United States Patent 8,781,750 (CELL-TYPE-SPECIFIC PATTERNS OF GENE EXPRESSION) - sequence listing, part 21

SEQ ID NO: 36618 - DNA, 153534 bp, Homo sapiens
gcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgagccgggggcgcccgccgaagctcgctgctccgggtcggggtccgggcccggggccggccgcgcgccgcctttgacgcatcggagcgcggctcctgcaggatggagggctccgcgccgccagcggagttgtttgtgcgcaggcggctcgcggggctgggagcgctcaaggtctgaacttccctccggagccgcagctggaggaggcgagcgcgcgaggaggagaagccgcgcggcgcggaggccaccctcggggcgagaggcgcggaaggcgagcgagcaaagcggtcccggagccacggcggccacgcggcggggacccccgggcgttctaggtccgtcccgagcggttctcgtgcgcctcgaaggtgggggcggtgggggcggtgggagcaccgctgagccgggaaccacaggaacagatggtgcctgtccaggtcgcgtgctggagccgccccttaggacaggagcaggtcccgggcctctaggcgtgcatgcctaggtgggagcgccgctaactctccccgttttgctggcaggtactggtgaccccggccggggcaggccccgggactcgacaacatggcttccccaccccaccagcagctgctgcatcaccacagcaccgaggtgagctgcgactccagcggggacagcaacagcgtgcgcgtcaagatcaaccccaagcagctgtcctccaacagccaccccaagcactgcaaatacagcatctcctctagctgcagcagctctggggactccgggggcgtcccccggcgagtgggcggcggaggccggctgcgcaggcagaagaagctgccccagctgttcgagagggcctccagccgctggtgggaccccaagttcgactcggtgaacctggaggaggcctgcctggagcgctgcttcccgcagacccagcgccggttccggtatgcgctcttctacatcggcttcgcctgccttctgtggagcatctattttgcggtccacatgagatccagactgatcgtcatggtcgcccccgcgctgtgcttcctcctggtgtgtgtgggcttctttctgtttaccttcaccaagctgtacgcccggcattacgcgtggacctcgctggctctcaccctgctggtgttcgccctgaccctggctgcgcagttccaggtcttgacgcctgtctcaggacgcggcgacagctccaaccttacggccacagcccggcccacagatacttgcttatctcaagtggggagcttctccatgtgcatcgaagtgctctttttgctctataccgtcatgcacttacctttgtacctgagtttgtgtctgggggtggcctactctgtccttttcgagacctttggctaccatttccgggatgaagcctgcttcccctcgcccggagccggggccctgcactgggagctgctgagcagggggctgctccacggctgcatccacgccatcggggtccacctgttcgtcatgtcccaggtgaggtccaggagcaccttcctcaaggtggggcaatccattatgcacgggaaggacctggaagtggaaaaagccctcaaagagaggatgattcattccgtgatgccaagaatcatagccgatgacttaatgaagcagggagatgaggagagtgagaattctgtcaagaggcatgccacctcgagccccaagaacaggaagaaaaagtcttccatccaaaaagctcctatagccttccgcccttttaagatgcagcagatcgaagaagtcagtattttatttgcagatatcgtgggcttcaccaagatgagtgccaacaagtctgcccacgccctggtgggtctcctgaacgatctgttcggtcgcttcgaccgcctgtgtgaggagaccaagtgtgagaaaatcagcaccctgggagactgttactactgcgtggcgggctgtcccgagccccgggccgaccatgcctactgctgcatcgagatgggcctgggcatgatcaaggccatcgagcagttctgccaggagaagaaggagatggtgaacatgagagtcggggtgcacacgggcaccgtcctttgcggcatcctgggcatgaggaggtttaaatttgacgtgtggtccaacgatgtgaacctggccaatctcatggagcagctgggagtggccggcaaagttcacatttctgaggccaccgcaaaatacttagatgaccggtacgaaatggaagatgggaaagttattgaacggctgggccagagcgtggttgctgaccagttgaaaggtatgtgcactgctttacctcggcatcccccctccctgatcctgattgtattaaattaaaaaaaaaagcttccagcctcagtgtctgcagacagctcaggtatctcagaatgccttaccatggggggatctcagggtcagtgtgacttttctttcagcgggtcaaatatcacagatctgttcacactgcagaaagggacgctgtgcagagatgacctagacgcgacctttagaaggaaggagaactttgaacgtgcataaccactggttggctgaaatgtgggggcacgtccggtgaatgtaagggtatggagcccttcagcattcagcactgtttagcacttaaggaaattgcctttgcattcatttggtcaccctgaagtcccatccaaatgtttctctctgccctttttgcgaaaacgtggagaataaaatctttctcctctctaggcctcactttgcttatcctcaaaatagggataggaagtcggcgcagtcctgcaggtctctggagaattagacggagttacttacctctgagtacacactgtcttttatctaggtctttttttttttttaaaaaaagtttgcattttcagctttcagccatcatttgtttaaggatattttattatcatagtatttgccttaagtgaagagcttcatattgagcttctccagccaccaggtgatttggaagggagaaacgtacctgccggagagctggtattcccctccctcatcctctcaggtttggatctggtgcctggtccctggtttgaagctccttactgctattcttgatgtttttactgggctgcttgttttttctaatataggacaaaagtctttgagatctggaaaatgatattaaaataagtaggacgaaaaagaaagattttaagtaatctgctacatttcttcccccacttcctcctttttaaacagtccttatgttttactaaaatcttcaggattgaggggaacatctgttgtggaagtatgtagagaaaataacactgattttttttaaaagcctgcttttgtgaagctgtattgtattttgtggtccccacacactgcatacttaaacagttaaaagcctcaggaaagggaatcctcggaagaagtaattaatagttccaatcagagatggcagaagtaatagtttcaatcagagacggcagaagtaatagtgtcagtcagagacgtccagtggttgaggtagggcctgcataggtcgttggtgtgagatcatcctatgtgtccagttggcattctctttctctggcttgtgatctgagctcctgtatcttttatgtatttgttctctggcaagggaacatcatctttcttctgatttttctttattttactaactttgctgttgaagattttatggatgtagacgaaaactattttcacccgagaattcccctaacctagagcactttaaggactatgttaacaaggtcagaaactacactttctgttcacttgaaagatgctgccgtgatgagtgtctttccgtttagggcggtggcactcgctcttgagtctgaaggtgtcagtggacggggctgtgggtgtaaccccctgcttgccaccttggcatttttagggcccaggtgttgtgagctctgtccttggagactgtgggacggtggagctgggcggcagtacgttaaattaaatatgttggcccagaggacaatgagaacgttttgtaagctgtactttgtatgctgtattactcgaatttcaaaaatgaagagggtgtaattattaaatatgtttggaaattgccaagtcattgaatacctattttgtgaatttatgagtagttttatttttaagtttgtagatcaggggtctcagacacagagccaaaaaaaaaaaatgctagagtgagtttgtgtttttttttttttaaacctcaaatagtgtaaatttggtaaattaacttttcttgacatttgtgtacattgtatatttataaaagttttagtactgtagggagtagggaagatagaaggcttagcttagctgctgattttttaaaagtgatattctttcctttagctctttctctgagaccacgattttgttttcttgagctcattttacaaacctttgtggataggactccaggaatagagtatgtctacacaacttcctggcccttttggaaactgtccttacaaagctaaattgagatgacagcacagtttgtagaagaccctttcacacacatagttaagcttatctacatgtaagatcgattttagcctctgcctttgggctggtggcagatgttttctctatacaatattgggtattacgggaggctgaggcaggagaattgtttgaacccgggaagagaaggttgtagtgagccgaggctgcgccactgcacaccagcctgggcgacagagcaactctgtcttaaaaaacaacaacaacaaaaacaaaaaaaaccccaatactgggtgtattagcctttccctcttacccccttttctgatcccagggttaaaaagcagccagtagcggccctgcaggaatgggcatccatagaatgagaaggggcttctagaactagcctgggagcacagaaggaagctcctctcattcaaatttatccgaacaggctttgcagaagggtagtttcatgatttctgcacattccttcactctgaaatctgtgtcgtgcccctggcactgactgtgcacctggcactgtggatgtggagcaggatccgtgatcgtggagcaggatccgtgatcgtgaggtaggaggtgggactcgactccagaggcggggttcagatgccagaccgaattgaggactagctgatacagggatggggcagaagcagcgttctgcaaggcacgcccaccagtgtgccttgttagtttactgtcgccatggccacacccggagttactgcctctttccatggccgtgacctgacaacccaaaagccaccacccttttcctagaagtgtctgcctaagcctacctttactctacaggaaattaaaagtaggtataaggtaaggctgggcgcagtggctcatgcctgtaatcccagcactttgggaggccaaggcgggtggatcacctgtggtcatgagttggagaccagtgtggccaatatagtgaaaccccgtctctactaaaaatacaaaaattagcctggtgtggtggtgtgcgcctgtaatcccaggtgctcgggaggctgaggcagaagaatcgcttgaacccaggaggtggaggttgcagtgagctgtgatcatgtccactgcactccagcctgggcgacagcctaggcgagactgcgtctcaaaaaaaaaaaaaaaaaaaaaaaaaagtaggtataagtatgattgcaaaactgccctgagctgctactttccgcctttgggaaagcccagctctgcaggagcagtcatggagccgtataacactgcctgcctcttcaataaaggtgttttctttcctgccaccggctcacccttgaattatttcctgggcaaagccaagaaccctcttgggctcggccccactttggggcgcgtctgacctgcgttaatagttcccaacctccgtgagctcacagttaaaaatgttgtggagtatgttcgggagtggggagcgctttagagggggctcctgctggagctgggtcctgagatcaggctgtggctctccaggtggacagaagagcaccagggcagagcggagaggtgggtatggctgggccctgtgcttctctgtgggggcggacgattgttagttgttcatcaggacaaggaaggccatgggtagcgtgggaaggagtttgcatttgaccccataggtgtcagggaaccactcaacagggggcttaggtgatctgacttgcagttttagaaagttcactctttcagagctagtgagtgtgggttggaaagagattaatgaggtgtcgagtaaatcccaggtaggggtgatggtggcccaatccaaagttacagtagcagtgatggaggtgatgggatctgagtggcattaggaagagcagcttgatgggactgcaagccagatttaaacaaacgactggcaggaggggaagggcttgaccatgtgaatgggaaatggcattttaagtttctggaagtgacttggcgacaatgtggagtcaggaatgggtgaggggcctttgaagttgctatggtatgaatggagaatgcaggatggacttgcagagtacagaggcccggaacccctggcttgcttactcattcagcaaatcatttactccgtgccaggcacggttctgggttctggcaatacagccgtaaacaaaacagacaacaattcctgctcttgtaataggggacaagaatttttaagtcaataatataggaggatcgctggagcccacgaggtcgaggttgcagagagccgtgattgcaccactgcattccagcctgggcgacagagtgagaccctgtctctaagaaacaaaaaccaggccttcaaataggggagatctaatagaggggacaacaggggagtcaaaccataaataagtaaaatagaaaaagtgttttgtgaacaaacataaagcaggaaggggatacagcagatggggtgtacgagtgtgagaaatcttatctagggtggccagtcactgggagaaggttgcaggaatttttagcatactgctaggattttggaaataatctaaaaagtgaggggccaggcatggtggctcatgcctgtaatctcaacactttgggaggccgaggtaggcggatcacctgaggtcaggagtttgagaccagcctggccaacgtggtgaaaccccatatttactaaaaatacaaaaattaaccaggtgtggtggcaggtacctgtaatcccagctactcgggatgctgaggcaggagaattgcttgaacctgggagacggaggttgcagtgagccaagattgcaccattgcactccagcctgggcgacaagaatgagaccctgtctcaaaaaaaaaaaaaaaagtgtgagggacagttattaaagatatggagaaatgggccgggcgtggtggctcatgcctgtaatcccagcactttgggagaccgaggtgggcagatcaggaggtcaggagtttgagaccagcctgaccaacatggtgaaaccctgtctctactgaaaatgcaaaaattggctgggtgtggtcgcaggcgcctttagtcccagccacttgggaagctgaggcaggagaatcgttcgaacccaggaggtggagtttgcagtgagccgagatcgtgccattgcactccagcctgggcgatagggcgagactttgtcgccaaaaaaaaaaaaaaaaaaaaaaaaaaaaaatgaagaaacggtctgattaaggtgagggaccttccacagcatttgggatgaaaccgctaggcctgagggaaccgtggctgttgtattctgccttgggccacaagcaaaaaatggtgagacgtgttatctcgagctgttggcttttcctgtcatagatacagggtcacaaagacagaaaatgaaactgttagaaaatatctacaggcatcttcttttcccgtgtaaatattaggaagacagaatgaagatgctcctccgctctcatccacacccatggtcatatctctgaagaggggaataccagggagtgatcacattgtcagatgcagaaattaaaaaagcttttttccccagccaaactttatgcttgtggagcaacttggggaggagacccgctggtatgcatttgggcagattgtcacctgttggccacctctgtgatcgagacctttgccttagaggagttcctatgtagaccctgtctggtgggccgacagaccgacagtggacggaggcattctgtatgcgttagcctctgcaaacaaacacctgtctcatgccggaaatctgggcgccccattaaccctgagcacgggcctgccagctgacagaaccctagccaggtgttggtttggggttcagttgcatgctcaggtgttccccttccttcccccgttagcttgtccccacctaagcctgcaacccttgccactgggatgctaacccgttagcagagctcagtctccttgcttggaaattctgtgttgacctgcactgcattcttttttttttttttttttttttttttttgagacagagtctggctgtgtcacccaggctggaatgccatggcgtgatctcagcttactgcaacctctgcctcccaggttcaagcggttctcctgcctcagcctcccaaatagctgggattacaggtgtgcgccaccacgcccggctaatttttgtatttttagtagagatggggtttcaccatgtaggccaggccggtcttgaactcctgacctcaggtgatccaccagcctcagcctcccaaagggctgggattacaggcgtgagccaccacgcccagccttgacctgcattcttgagcaggatctgttatgcacgtggaaatacagcctctcagatagcaaatggcagagatgagatgaggcacacagttcccctccacagctggggtgggagacagaaaacagcagtagagtcgacactcaagctgcccccagtgaccatttgttcaggctctttgagacctggcttacagtgacaaggacacagctgttaattctgaagacaagctttcgagtagaagtaacctctggtaaagcaagagaaggttaaggtttgctgaattgccaatgggatgaagaaggaagggagggctgtcttttcaggtagaatgcctaaggaagggaaacatggagaaggaacaattagagcaagtcaagaagtttcaagatttttgtcttctggccagcttggtgagatagtaattatgtttctgcatattggtcagcgttgcctatgtactttgctgtggaatagtaatcttggaaaaaaaccaaccaaccaacccacattaatctgtccatgtctgggcacagagtgtgcagaagcctgcgtgggccgtaagtctcgtctttgtcttggttggtgattttagtattggtgtttttgctggaattccaaaactgtaagagtgtaatcattcaccattagaattctgcaggtcccctcctgactctggactagctgagcttaggggcctgtcatccatctggccctgggcatatcatttgtactttgcctgtgacacacctcaagaccttttccaacaggaactagcatccctggagggaattttgtgaagagatgagagtttttgaaacaggaagggaactggcaagggaagtggccaggcaccggtgctgccgcggaacagaagggaagggactgggctgcatcagagggtggatgtggggccgccatccgtggtgtgggccaagggtagggtggtcctcccctgggaagactgcagacagcagtgatattcttgtagtcttgtggatgtacccagtgaaccacaccagccaagccaacccgtggctaaattttagtcaacttcagcgaagaagactgccccttgtaaaacttgtctgctcttggaaatcaggttttttgtctcattttccccagcctttgctagcattgcacttgtaaaaaattcctggcatcctttctgcggagttaagtgggaaggctcaatgttctgggataggtgggaacatcaaacccgctagaggctgctggtggcagtggaggcagaatgagttgtagcagtagtggtggcagtagtgtgacctagagggcagaagctgggaaacagggtgaaatgctgggccccgacagtcagggatagctgcacctagcttatatgccttcctctaatccagtagaaattgttgtttctgtaggttttttttcttttctttttgagacagggtcttcctctgttgcccaggctggagtacagtgtgcagtcacagttcactgcagcctcgacctcctgcactcagatgatccttccatgtcagcctcttcagtagctaggacacaggcgcatgccaccacatccaactaatttttttttttttttttttttgagacggagtctcactcttgcccaggctggagagcagtggtgtgatcttaacttactgcaacctctgcctcctgggtgcaaggaattctcgtgtctcagtctcccgtgtggctgggattacagatgcatgccaccatgcccggccaatttttttttttttgtatttttagtagaaatggtgtttgaccatgttggccaggctggtgtcaaaatcttggcctcaagtgatctgcccgcctcagcctctcaaagtgctgggattataggtgtgagccaccatgcccggcctaattttaaaaattatttgtagagatgacgtctccctatgtttcccaggcttatgtgcattatttatataggttgtctattgatatttacagtattagaaattgaaacaaactgagaagcttaaaaatcttttctaaatttatttcaaaatagtaattcatttcacccattgcatgttaatgtaagtaacatttttataaaagtaactatattttgtaaaatgaaaaaatttgatgagaagggtggcactgccatacatttttgcaaatctctttaatgtctggattaataaacggttgaagttttttgttttttttttggtggatttttttccctcttgttgcccacattggagtgcagtggcacgatctcggcttactgcaacctctgcctcctgggttcaagcgattctcctgcctcagcctctcgagtagctgggattacaggcacgcaccaccacacccggctaattttttgtatttttagtagaaacagggtttcagcatgttagccactgcgcccgacccacggctgaggttttttgagtgataaaatgtacacaacagaaatctaccgtgttaaaacacttttaagtgtgttcgctgaattttcttaaccgctttggcattcaatttgttgcaatatgttgaaaaatgtgtagaaaatctggctttagttggaagagcattttcatagcctttttatgtgattctggatatttttctttgattctgtagaaacattcaacaagtgagtagtagtttctttttctttttctgagatggggtcctactctgtcacccaggctggagtgcagtggtgctaccatagctcactccagccttgacctcctgggctcaagtgatccttctgccttggcctaccaagtagctgggactacaggcatgcaccaccacaccccgctgattttttattttgagtggtagtttcttaaatgttagttgcaatatggaatctgaaattttattatctttttttgtacactattatattaaatgctgttgggtttttacccaggtgtgattttataacgtcatgcactagtcatttggaaaatattggtctcttgaatgatgcagctcttccacatgttgacgtcagtaaagtctaatagtctgaagatgttgagttcatcacagtggctgatgtaagttttccaaaactctacttgaaaactggaattttttatcattggcggcaaatactgtcagttattttccttgaagcgacagactcattcatattcccaggaatggtctgcccgtactcaagcctgaacgaccgtggtttgtctgtaggtcacgtgtaaataatgtgctaccaaaaaggtggccagttcagcttgcaatccaaacagctgcacagctgcttttctccaggaccgctgtgctttgatgggcagcagcgtcgtcgtaggcgtgcttctcatttcatcactcagactattcagaagacacctactcaagcttgcgatttaaccaatcattcatgttgacagcttcatctgggacattcttttttttcttttttctgtttttgtgacagagtctcgctctgtcgcccgggctggagtgcagtggtgtgatcttggctcactgcaacctccgcctcctgggttcaagtgattctcctgcctcagcctcccaagtagctgggatttacagatgtgtgccaccacgcccggctaatttttgtctttatggtagagacggggtttcgccatattggccaggctggtcttgaactcctgacctcaggtgatctccctacctcggcctcacaaaatgctgggattacaggcgtgagccactatgcccggcccatcagggacattcttaagtgaagctgtctgcctttcctttcgtaagtgtggggtagtgaaggacaagctgagggctagtgcagtttggtttccctgcatcgggacctgctcaggcactagcagtttcacccatggcttcttctgcactgtcactgcaagtgtcaacactgaagaaggcaaatgctgtcttagtgtcattgtgcaaatagtttagactccacagatgccttgcaaaggcctcaaggacctctagggatctgcggatcacactttgagtactgcttcgctagctgggctgcaagatgggaagactgagggttttgtatgtgccacccaaacacgcattctcatgtgtgtgaaacaacgccaattggagttgtcacacccattacatattgcctgtggaaatagcaagtgaccttagttcatacattgaccttttcttacaaaatccttaaaaatcttttgtgattctggtaaatctttgttgctcatgttcaaagtgtgtgataaagaccatcaacttcgagctggccatggctcgtgcctgtaataccagcgctttgggaggccgaggtgggtggatcacctgaggtcaagagttggagaccagcctggccaacacggtgaagctccgtctctcctaaaaatactataattagccaggcgtggtggtgggcacctgtaatcccagctactcaggaggttgaggcaggagaatcacttgaacctgggaggcggaggctgcagtgagccgagatggcaccactgcattccagcctgggcgacagagcgagactctgcctcaaaaaacaaacacatggctgggcgcagtgagtcacgcctgtaatcccagtactttgggaggccgaggcgggcggatcacctgaggtcgggagttcgagaccagcctgaccaacatggagaaaccccgtctctactaaaaacacaaaattagccaggcatggtggcacatgcctgtggtcccagctactcgggcggctgaggtaggagaattgcttgaatccaggaggcggaggttgcggtgagctgagatcatgccactgctctctagcctgggcaacaagagcgaaactccatctcaaaaacaaacaaacaaacaaagaaacaaccatcaactttgtttctgtaaattttttttggaagggctcacccttgaatggttgggtgcttggattttgatttctgatacattcgggcttaattctcggttgtatggtttcctaactgtgggactttgggcaagctacctaggggcgctgcaatttataggaatgatggtgtctctgtcagagggtcgttgggagaatcaactgggataatgcaagaaaagcacttatttgcatagtgactcgatggtggacagccattccatcaataactaacgctccccgctggctgagtcacatttcgtattgcactaaagggtgtttctttcttcctgcgctcaatctggcgcacatcttgtgtcgttcagtaccgaaacctagaacacactagggactgtgattgtgtcagtttctcgtaataaaaagggcaagtgtccaaaatacaaaatactgatagctcgccctggttaaactctagctgccgaacttggcagcctctttactgaaaaccctcgggggttcagcaggctcgttcctaggctgcttcagttccccagagcctggaggttcttaagatgatgggcccctcgatggttgaggaattataagcagatcttcagctgtgcaactccagctattggccgtggtttgaactagagtggtttttttcaactgtactgtatcctactgtaaactcatttgtttattcattaaatattgaatgggttcctaccattggcaaggcgaggactaggttctggagatagaggggtggcccctgccctcttggggcatgacgcctagaaagggaagtagacagtgatcaaataatctgtacaggccaggtgcagtggtcatgtctataatcccagcactttggaaggccaaggtaggaggatcgcttgagtccaggagctcgagaccagtctgggcaacatagtgagaccctgtctctaaaaataataaataattagccgtgcatggtggcatgtgcctgtattccaagctacttggcagactgagatgggaggatcgtttgagcccaggtggtcgaggctgcagtgagctgtgattgcaccactgtactcagcctgggtgacagagcaagactctgtctcaaaaaaaaaaaaaaaaatcacctgaacaaatattgtactagacttcctgactgtattacagatagggttgagatgatctctattttatagatgagaagactgaagcacagagaggttaggtaacttgtgatgatcacacagccagaaagggatactaaatggtggagccagtatttaaacccaaaggctgtattagaaaacactagtacccatctcacagaattgctgcgaggattaaatgagaaaatacaagttcttagaaaagttcttggcacataatacctgtcagtagagaagagctagtgttactgaaagttggaataattttcttagcagtggcagcaacagccaaaacaacgatacctgtctttagctctctgcatttaccctgctgtcatgtaccctgccctcacgtatcctgctgtctcagccactgtgaaatcctaggatcctgggagccgtgtgtgtttagatgcttttatttgcttggttctttccctttctataccatttacagactgagtttgtttttttcttttctttttttttttttttgagacaagagtctcactcctttgcccaggttggagtgcagtggcataatctcggctcactgtagcttccacctgtatcagaccattctaacactgctataaagttgctacctgaggccaggtgcatggctcacgcctgtaatcccagcactttcggaggctgaggcgggcggatcacttgagctcaggagttcgagaccagcctgtccgacatggcaaaaccccgtgtctactaaaaatacaaaaaattagccaggcgtggtggcatacgcctctaatttcagctacttgggaggctgaggcaggagaatcgctggaacctagaaggtggaggttgcagtgagcccagatcgcgccactgtactccagcctgggcaacagagtgagaccccatctcagaaacaaacaaacaaaaaagatgctacctgagactgagtaatttataaagaaagcaggtttaattggcacagttctgcatggctggggaggcgtcaggaaacttacaatcatggcagaagatgaaggagaaacaaggcgcatcttaaatggtgtcaggagagagagagagtgagagagagagcatgcgaagggggaactgccacttttaaaccatcaggtctcgtgagaactccctcactctcacgagaacagcatgggggaaaccacccccatgatctagtcccctcccaccaggtccctccctcgacacatggggattacaattcaagatgagatttgggtggggacacagagctaaactatatcaacctcccagggtcaagtgctcctcgtacctcagcctccctgtgactgcacatgtgcaccaccacgcccagctgattttttcaaatttttgagagagacagggtcttgccatgttgcctaggctggtctcaaactcctgggctcaagccatcctcctgccttggcctcccgaagtgttgggattacaggcgtgagccaaggcacccagctgagatggtttcttaacgtcctccaaaggtgatttttttcaagaatcaatataaactcttggattttagcttatttgatgtatttcattccattacagatacatgatttttgatgctcagattgtcccatttggggcccatgggagcccctttaagttggctgctgagtcctcttcatgcaaccccagtggtctttgataactttcatacccttttagtaacctttttaaagagttgagaaattataggtattaaaatctcattaattctgtttgtctgatatgtttattcagagagactgagctaaagtttaccctcatcttttttgaaaagaaaatgaatagtatatgcatgtttctatgaggaaataatgccacccaagaaacggtttgtgcatcttcgagttccttggaagctttaatttgcattcctacaattgagagcaatgtagaatttctttctgtatcttcccactaatgcctgttgaggggcaggtgtctgtgaatgtaggtaaatcgtgataaaaaaacaataaaaaggccgggcgtggtggttcacgtctgtaatcccagcactttgggaagctgaggcgggtggatcacttgaggtcaggagtttgagaccagcctggccaacatggggaaaccctgtctgtactggaaatacaaaaattagccgggtgtcgtggcgcacacctgtaatcccagctactcgggaaactgaggcaggagaattgtttcaacctgggaggcagaggttgcagtgagctgagatcacaccactgcactccagcctgggtgacacggtgagaactctgtctccaaaaacaaaacaaagcaaaacaaaacaaaaccaaaacaataaaaaaaaatcccaaaccaaaatgtagatgacctgtttgcagactgaggagtcctgcagcaaactccatcccccaggacagctgcggaatgttctagaaggcccaactctaggaaatcccttagtaggagccttgctctcaacagtgcctcctggaacgatgggccggccactctcttttccatcttgcatcatatgtatttgacttattttgtttataatctgtttccacgccactggaatgtatcttaagagcaggaattttccatgttttacttcctgctgtgttcctagtgctgggaatatagccaggcatataatacatgcctgataatattggctgaatgaatgaatgaataaatgaatgaatattacaggccagacacagtggctcatgcctgtaatcccagcactttggaaggccgaggcgggcggatcacctgaggtcgggagtttgagaccaacctggccaacatggtgaaaccccatctctactaaaaatacaaaaattagccgggcttggtggcgtgcacctgtagtcccagctactcgggaaattgagacaggagaatcacttgaacccgggaggcagaggttgctgagattgcaccactacattccagcctgggtgacagagtgagattctgtctcaaaaaaaaaaaccaaaaacaaaaacaaaacaaaacaaaaaatcccaaaccaaaacgtagatgacatgtttgcagactgaggagtcctcccccagcccagcaaaccccatccctcaggaccgctgtggaacattccagaaggcccaactccaggaattcccttagtaggagccttgctttcaacagtgcctcctggagctatgggccagccactctcttttccagcttgcatcatatgtatttgacttaattttgtttataatctgtttccacgccactggaatgcatcttaagagcaggaattttccatgttttacttcctgctgtgttcctagcgctgggaatatagccaggcatataatatatgtgtgataatatttgctgataaatgaatgaataaataagtaaatataagcctggtatggtggctcatgcctgtaatcccagcactttgggaggccaaggcaggcagatcagctgaggtcaggagttcaagaacagcctggccaacgtggagaaatgccatctctattaaaaatacaaaaatcagctgggcatggtggtgggcacctgtaatcccagctactcgggaagctgaggcaggagaatctcttgaacccaggagatggaggttgctgagattgcgcccctgcactccagcctggatgacagagcaagactctgtcttaaaaaaaaaaaaaaaaaatatatatatatatatatatatatatgtacatatgtatttatacatatatatagtgtgtgtgtgtgtatatatatatatatatatatatatatatatatatgtaactccacatgtgagtaccctgttatgtgtgaaaccacaccccaaacatctacacagaacaagcctccaggtagaggaaaggcagtaaccgctttgctggaatgactgagtggttcattaaatagaggctccggagggtcttgataggctctagcaaaggtggtggccgagagggctgaccagcgcatggtgcctgggaatgtgaatgggcccaggggcgccagagtgtggacagcttgggactgtgggctccgaggtgctgcgctgagggcgtggggcgcagggcagaaacacagaggactgagtgcttaggggaggcccaggaaatgtggggttgaacggcctagttctggcaattgtttttaagctttgtaagatggagatttcaagaagtatatttatcttaataatattgtagctcctggtaattcttatttgattaccatttatacacatggaaaaccagcatgcctgtttctggcaaagctccagggtagtctttgtgcataatttccaggatttttatgtaatgctattaaaatctgttcttttttttttcccccttccaaagcggggaaaaagcagcttttgaatcatttattttcgtgtttgagttgtttgggaaatattaactacattttctaacactctagcctggagaaaggaagaaaccccacatgcgtgtgatttatttccttgtgtatggatattaaatgcaatataccattaaggctatgacactttaagtgaaagtgtttattgcatgttgattcagttagttcgtaccctattgtgttactatttaaagtgtggattgcatcgcattctggaacttcataaatgagttctttttcccataaggaaaggccactgcttctgatgttcattaatgtgatttttgtgtgtgtgaatgagctgcctaaaaactgggtgtggtgagggtggtttctgaaagggaagcacttttatagcatgatcttatttgaaaatttaatttgtttttgtaaattagcttttggtcttaatacatttcctccactaacaagcacttttgggcaaataatttaatctctctggttctgcttttttcatattggtaaaatataaagtttgagatagatatgcttaaaatctccaccattgtctaagtatagctgagattctcacgtgattgggacatagtgctcattcttaatttgaaaagtgtttttttctttgtcctcttgtttcaactacgaactctcatttagacacatttagcatagggaagctccgatttatagagccactaaattgcagggcgtgtgtgagatttgtaacttcataaaagattctttacttcctttaaatataaatacgtaagattgagttctagaagtataatttacacatggtttcctgaggatcacgtttcctgaataaagcagggtatcgttagaggaaccccatttgattttttttttttttttttttttgagatagagtcttgctctgtcacccagggtagagtgcagtggcgtgatctcagctcactgcaaactccgcctcctgggttcaagtgagtcttgtgcctcagcctctcgagtagctgggactatagtcatgcaacatcatgcccgtctaatttttgtgtattttgtagagatggggtttcatcatgttgcccaggctggtcttgaactcctgagctcaagcaatccagctgccttggcctcctaaagtgctgtgattacaggcgtgacccatggtgcctggtctgggaatcctgtttgattttgaaagtctgagaaacacttttgaaatggcttggagaaaatgtgaagtgaataattattatttttttaatgtgcttcagttcccatgtgaacattattttagagagagattggaaggttagttgccagtaaaatgaatttcactgtgttggcaagtttttcactcgtaggactgagtgaatcctggactgacagtgttcttaccgatgattctgttgaggaaggacttgcttgctcttgttgctcttgacggtgagcttctggatctactggccctatattgagtgtgcaaggggacgtgttagtcctctagttgtcccccacattaatgcatctggaaagtgtctaccttagatgttgtaattagaaattagagggctgggcgcggtggctcacgcctgtaatcgcagcactttgggaggctgaggcatgtggatcacctgagatcaggagttcgagatcagcctggccaacgtccgaaaccctgtctctactaaaaatacaaaaattagccgggcatggtggtgcgcacctgtaatcccagttactcagaggctgagacaggagaatcgcttgaacctggtaagtagaggttgcagtgagctgagattgcgccattgcactccagcctaggtgacagagactgtctcaaaaaaaaaaaaaaaaaaattaaatgtcatcaacattgaaaggaaactcttggattttgtcaaagatttataaaaagttttgaatgattttatttttttcattcagaagcataatttccctcttaaaatccctgatgtggatcatttggttccctgtcatttccattttctttgttcagagtgtctcttctggatctcctgagtttctgtgtgtgttttcttcctttttgctcaaatgatgagcacacatgaaagcttttcctcctttgcctgggtgaggcggtgttccaggtgtgatctgcagtgcctgattattatattgtattaatctcctcaattttattttctggcttgtctgcatttttccttttctttcttctcccttttttttttcttattagagatgggggtcttgctgtgttgcggggcctcgagcgatcgtcccactttggcctcccaaagtgctaggattacgggcgtgagccacagcgcctggcctccttttctttatagtaatttgaatgtggtgattttaatcctccatggttttcttatccttcctcaacaaacagcaaagaggctgctggaaagccacatgacatttgctgtgatttgcacggctgatgggaaaacactacttggttctgaaggacagggttgtcattggatacctttgccctctgacccgagtgagaatctcacctggacaaagacccgagttgtgaaatcacacagagaaagtgtgattccgaacctgctgctgtcctgtgcttcctgaggacaagtgagtgactgactccgtgtgccaggaactgcaggaggttaaaaactttcagaactaccatgcaaataagaaatttcaaaggacttttctctaacacacatttcatagtgaacgtctcagctggattaacataattaacgctgtgttctttctggctcctgaaagaaattgtgattaggaacactttcagggctgatgagtctaaggtatcaactttgtcccttctgccacttgaagttcaaatggaaatgtttgctttcatagctccagtcatgatgttactgtatttagtagctattaagtttccaattccatagactcctgggagaagttccagttcgcactaaggcttctgttgcatttagcaccactgcctatggtgtgtggagctttcctgaacaagtaatagcagcaaggttcttagcttagtaataattttaagctattctttgattttttaaacaattaattaattaattattttgagacagcgtctggctctgtcgcccaggctggagtgcagtgacgtgatctcagctcattgcagcctccgcctcctgggctcaagtgatattctccagcttcagcctcctgagtagctgggactgcaggcgcatgccaacacgactgactaatttttgtattttttgtagagacaaaaatactttttttatgtagagacaaaaaaaaagttgaatgataaaatcttttattacttaataatatactttgattgagatttagccatttcattttcactagtgtccagacgttttcctgaaaggcgtgattccatgagatttaatactgaattataatttgatgtaaatgttttatataatcagttgtttgtttttaaacagtagcctcttttctaggcctgctctaggttgattaaatattaagttttctgatcagccagatccttaatagagagcttcggggacagcaaatggttgaatatgaaaccaacctcatttgccatgttgttagatataaatgtcagtgatagcactttctggatggttgagttttctgaagagcagaggattttctcttttaatcaatcagataattttctgttttaaccaattcaaacatttgattttatgtttctgaaatagataaagcactttcataaaaatggactgtgccaaataagaggtaattttcttgatgactcagttatttttgcctcttgttatttggcttttactaatatagcaatttctctataaaaataggaatctttgcttttttaaaaaaactgagatcattctgtttttccagttcttacattttaaaaaataatttttttggcttcttttgctatccatgtatgtagctgttggtgtgctttcctgtatcacatttgctcctggtttttacttcgttacattaaaaaaccaaaccaacaagtaattaagctcgttcagcctgcagatatcgtttgatggaaagggctaaggagtcagcctttgtgcaggtttttagttgtcagctatagtctgagtaagtgaggttgctaggtacaggcgttcaggatgtgtaagatgttattacagttatttttagtgtattattaagggggaggaggagaaagagaaatttgaatcaaatttgtgtcttattaaataggacacgttttccataagaccaaaagggcatttcttttgcttatgtactagaaatagaaaatggaaattagatattagattgtataatcgaaagtcaattagaattaatgaacaattctataactagttatactgtaagctaaaatgtgaatgttaaattagggaagtattgatttttatgaaaatttaccagaatttcaggaaaggactttgcttactttcccaagaaacgtctggtaggagtcactgtagaaatttggtgtgttctgtacaacactgcccaggaggaactggccacatttcttcctacttggttcttttgtttgtttgttttttgagacagggtcttgctctgttgcctagaccggagtgcagtggcacgatctcagctcactgcaacctccgtttcctggattcaggcaattctcgtgcctcagcctcccaagtaccggtgattacaggcacccgccaccacacctgtctaattttttgtatttttagtagagacagggtttcaccatgttggccaggctggccttgtactcctggcttcagatgatctgcccgcctcggcctcccggagtgctgggattacaggcgtgagccacagtacccagcctgctttatttttaattgaagctaaattcacataacttaatgatttttaaggtgaacagttcagtggcatatcgcacattcacagtgttgtgcaaccatcccctgggtctaattccgaagcgttttcatcacccctagaaggaaaccctacacccactaagcagccacttcccagctcccaagccctagcacctggcagccgctgtgctgcactttgcatctgcaggatttaccgagtctgggcgtttcttatacttggaatcgtaggatacgtggctttgtgtgtctggattctctcgctcagcatgtttccaaggttcattcatgttgtggcatggagtagtacctcctttttgttatgggtgcataaaattccattgtatggataaaccacattttgtttttccattcttccattgatggacattagggttgtttctgcctcttggctattgtggatggtgctgctgggaacactcgtgtacacgtttttgtttgagtatctgttttctcagttctttggggcacatacctgggcatggagttgctgggtcacgcggtaactctgtttaactttttgacaaacctctgccacttttaaaatgaggaacttgggctgggtgcagtggctcacgcctgtaatcccaacactttgggaggctgaggcaggaggatcacttgaggtcaggagttcgagaccagcctggccaacagggtgaaaccccgtgtctactaaaaatagaaaaatcagctgcgcatcatggcgcgtgcttataatcccagctactcgggaggctgaggcaggagaatcgcttgaacctggaaggcagaggttgcagtgagccgaggtcatgccactgcgctccagcctgggtgacagagtgagactctgtctcaaaaaataataaaataaaataaaataataaaataggaacttatatgaagaccctgtaaaaagttacctgtggcagtccgatgttttggaaaacatctgaaagcttaggtcaatttggtcatagatgtggctggccattatgtttcttgattgaaataattactttgttcactaccattcggaatagttttgtgattaggataaaaattataatgtagatataagagcctagagactctttttatatgaatgcataagttttggctgttcccttcaaattggcatgaggcttggcaacactggaattgtgtgttagataaacagttggtatctagggcaagcttgaaaaaaaagtagtatttaaacattgaccaaaaaaaaaaaatctcaacaactctaggaacttccttgttcaaatgaatccacaccgtctaaatacagcgtgataaaattaggcttccctctggtttccgtggggtcgagtgagccctgagcgtctcgtgcccagccaggactctgcctgctggctggcttcggagcacagggaggtgggacggtttccacggccagcagtgttcccacagcacttccttaatatagaacgtttttaaaagcagcgttggccacagaaaaagctcaactcccaaacactgtcatcagttcatagttcatttttattttgttttcatgttgttaaaacaagaaatagcatgtaaacatgtctgcattaccgaacatcagtagtgtttaggatagaagaggaacacattgagtttctaagtagaaaaaaaatctgttcatccttaaaggcaaaggaaggggcaaggtccctccttgaacaactgggtgaggttggacgcctccagctgtatttgctaagttgggcttggaagtatccatagggcgtggggggcctgctccagggctgacctcagctggagtcccctccaagtcaggggtatcgctcggcacacatttgtatgagttcacctgaaaagtgcccttgttgggggagcttggaatggcctgtagggcagctgggtcacagtggctgccggggatgcctgccaagctgttaagcagccctcgggcccacggagtcccagcaagtgtggtttactgtttgttaggatgtaattcaagcctgtgggtaggtaaaactacccaggattaaggggggttggcttttccagggaacaaaaggatcccaccagggagaggactgttctgggaagtgccctggtcccctgtggccaggcttgatttgctctctctttggaagccaccttggcacgcaggcactggtggaaaattttggagtacctgctggaggttgaagatgtgagcacgaagaaaccatggtcttgtctcgggagcctcccagactttcccctttacggctggtgagaacgtgaaatggttcacttgctgcagaagacagtctggcaggtccccaaaaggttaagcacggagctaccgtagggcccagccatgccactcctgggtttgtgcctaagaggtgaaaaacacacatccacacaaaaacttataggaatgttcatagcaacattatccacaattgccaaaaagtggaaacagcccaaatgcctgtctgctgatgaacacataaacaaaacaagtaacacatcaacaaaacgtagcacctctgtaggatagcatacgattcagccttaaaaaggaatggagttctgatacatgtgacaacgtggacgaatactgaaaacatgcccagtgaaaaaagccagaccacaaaggccacgtttcgatcgcttgagcccaggagttcgagaccagcctgggcaacatgtcaaaatcctgtcaactcaaaaattagccaggcatggtggcatgcacctgtggtcccagcccctcgggaggctgaggcgggaggatcacctgagcccaggaggtggaggttgcagtgagctgagattgcctgggtgacagagcaatctctgtctcaaaacaaaacaaaacaaaaacccaaatgccacgttttatatgattccatttctaggaactctagaactacaggcaaatccatacacacaaagtagattagtgatggccagggctggggaaactgaagggaaatgggaggtgaccgccgatgggtatggatggggtttcctttcggggtgatgaaaatgttctcgaatgggctatggtgatggttgcacaactctgtgtgcgaaacctccctgaattataaactataaacgagagaattacacagtatatgaattctctctatataaagctgttatgaaaagcgaacctaccagaccaacattaacaattagagtatattgtagtacaagacagttgtagattggcaagataagattggacatagagattttgtagattgtggagcggagagggatgaggtggacggtgctgttacagcctcttaggagggacagagatcctgaggtgatcaccgagcttcaggatcttgttcataattttgagattaagaatcttggtttggaatcccatgcctgtcatcccagcacttcgggaggccaaggtgggcagatcgcttgagctcaggagttcaagaccagcctggttcacatggtgaaatcctgtcgctgcaaaatgcaaaaactagatgggaatggtggcacgtgcctgtagtcccaactactctggaggctgaggtgggagggtcgcttgagcctgggaagttgaggctacagtgagctgagatcatgctgctgcactccagcctgggcagcacagcaagaccctatctaaaacaaagacaaaaacaaaccagaatcttcatttccatcagtcttcagaactgtgtgagtttaggagttgtgattcatgctgaccatgagaccgatgtataaagcaggtgccagtgtattaagttactttggggaatatgatgtacttttccagtggctggaatattaatatctacttcccaaggcagttcctccatgagatcaaggtatctgtgaggcctcattaatagtaacaagttagccgggcatggtggcacatacctgtagtctcagctactggggaggttgaggcaggagcattgcttgagctcacactgctgcacaccagcctgggtgacagagtgagactctgtcgcaaaaaaacaaaaaaaaagaagaagaaaggaagaaagaaacgaaagaaagggagaaagagagggagagagcgagagagacagaaacaaagagaaacaaagaaaagagaaagaaggaaggaaggaagagagagagagaaagaaagaaaataaatagtaacaggattgcttcaggactgtagtatccgagcaaatagtaacaggattgcttcaggactgtagtatccgagcaaatagtaacaggattgcttcaggactgtagtatctgagcaaaggatctgatttgatccagcacatcccacgagggactgagtgtttatgcccacagactcagtgccctccctgaactgtgcagagtaaactctgccaaactcttagctgttgttgttcttcttttttttttttttttttttatctttttgagatggaatctcgctctgttgcccaggctggagtgcagcaatgtgatcatagctcactacagcatccacctcttgggttcaaacaattctcatgtctcggcctcccaagaagctgggattacaggcatgtgccaccacatgtggctaattttttgtatttttaatagagacagggttttgctgtgttggccaggctggtctcgaactcctggtctcaaccagtctgcctgcctcagcctcccaaagtgctgggatgacagacgtgagccaccgtgcccggccttccttgttcttaaagaaggagatgttacagaacaaacgaatctccatacaaaacaaaacctcaccataaaagaggaaactccctgcttcatgaggggtgcaggtaaatgtagaaacgctcaccaagaaagccagagtggatttcacattaatagaatgcaggtaaaagacataacttgttgggatgtagggcgcagtatcagaatggaatagggttcaggtgagctcctaggatggcaggatttgaagaaggagcagcaccttgattaggggagaatgaagaagctttggagggctgggcgtggtggctcacgcctgtaattccagcactctgggaggcctaggtgggcggatcacctgaggtcaggggtttgagatcagcttgggaaacatggtgaaaccccatctctactaaaaatacaaaaattagccgggcgtggtggcgcatgcctgtaattccagctactagagaggctgaggcaggaggatcgtttgaacccaggaggcagaggttgcagtgagccaagatcatgccattgcacttcagcctgggtgacagagtaagaccctgtcttaaaaaaattaataaaaataaaaaacacagtccaatttttttgagctaattatggaagtattaatggataaaatctacattttgtactggtgctgagagtgagctgtcccctaagtagattatgtttcatgattctgtgtcaactttctctgggctgatgggccctctttggacactgacgtctcctcacgtccatgatccctcctgggtccgtgccagctgcgcgtgtcatcagagcggagcgtgcgcttgtccttcatcacaggcctgggtgatgtgtggctgacatgcgtcacatgggataggctctccgatctcagggctcgggctgccacccctgccacgtagtacatggcatgtggctgattctccacttgcttgcaatggaccctctgtggaaggcaccggagaggcggtttccctgtctcttctcctcctgtgttgccctcctccccctcgatagatgtgacctcccttccagctttgtgccagtgtctggcagcacttgattttttttctccttgtccttcatctgttttcattgcgtcgccaccttccccacccccaagcagcatccttctgccccttggtgctctccgcgcggccgtctgcctacctgtgagtacgctgaccagggctggttgactgcctacacattagcggagtctttctcattttttagggcacagtagatactcagcgagtgttgttttttttttaataattatgcaataaatgaatggatgtccgcacaccaccctgaacaccagcacccactggtcatccctggacacgcatgggtggaaggaccacactggttgtccctggaagagtagctcactctcgagcctgcaccgatgtcatctgagtcaaaacacagacgtctgggccccaccctagagagtctggctcagcgggtccagggtggggcaagaatgtgcattcctgcaagttcccaggtgatactgaggcggctgctggggggataccatttcaagaagcactgcttggaggcaacgcagacctctccctcttcgacgaggtcctgttcacttccatgtaaccagtcagggttggaatcccacatggagttcccctcctttggtgaccctctgctgcagctcttgggagcctcccctttagatgagttcctccctgctctgaccaggagttgctttttctataccacctcagctgatggtgttcacacacacattcatttaacacacatttacggagggctcctgggggctgggtgcacacacttggtgcggctctcttttggaacctggtgccttctctctctccttcatttttgaggcagagtcttgctctgtcgcccaggctggagtgcagtggtgcgatctcggctcatggcaatctctgcgtcccaggcttaagtgattcttccacctcagcttcccaagtagctgggattataggtatgcgccaccatgccccgctaatttttgtatttttagtagagacagggtttggccatgttggccaggctggtctcgaactcctgacctcaagcgatctgcccaccttgacctcccaaagtgctgggattacaggcgtgagccactgcgtccagcttccagtgtcctccctttcagcctctgggtgttgccagccagtgccaccactcagcactgtttatacctaaggcaccaatgggtaaatggagagacaggcgtctgaagacttttaaaaatgtgtactttatttggctgtagctaaaccagttagaaggccgggagttgaagttgatatgagtatcataaatgcgcaagttaagtagttacttaagaagtcacaggaatatgggtcgttccttgttgggtttctgataactagcaggcggctcagtttggctatgttaataacagaaacacagagattgccactgattctatcacatttcctgtttgtttgtttttgtttttgtttttgagacagtctcactctgtcatccaggctggagtgcagtggtgcaatcatggctcactgaagcctcgaccacccaggctcaagtgatccttccacctcagcctcctgagtagctggagctagaggtgtgcaccacctaatttttaaactttctgaattttttgtagagatggggtctcactgtgttgtccagtctggtttcaatctcctggcctcaagcaatacccccaccttggcctcccagagtgttgagattacaggtgtgagccaccgtgcccagccaacatttcattttttaaaaaatgctttattgaggctgggcccggtggctcaggcctgtaaacccagcactttgggaggctgaggcaggcagatcacttgaggtcaggagttcgagaccagcctggccaacatggtaaaaccctgtctctactaaaaatataaaaattagctgggcgtggtggtgggtgcctgtaatcccagctacttgggaggctgaggcaggagaatcacttgaacccaggaggcggaggttgctgtgagccgagattgtgccactgcattccagcctgggtgacagggtgagaccctgtgtcaaaaacaaaaacaaaacaaaacaaacaaaagaaagctttattgagatgtaattcacctgtcacccagcctgggtgacagggtgagaccctgtgtcaaaaagaaaaacacaaaacaaacaaaagaaagctttattgagatgtaattcacatgtcacacaattcagcagtttaagtgtacagttcctatactttgacatccatcactacagacaatttggggacgttttcttcactcgacagagaagcccggcacacccgagctgccacccccagtgctcccagcccctggcagcccctaagctgctttctgtctctttgcatttgcctgttctggacatttcataaaaatggaatcacatcatatgtggcccttcatgactggcttctctcactgagcctaatgttttctgggttcacccatggtgtagcatgtattagtgctttcttccttttcatggctgaataatattccattgcgttttgtttatctttgttgattatccattcctcagttgatggatatttgggttgtttcactttttgactatgatgaatagtgtttctatgaatgttggcagacacgttttcctgtggacatatgttttcatttctcttgggtatgtacctaggagtggaattgctgggtcatatggtaactctgtttaactttttgaggaatgtctggagtttgttttaaagtggctatgccattttctcttcccaccagagtgtgtgcgggccctgatttccccacgtctccataaacacttgctgctgttcgtcttttttattatagccacactagtggaaagacacttttgtatcccacacaaacagaaaacttatgtataggtgatttttctaaaaaaaagactttatgttttgataaaataagcatgttatattggttaagatggtttttgttgtgagttaacgaaaacctaactaaaattacctaaaacaaacaaacaaaaaaacgcatttactatctcatgtaacaagaagtatggcagttccagggttgattaattcagaggtgtgatgacatttccaggaccccaggtgcttttcatctttgctctctgctgtctttgccacgtgggagatgtcttcccttgtggcacaaagtggctgcagccattccgaatgacacagtgatatctagtaaagaagaggggcttttccaatcctgcatgtcttattttactggcatggaaactaagcagacatctctcagctccctttggccaaggcggggccatgtgccacatcctccttagttactggaaaggggagggaagccccattggggtgaacttaccctgctccagctacttactgcgggtgggctgtgtgtgcgcatgcatggtgtgtgtgcgtgtgcgtccatgcgtgggtgtgcatgtgtgtgcgtgcatgcgtgggtgtgcatatatgtgtgcatgcatgcatgggtgtgcatgggtgtgcatatatgtgtgcgtgcatgcgtgggtgtgcctgcatgtgtgtgtgcgtgcttgcatgggtgtgcctgtgtgcatgcatgcatgtgtgtgtgtgcgtgtgtgcatctccttcctaagcaggtagaagggagataccccaagcagaatcaggcttctgctggtaaggaaggtaggtgtgtgggaacggggaggacatgaagaaagaaaatgattcttagggatgcaatgcattagtggctgtgactttagttaaaacatagaattttgtttgttttttttcttttgagacagggtcctgttctgttgccctggctggtgtgcagtggcaatagtggctcactgtagccttgatctcctgggctctagccatcctcctgcctcagcctcttgagtatctgggaatacagtcgtgtaccaccatgcctggctaattttcaattttttttttgtagagacagggtctcgctatgttgccgaggctggtctttaactcctggtgtcaagtgacactcttgcctcagtctcccaaagtgctgggattacaggtgtgagccactgcccaaccttcatgcagcattttaaaaaatgaaaatgtagctgcttgttctaggagaaacttgtgaaattggatcatttaaccaactctgcctgtgcgtgacttgccttcagttctccagcttggcctcaatccctttttcttgctgcttggaacccacatcaccaccagtgacctcacaaggcagtgcccctccgcacccctcccttctccaagactcccccgccgccccctttcttgctcttacccacacgccactgcagacacagcgccctcctcccctgctgcccccctcttgctcttacccacacgcccctgcagacacagcaccctccccccacccaccgttacaccctctcttgcttttacccacacgcccctgcagacacagcgccctcctcccctcctgcaccctgggggctccccgcatgtgctgtgatgttgaacatgtgggtgtcaggatgaaaggaagaaatctagatttgatgtggtgggaggtaaaagcactctcgaaggctttcgagctgggctatgactgtcaggatgaatgtggttttaatatgtggaagagatttatttctttaatagtcacctgttaagagtcttagatatcactgatgtgtcttgttaagaaaccttataacaaacgtatttcttaaacttacatctggagctctgcaaagcattagctgttctgcaggaatgacagagggtctcctgtgcggccagctcctctggagtcagggagccatggagccactgctggttctgaggatggtgacagcaggaggtggagatggcttcatgatctgctgtgagcaacgtgcaaccttctccctgctgttaagtgactagaattcccaggtgccgcctgctgattagttccagtttgtgttccacgagagcagatgtgtgtgaggtgcagggaatgccccgctgcgggagatggttttctcctgccaccgtccctccccaggccacaccatccacacacatgagcacgctcgtcttcctttctcataaagcacagacctagaaatatttctcggtttaaaaatagtgttttccctacctcgagtcaaggttcagttctcatctctctaattttagttccttgtttttatgaactttgaaatgttttccttaaccagaaaacagaaaaaagcaatcccagagacaagggaaatttcttgctccatttccctgtagtaaaggcatttctatgtgagattttctttttatcctgagcaggttatcagaaaccaaaattttgaattaggagtttaaagaagaggcaagggggaaaaagtgctctctacgggaccttggttgccatgtggaatgtttttggagcataaaattgatatttttacaaaaaaaaaaaaacgaaaaaaatgtttctggtagaggcctggagaacgccgtcatgattctgaaggtgtatatattttttattgtttctgtcaaactaattttatataagacattaatggaaaggtcaaaacacataattctctgaagcctattagaaaaatttcttccgttgggctgggaacggtgggtcatgcctgaaatcccagcactttgggaggttgaggcgggaggatcactcttgaggccaagagtttgagactagcctggccaacgtggcaaaaccccatttctatcaaaaaatgtatatatatatacaaaaattaatcgggtgtggtggcgcacgcctgtagtctcagctactcgggaggctaaggcaggagaatcacttgagcctgggagatggaggttgcagtgaaccaagagcatgccactgcactagagcctgggcaacagagcaagactgtctcaaaaaaaaagtaaagaaaagaaaaattacctctgttaacttctttaaattcttaggtacaggtggtaatttttttctttgttaaaattgatgttggtcattttgtgtttgagttttctgttgctatttcatggggattttcctgtgcatctacataatatagtatttctttgaattaatatgccatagtttaatcatttcctgtttgagctttttagattgcttgaaggtttttctttcctttgtaaatactgcagctttaaggaatgtgtgacttttgaagctctctgttttggcagatggcaaagggggtgaccatcttatttttattaattttttattataaaagtaaaacatgtttttggtgttttagaaaagacagataagcaaaaagaagattaaaaaaacatttaccaactagagatagccattttgaatgtttcaacatgaggtttttagactttttcagtgcatatacgatatatatcaaatatttattcaaaatcaaatatatatcaatgcatataaatatatatagatataatggtgtcatatgaaacaccattaacaccattaaacaccattaacaccattaaacaccattaacaccattaaacaccattcatggatcatgaatacctttccacttaaatctgtatgtacatctttgtttattttattttattttatttttttgagacagagtcttgctctgtcatccaggctgaagtgcaggggcatgatctcggctcactgcaacctctgcctcccgggttcaagagattctcctgcctcagactccccagtagctgggactacaggcgtccgccaccacacccagctaatttttgtatttttagtagagacggggtttcaacatgttggccaggatggtctccaactcctgacctcaggtgatccacccaccttggcctcccaaagtgctgggattacatgcgtgagccaccatgcctggccaagtctgtacatacatctgtatcatcattttaaatgacttagattttattctggggatgtactataatttattcaggaaatatctcttgttggaaatgtagattgtttccagctttgaatcattgtatatcacaatatgaaactgttaataatccagccatccctcacatcaggatgcattgtataatttaatggtatgtcatagtttaattggcagcactttgcattatattttaatagaacaaaaagtaatgaaacatcatcattggcatcttagactcgatgaaatataatattgtcaattataacagtgtgatgaatatccttatttgccgttgtctttgcccacgataattagtagtggggccaaatctctttttcatatgtgtgttgcccttttgtatttcttcatgagttgcttgtgaattggttgtcttttccttactgatttgtgaaagttctttatttatgtaagtatcttaaatctttgtcttccatatatgttgtaaaatgcctcccattttctaatttgtctttcaatcgtgatatttcttgatatgtggaaatttaaaatctttatgttggtcttatctatcaatcattgtttatggtttctacctttagtatcatggttagaaaagccttccccacctgaggactatgtaaaatattaacctatattttcttctaatacttttatgtttttgttttcttttttttttttctttttttgagacagggtctcactctaggcaggctggagtgcagtggcgtgatctcactgcagctttgacctcctaggcttaggtgatcttcccacctcagcctcccaagtagctgggactacaggtgtacaccaccacacctggctaatttttaagtattttgtagagatggaggtctcattatattgcccagtctggtctcaaacttctgagttcaagcaatcctcccaccttggcctcccaaagtgttgggataacaagcatgaaccattgtgcctggactggatataccaccattttaaaaaatcagtttatcagttgatgaatatttgagttgcttgcagttcttggctattatgaatagagttgctgtgaacattcacaagtcttccgtggatgtatatttttatttgtttcggttaaatgcataggagtggagtgactgggttgtatgatgagtgtgtttaactttataagaaactatgaagctgaacatgttatttttctttgtaactggacacttaattgaatgcttattgtgtctgaattttttttttttttctgaagcagagtctcactttattgcccaggctggagtgcagtggcaccatcttggctcactaccacctctgcctcctgggttcaagcaattctgccgaagactcccaagtactaggattacaggtgtgcaccaccacgcctggctaatttcttttgtatttttagtagagatggcgttttgccatgctggccaggctggtctcaaactcctgacctcaagtaatccacccacctcagccttccaaagtgttgggattacaggtgtgagtcaccgcgcctggcctgtgtctgatttttaaaaatcagatagccttagatttttcttggcagaaaatcatataaatttaaaatcccctccttttcagtttttatatctcattttaaaaaattggactgaaaggtaaaggccaaaaatatgcctattctctgcttaggagttacagtaacttttgatgtgtgtgtgtgcatatacctgtgtgcgtgtgtgtgggtgttttcccgctgtaagaaaagaaggcatgatgtaatgtgcaggaaataatcataataaagagaatgctggcgtacttcttgagtgctcattgttgctaaattggtcatttactcctaaaggacgttggggaagggtgtgtttgatctctctacagccagaaagaccacctgaaaaccctcctgggcctcgtgaatctgctcatctctccagatgtcacaggaagtgtcctcggggggggacaaggctgtgctgttccatgcaggcatggtctcaggctgttcccaattgtgagtgagttttgaacaaaactgtaacttccctgtatagggcttacagttggcctcatcttacaccctgtagtccagtgagtccgcatgctagctgtggaaagcgtgtacagaaaggaggctgattctttttttttttttttgagacgaagtctcaaccttgtcccccaggctggaatgcaatggcgtgatctcggctcactgcaacgtccacctctgaggttcaagcgattctccttcttcagccccctgagtagctgggattacaggtgcctgccaccatgcccggctaatttttgtatttttagtagagacggggtttcaccatgttggccaagctggtctcggactcctcacctcaggtgatcctcctcccttggcctcccaaagtgctgggattacaggcgtgagccaccgcccccagccaggaggctgattcttaattattgatgcactgcagcctgggcaacagagcaagaccttgtctaaaaaaaaaattattgatgccatttggttctctttgaaactaattaatggctccttaatttgtcagtgcgtctatcttctagcgatcacagatgctgtttgggtgctcttgtcagtttttggtaaccatttctggtattttcttttcaaatccccagcctcactttgtgctggttatcacaagatccacttagaccttagaggtgagagcttgggaatatttcatctgcaagaaaaatcattcgtctgtctttgtgtgggacgagttaggttatgtaagctgatggaacacgaaacagaaaactggagcctttttctttgggcacacaaaaatgcaaaaatctaaatctcttattttgttgaatttttaagtggaaggagttgtagatttgccaccatcagtcctggagctgacttgaatttttcttttaggctcttgttagcttttctaacagagatgtcacagattagcaactaggcataaacctgagaaattgggcactaattttgttttgcatttttgttttgtaagacgggggtcttgctgtgttgcacaggctgcagtacagtggctgttcacaggtgtgatggtagcgcactgcagcctcgaactcgtgggctcaagtgatcctcccacctcagcctcccaagtagctgggaccacaggcatgtgctacgccacccagctgttattttgcatttgctctgtcatcacgttgtgcttttgtgcctgccttttctcctcattaactagatatctgtcacttaaagaaataacagcgatgcatttcaggataatagaacccctatgaactcttccagacttaaaatttatctgtttctccaaaaaacactgcctgcatttttcccaaataagccagatactctcagccaggtatctgtgcaggttggacccctgcccaccttacaagatccagtagcatctccgttggaaagcttttcctgagccctcccgcctggcccccccgctgccccagccgccattccttgccaggtctctttttacctccttttgcgttaatgggtctttggagttgtgtctccccttcactgagctctccaggacacattttgcaacatttttgtgtccctggtgtatggtgtttagcagacgctcagtatttacatgttgacagattgcacacatgggaccgggtacatttcttgccagtacatccagttttcccttacctcttctgctgtaaattaatgttcctctggggtttaaaaaattaatttagtggttaatttagtaagagattaaaattaggcactggccaggcacggtggctcatgcctgtaatcccagcactttgggaggctgatgtggacagatcaccagaggtcaggagttcgagactagcctggccaacatggcaaaaccccatctctactaaaaatacaaaaattatctgggcgtggtggcacatgcctgtaatcccagctacttgggaggctgggacaggagaattgcttgaacccgggaggcggaggttgcagtgagccaagatggtgccactgcactccatatatatatagtaacaggtctcaccttgtcacccaggctggagtggagtggcatgatcacagctcactgtagcctcagcttcctgggctgaagtgatcctcctacctcagcttcctgagtagctgggactacaggcatgcaccaccatagctggctaatttttctatttttttgtggagacggggtctcaccatgttgcccaggctggccttgaactcctgggctcaagcgatcctcctgcctcagcctctcaaaagtattgggattacaggtgtgagccactatacccggccataaagtagtacttaaaagtgtaacaactttcaataaatctttgtgagattcagaacaaccttttgaattgtctatgtaaagaaataccgaactgcttttttttcccctcgatcactttttaaccttccactttgtagacaatttgctagtgtgttttctatttttttttttttttgccactgggtattgccctgtcatccagactggggtacaatggcatgatcgtagctcactgaagcctcgacctcctgggctcaagcgacccacccgcctctgtcgcccaagtagctgggaatataggcgtacaccaccatgcccggctaattgtttttttaatttaaattttgtttttttttttttgcggaggcagatcctcactatgttgcccagcgtggtcttgaactcctggcctcaagtgctcctcccacctctacctcccaaagtgctgggattacaggcatgagccactgtgcccagccagatttttgtcatgattctatttttatctcttctatcgatttatttcttatatattttttctcacttattttaagtcattgcccgaaatttacaaagtacattttttatcagtctgcctccaaatattataccatttattatataagaacctcgtaagaattcttcataactgtaagttactacaaggttctatgagaaccttgtaaatgtttatgatgctaatagtgtcataataatgtattttatatatattataaacctcataacatgttatttttacagaaaattaccttttagagcaatgctgtttgatgaaacttcctgcaatgatggaaatgttttatatctagactatacaatatggtagctactatccatgtgtgaccattgagtacctgaaaacaactgaattttaaataaactagtttaatttaagtaatttaaatttaagcggctgccatatagacagtgtagttttagaacaatggaagattttcaaaatacttttgaaaattattttgaaaatctttcttctttttaggccacttcaggaactcttcgtttctttgtgtagatctataggtttctgtctcatctcccgactgaaaaacttcctttaacattttttatgctacaggtcttctgggaataaatgatctcagcctttgtctgtctgaaaaagtttttatttccctcccattagaaaatgtttttaggccgggcacaatggctcatgcctgttattcccagcactttgggaagccgaggtaggtggatcacctgcagtcaggagttcaagaccagcctggccaacatggcaaaaccctgtctctactaaaaatacaaaaattagctggatatggtggtgagagcctgtcatcccagctacttgggaggctgaggcaggagagtcatttgaacccaggaggtggaggttgcagtgagctgagatcgcgccattgcattccagtctgggcaactgagtgagacttttgtctcaaaaaaaaaaaaaagtttttaaagagggctgggtgcggtgactcatgcttgtaattccagcactttgggaggctgaggagagttgatcacttgaggccaggagttggagacctgcctggctgacaaggcgaaaccccgtctctaccaaaaattagctgggcatggtggcgcatgcctgtagttccagctacttgggaggccgaggcaggagaattacttgaacccaggaggcggaggttgcagagagctgagatcacgtcactgcattccagcctgggcaatagagtgagactctttctgaaaaaaaagaaaatgtttaaagaaaaatttcataccaaggagatccaagagacactcatttttaagagtcggttttttcttttttttggttttgtttgtttcttttttttttttttttcttttaggatatgaaggtttgtgttgaaaaattttttttgcaacttattcttttagtactttaaagatatcacaccactgccttctggcttttgttgttttggtgagaagtctgctataattcttttctttgttcctctgaatgtaatatgtttcccaattcccactgtcaccccggcagcttttaagattttctctttatttttagttttcgacaatttggacatgatgttgttttggtatttctcttttttggagtcctctaaacttcttggatctgtgctttgatgtcttttattatgtttaaaaaattattggccattatctcttcaaatatttccttctatcctttctttcttcttcaagcattttcttttttcttagaaacatttaataggggcttatgcacagaagctatgtctgttctcaagcttctgttcattagtctgtgaactggggctgcagcgagaagagacagtggatccctgcaccattatcccctggtcccagggcttgtataccgtagggaaggggtgattcagagggatgtgtaggtcagtgtgagtacaataacatcaaagttgtttgacctaaggtcaggctttatggtaagttcttggtcttacacgaggaacagcgcataagctggaaatctcagagggtttcctggaactggggttaatcagaagccacatggcggagtagcatccacgatggagctacttcagcctccacagtccactcttgtaatccagctcttgtaatctcacatgccctcttcttccttcatggtccctgagcctttaaggagggtgcttgatactgtatagctttagcagcagtgccttggtcatggaaaacagatcgggcccagtgggattccaaacaagggagattcacaggcttttaaatcgtcttcagtcttcagaatgcagtggctttggttctgtcagaataggcaaaacaatgtgagatatataacatcgatcactcggatagtagaattctgtgcacacagagattgcaatagaaagagaatcgcctgtaatcccagctactcaggaggctgaggcgcgagaatcgcttgaacccgggaggtggaggttgcagggagccgagaccgcaccaccgcactcccgcctggatgacagtgagactctgtctcaaaaaccaaacaaaaaaacccagaattcgtgggccagaacaacaatgaaaaaagaacgtattctgttaagaagccaactaaaatgcatcatgatgaaaattaaaactcggttcttctttagagacttgttgcagccaggaaatggttcaggattagcccaaattgtaggcagataataaaaactcacaaacaatggttaaggctagaatctaaatttttctttctccagtttccccatttctaccagggataaattatatatataatagtaagaccaatttatttgcaaaacaaattttagttgctttatacttggcctgaagatttgcatcaaatgtagcaagaattgtgatccaccatacggaccctttttaagttggctttgcaggaacctttataaggaattttggatttgactttttaaaagcctcaatgccagatattgatctgttttcaacttttttgattttttttttttttttttttttttttttttttggagactgagtttcgcttttgttgcccaggctggagtgcaagtagcaccatctctgctcactgcaacctccgcttcccgggttcaattgattctcccgcctcagcctcccgagtagctaggattacagacatggatcaccatggctggctgatttttgtatttttaggagagatgggatattaccatattggccaggctggcctcgaactcctggcctcaagtgatctgcccacctgggcctcccaaagtgccgggattacaggtgtgagccaccacgcctggctactacttggttactttgtaaccccgcctctttgatgggtcaagaaaagttgtggttatattatttatcttggtttttattattattattattttattttttgagacggagactctctctgttgccaagactggagtgcagtggtctgatcatggctcactgaagccttgaccttctgggctcaaagtaatcctcccatctcagactcctgagtagctaggactacatgcatgcatcatcacacccagctcatttttatgtatttttgtgtgtagatggggtcttatgttactcaggctggtctggaactcctggggtcaagtagtcctcctgcctcggcctcccaaagtgataggattacaggtgtgagccactgcacttcgcttttttctttttaaagagaaaggatctctctatgttgcccaggctggacttgaactcctggactcaagcgatcctcctgccttggtcttcgaaagcactgggattacaggtgtgagccaccaggcccagccagttttaatttctgttaggtggaatgacattccaggtttctaaaaataacttctacttggttatttttcaaaagttttgttgagttcagtaattatataaggtttataacataatattatttgaaactttcatccacatcctattctttactggtagagaaaagccacatataagaaatacatgtgtgtttgtcttttataaatatatgttacccagttttccagttactagctgcaagttttttttccaggtcataatttggagaaaaatatatgcgtgaaaattataacgataaagcttattttctatacaacaaacagtgagtgatatggaaatgtatgtccttactagtaattttaaaagtacaaaagagaatgccttaaaagtacacacacacacacacacacacacatacacacacatacatatttttttgagacagagtctcactctgttgccgaggctggagtgcagtagcgcaatcttaactcactgcaacctttgcctcccgggttcaagcaattcttgtgcctcaccctcctgagtggctgggattacaggcatgtgccaccacgcctggctaatttttttgtacttttagtagagacagggtttcaccatcttgggcagactggtctcaaactcctgccctcaagtgatccacctgcctcagcctcccaaagtgctgggattacaagtgtgagccaccatgcctggccgcattatatactttttaaggcagagaaaattttctaaaacttgatgggtggcctgttgttgctggttcacttcttctaaagaacagaagtaagaactgtaacactgtccgaatcctgggagagtcgccttagaagatggtcctgtagatacaagagaataatttactcaatgatacgaatataattgagaatagcaaaaattgaacagcagccaaattggtgatgagtgaggtaactctggtaagtcaccctgatagaatatattccatttattcattgttcatagaatatattctatttattcgttgttcttccaacctttgttgaagccccactctgtcagactcggcaccaagtgtctgagatgccttcgctcattacatcttcacggctcccccgagaagtagatgttactttcattatctgcattttacaaccaaggaaccgggatattaaattacttctctaggtcatgcagctagtgtgcggtgggctaaatgtacaatccccctaataataataataataataataataataacttacaacaacagcatattgaaataagaaaaaaaatttgaaaaatctctttgattcgtaaagatgaaaaaattgattctagttgttggtggtgagaggaaagggaacgcaggccctctgaaacactgttggtgggactacgaattgcagaaacctttttgaggacattttgcatatcttcagaatttcacatgtcatgccatttgaccaagtcctttcacttttagggatttaccctatggcaatatttgcacaagtacaaaaatgtatgtatgagaatcttggttactgtctttcttgtaatagcagaaagtgggaaatcacttgaacatctattaggtggaaattatggtctgtccttatggtggaatagttgtaaccatttgtaagaatgagatagatctgcgtgtacccatatgtgcaaaagagccaccgtgaattgtttttttttttttttgagatggagtctcgctttgtcactcatgctggagtgcagtggctcgatcttggctcactgcaagctccgcctcctgggttcacaccattctcctgcctcagcctcctgagtagctgggactacaggcgcccgccaccatgcccagctaatttttttttgtatttttagtagagacggggtttcaccgtgttagccaggatggtctcgatctcctgacctcatgatccgctcatctaggcctcccaaagtgccgggattacaggtgtgagccaccgtgcccggccatgaactgtgaattgaaaaaagcaagcaactgtaccatatgtaaaacatgatctcattttccataaaatagcgtgtttaataatgtgggtctagagagataataatacatgcattgaaggatatatacaaatttatatatagcgcgtgttctttacagtgggattagaggaacttgtactaatattttttttgctttgttttttttttgcaacagatatgattttattattagaaaaaccagatttaaaaaaagccattatatgagttttcctagttggcaaaaattcattatatgagttatcctagttggcaaaaaaggcacttaagtgaggaaaggagatgcaaaatcatccttgactgtaaaggggtgcaggtgggatatgagcttgtctgggtatgagaatatcatgttctatgcattttttatttcctaaactgcttaaattataaatcattaatggtaattattaaaagactttgttttccctacaattagaaaaacttatttgaagacctcaaatcccaaaagtgaaagaggaaaaaaaaaattattgccacggtttttcccttaacccatttaattaaagaattaattaaattctatgttgcagtttttcaccaaaagtgcaacatagagttagttcagtcaccacaaaaagattcagagattggattttgctgacttagtgaagctactaagatacaaattcacaaagtaaatgtttgcacacattagctacagtggcaaagtgtttgggaggttgcagtccacctcccggtgagggagatccatccttttggtcagcaaatgccctgaattgaccctctcccgagggtcagctgcaggctgtgctgatctcggaacttctctgggggtccagttctgtttaggacagaccataaaatacatctctctggggtgggtagagctaccccagtacttaccctggaaatggactcagctgtccctggagggtgactcagttgaggcagaattgtcttaatttggtaactctcctaatttgaagcagaagtcctgggtttgacccagacccatcttggtctggagtggagttgtggtgtgtctaatgctgccagatcatgttcactgttagaagcctggggaagggaaggaacttgctcagccaactcagaagcaggcatagcgcaagagggaggattttaagaattagtattttactatccttgtgagctggtgttattgacaaacattatttcaatctgtttaacgattttaagaattagtattttactacccttgtgagctggtgttgtttctaaatattatttcaatctgtttaacaattccattttttaaaaaccctgcactttgggcaggagttcgtatttctaatttaggatgaattttttctcatctccccccattctgtgattctaattttttttaagttatttcagttcttaaaactctttcatagagctgggcatcagccgcaattttctctaaatctgtctcagatgagcacttgcagtctaattgtataaaagatcaggaaatttagtattgaagttgcacttgctttgatgtaatgatgaatgtttccttcatctgaagagcatttgaaatttatggaaaagtaaatctttttgaattatatgtaaatgaaaacgttgggatgaaccaggttatgtttaactgggcagttttgaaattctaatagctcctacaagcgggaatcttttaaagctaattttgtgatatgaattgtttattattctaaagaataatattcacttttttttcatggatctcatgtaaatgttactggacaatatgacccatctctttaaaaagtgaaattgttagtgggaagctgtggctcacacttataattccagcactttgggaggctgaggcgggaggatcacctgagcccaggcatttgagaccagcctgggcaacagcgagacctcatttctacaaataataaaaacattagctgggtgtggtgacatgcatctttggtccaagctactctggaggctgaggtaggaggattgtttgaacctgagaggtggagcctgcagtgagccctgatcgtgcccctgcactccagcctgggcaacagagtgagacctccatctctaaataaataggtaaaggtaaaatcactgctcagtcactagagagaggagagagaaaagtaaatatactcaaggagtgggaaaagctttgaagtggcatatcaaaatgagaaaaataagtgttttttagagagaaaagatttgtggagaattatatattagaactatttaagacttcttaaaacttcacgattatatggttttgtaaggtttttggggattttcataatgagatgtagatggaacgtccccattgcccatcatagactattcaggcaagttcatacccattcctagaatggagaaccgtctcctctgcggtgaagaagcgcccctgttccttaagaggcagcagcaggaggtggaaaacaacatcccgcttgctaaagtcatgggccttagtccaggcgcggaggctcacgcctgtaatcccagcactttgggaggccaaggcgggcagatcacctgaggtcaggagttcgagaccagcctggccaacatggtgagacccagtctctactaaaaatacaaaactgagccgggtgtggcagtgggcgcctgtaatcccaggactttgggaggccgaggcgggcagatcacctgaggtcaggagttcgagatcagcctggccaacatggcgaaaccccgcctctactaaaaatacaaaaattagccaggtgtggtggctcatgcctgtaatcccagctgttcgggaggctgaggcagaattgcttaaatccgggaggtggaggttgcagtgagccaaaatagcgccattgccctgcagcctgggtgacagagtgagactccgtctcaataaataaataaatacataaaaataaagccatgggcctcgatgggaggctgtacattgacgtgcgacattcgacttctgccattatttcagatttcgcacctgcccttctggcaacatggtgttgctgtgaggatcttgagaggagatgaatgatgctttccaagtagtaagtattattccattagggaaaataggaataaaattggaaagcatcaagtatttgaaaggaaacgaaaacagggcttactttccctttcggccagcgttagaagggtgcagtttggaattgaaagtgaaaggagcatgcacgtgttcggggcaggttgcggggagagtgaagatcattttaaagaccctggtgctttgatcttagagcaccactcatttgtactcagttcagatctaagtgaattactgtgcaaacgacatgacgagagaggggcattttccaatagtagcttctggtctggcacatgagccagttagagattgacacacgcagtcatgtagctgctataaattgaagcctggtgatggacgtactacaggcatggctgcagcgaatgcctatgacctttcacttctcctccctctgtcactctgtgtattcgctctctccattttcctccctcacctattcaccagccatgaatcaggagtggactgggcaaggatcagcctgtagggaaatgatgtgggccgagggtaaagagtgaggaataattaaggcagcccttgaattagttgtacatttttttcttttgtgtagtcttcttttttttttgtaagcaaacaaaaaccacgttgctggccaaatgtagtggctcatgcctgtgatcccagcactttgggaggtccaggtgggaggattgcttgagtccaggagtttgagaccagcctgggcaacatggtgagaccctgtctctataaacaaataaattaaaaaaattagctgggcatagtggtacccacctggagtcccagctaatggggagactgaggtgggaggattgcttgagcccaggaaactgaggctgcagtgagctctgattgtgccattgtactccagcccgagtgacagagtgagaccctgtctctcaaaaacaaaaaacaacactttattatggatgatttcaaacataaacaaaagtgaagagagtagtataatcaactctcaggtacacgttacccagcttcagttacccactcataacctttcttgttaatttctacaaaaagcttgctgggtcttgttgaatctgttgatcaatttgggaagaaatgccatcttaacaatactgagtccttcaatccaagaacctggtatctccttacatttatttagatattatttaatgtatcaacaaagttttgtaattttaacttactaattttgatgctattacaaatggaattatttcttaattttgtttttggattgttcattgctggtatacacaaaacagttgatttcctgatattgattttgtatcttatgaacatgttaaacttgcttattagttctagtagttttttgtagactcctgaagattttctatatatagagctagtgaatatgaagagttttacttgttttccaatctgtgtcttttaaatttctttttcctgccttattgttctggatagcacctccagtacaatgttgagtagaaatggtgagagtagacatccttgttttgtttctgaacaaagaaccaacttttggtttcatcagttttctctattactttccctaattcattgatttctggtctagtatttattattgccttccttctgctttttttgggatttagtttactctcctttttatagtttcttaaggtggaaactcaggtttgtgttttttttttttgagacatgatctcgccccgtggcccaggctggagtgcagtggtgcgatactggctcactgcagcttccaccttccaggctcaagagattctctcacctcagccccccaaggagctgaggctacaggtgtgtaccattgggccagctaatttttatttttattttttgtagacacagggtctcactatattaccaaggctcttcttcaactcctgggcttgagcgatcgtcccagcttggccttccaaagtgttgagattacaggtgtgagccactgttccctgctgatgctcagtttattaacttgagacttttcttttttttttcctgatacaggcttttaacattataaatttctccctaagtacttctcatagctgcatcctaaattttgatctgctgtgtttttcttttcatccagtttgaagtatttttaaacttcccttgtgatttcttctttgacctttgaatcctttagatatgttttctaatttctaagtagttggggagtccacaaatttatttctgttcttgatttttaaaaatttcattttggtagagaacatgctttatatgattttaattcttttaaatttattgatacttgttttatgacctagcccatgattcattctagacaatgcgatatgtacacttgaaaagaatatatattctatttgttgttgcttgacatggtctacagatgttagttacgtcaggttggttgacaatgctgttcaaagtctgtatatccttgctgattttctgtttaactattatgtcaattattgagagtgggatattgaagtctccaaacattattgtgaattgcctatttctccctttggttcagtcagtgtttgctttattgtattttgtgctctgctattaagtgcttatgtatttatgtttttatatattcctcatgagttgacccttttattgttacaaaatttctttttctcttataacttttttgtcttaaagtttattcagtctgtgggatttttttgtgtttttgtttgtttgttttgagacagggtatcactctgtcacccaggctggagtgcagtggcacaatcatagctcactataaccttgaattcctgtactcaagcaatccacctgccacagcctcccatacttactttgatattattatagccactgcaactttcttatggttttgtttgcatagtacatttttctccatctgcatctcttgcagacagcacatggttagaacttctaaaaaatttaatctgacagtcttcaccttttattggagtgtttaatccatttacatttaatgcaattattgatatgcttggattacatctaacattttgctatgttttctctgtctcacatctttttgttctgtttctccttactgttttcttttgtgttaaatagatattttctagtgttctgttttcatctgtttggtgaggtttttaatattttttggttatatttttagtggttactctaaggattgcaatatgcatctcatcacagtctactttttaaagatctatatatagcttttaaaaagtagagatggggttttgccatgttgcccaggctggtttcaaactcctggattcaagtgatccttccatctcagcctcccaaagtgctgggattacaggcatgagccactgtgcctagagctcacagtctactgtagattaatgctaattcattttcaataaaatatagaaactttgttccattaaatgtctatgtctatctacctcctctgtggtattatgtcatgtatatgatatctttgtatgtcataagcccagtagtaaaagtctgtagttattgttatatgtacttgtcttttaaatcagttaagtgtaaaaaagagactatttataaatctgctgtatatttgcctatgtaattagtattactagcattctttatttcttcatgtggattcaggatataatctggtgtttttttctttcatcttgaagggcttcctttagtatttcttgtaagtagggtctgccagtaacaaattttctgtctttgtttatctaggaatatctttatttctacttgttagttttggggtatggttttgatggatatggaattcttgattggaagtttttctttcagtgctttgaatatgtcattttactgttttctggtctctgttaatttctaacgtgaagtcagctgttaatcttatggtagtgctccttttcatgaagaaccattttgtcttcatgcagtcaagattttctctttgtttttggcttccagcagtttggctatgatgtgtcatggtggctcactttattgagttggagttttttgagcttactttgagtttgttggatgtgaacattaattttttaaaatcaaatgtgagaagtttatgccattagtttttcaaaaaattttttctgcttccttttgcttcgttttcttttgaaacttcctttatatatatgttggcatgcttgatggtatccctgtgtttctgaggttctttttatttttctttatgcttttttatttcttcttcagattggataattttaagttcactgattctttcttctcccatgtcaactctgttgttgagcccctctagtgaacttttcattacagttattatacttttgaactctagaatttctgtttggtttctttttataatttctgtctctttattagtattctctatttgatgagtcattgttacatactttcctttagttctttaaacatgaattccttcagttccattcttacagtagtttcttataactttgaaatctttgttaagtccaatatctgggcccccttagagtttccagttatgactcttgcctgagtataattcacaatactttatgtttctttgcatgtcttatattttatttttttaagctctgtattttagttaatacgttgtagcaactctggattatgatcacctttggcaaaacgcaggtttgttgtttatttctttttgtttgtgacttgcctggattaattctgtgaagtctgtctctgtagcagctgctgatgatcctgctcattttttttttcttatttttaaaatgtgtttaagcctggctttgcaggggttaacccaggtcagcatagcttagtggtcaggcaatgattattcagaggtgtgctgaaacaccttgagctactaatgcttttcacagtttgcggtggatatgtgtgtacgtttagggacatgttcagaattcaggcatatattatacgagcctgtcttggtttttcctttttgccaggccttttctggcctcctttgtgcgtggggtaggcctcactttagccaaggatgagtggataaccagggccctcttcagtctttcctgcctgtgtgcagccttccagagcacgaagaatgtgtgggacttcagggactttaccactgcccgtgatagctcccttattctctgtatcttccggctaggtttttggctggtctcctgatctgttggttgccacaaccggcattgcaggctcagggtggctgagatgttgaccttctgtacatttcctgttgtttacaggaaatcaccgtggtttatgtcagtgcctttgggcatgtgctctcctccaaatcaagtcaacccctccagcagtggagccaccaattttcacagctcgtcccaccctggtagatgtagcagcatgggtgagctgaggggaaggaggggagcccctcaagccaaagcatcacagaacaccaccgctctaactcaagatttggtcatttttcttcttcattttattttttaattcttgagatgaggccttcctctgtcactcaagctggcgtgcagtggcacaatcatagttcactgtaacctcaagctcccaggctcaagagattttcccacctcagcctcctgagtggctgagactacaggtgtgcatcaccacgccaggctgacttttttgtttttcgttgagacggggtcttgatatgttgcccaggctggtctctgactcccagcctcaagcaatcctcctgcctcggcctcccaaagtgctacaattgcaggtgggagccaccatgcccagctgcgtagtttttcttgaataaacatttttcaattttttgtatgtctttggttgatttccaaccctgtggtggttgtttttgaccgacttgtctagttttgttgttactttttgaggagaggttttgccaagcttctcacttcattattccagaagttcttcccctctccccaggtcatctttttggttttttcttctaactttctttctttctttttttttctttttttttttttttcgatggattctcgctgtgtcgcccaggctggagtgcagtggcatgatctcggctcactgcagcctctgccttccaggttctagcacttctcctgcctcagcctcccaggttgctgggattacaggcacccgccaccagctaatttttgtattttttagtagagatggagtttcatcatgttggccaggctggtctcgaactcctgacctcaggtgatctgcccacctcggcctcccagagtgctgggattaaaggcgtgagccatcgtgcacggccggtttttcttccaactttctaagtactataagcttgttgtaaaatttggcaatatagaaatgtataaaatggaaatgaaaatctttactaatcccatcccttaaagatagccactgttaataagttagtgacttgctttccaagctttaatcatctttctttaatcatcatatttttgattatatcctcttaccaaagttcctttacccctcaccacaaaggtttctaattcagagacttcctttagctcccttgattcaaggagataaagttaattagcaatcaggagatgaggagccctttcctggcaaggacagaattctaagacggagggatttttagctcctcggtggactcagttccgctgcaccttttgcagcatcttgcctgctgggtctcctctctgcagttttcttgttccctggccttttatcctcctgatcacacataccttcccaggttctccaggaaagtagtggatcagtcacttccccctgcaacgtcattgtaggcatgattacatcttggagtgttctctcaacaagagtcagtgtagcatggggttccgggcctgagctctggtgtcacattgcttggagttcaaatttcaattcttcttcttttttttttttttttcttggagacaagagtttctctgtttcccaggctggagtgcagtggggcgatcttggctcactgcaacctctgcctcccaggttcaagtgattctcctgcctcagcctcctgagtagctggtactacaggtgcacgccaccatgcctggctaatttttgtatttttagtagagacgggggttttaccgtgttggccagggtggttttgaacccctgacctcaagtgatcttgccaccttggcctcccaaagtgttgggattacaggcatgagccactgcgcccagcctcaactctctttttttttttttttagacagagtctcactctgtcactcaggctggagtgcagtggcatgatctcggctcactgcaacctccacctcctgggttcaagcgattcttctgcctcgacctcccaagtagctgggattacaggtgcccaccaccacgcctggctaatttttgtatttttagtagagatggggtttcactatgttggccaggctggtctcgaactcttgacctgaagcgatctgcccaccttggcctcccaaagtgctgggattactcaactctccttcttagagtcctttgtgaccttgggttccctgggccttggttttctcatctctgaagtggggctgggagcaactcttgcagcactgggttggaacgtgctggccacagtgctcacacatcgagaacacgccgtaaatgctccccgggcctccgcttcctggtgtcgtcatccttattcagaatgaacaagaaatcactccttcagagtaatgtttcagacagaggagagagctttgtgggggccctctggcgtgctcacagaagctttggtattcgtcaaccactgtaggagccaagcatttcctacagaatgcagggagcagggctggcggggagatagtgcgtgaaaagagaggctggtgttgggaaagaaacagagacagaacggtggccggcggacaaacgacaataagccaggatgatggtgtcactgcagccgggtgcggagtttctttctggggtgatgaaagtgttctaggttgatggtggtgatggttgcacagccctgtgtgaatatgctagacaccactgaattgtaccctggaaacagatgaattgtacggtatgtgaattatatctcaataaagctgttattaaaaaaaagatggacagtcccagctactcaggaagctgaggcaggagtattgcttgaggccaggggttggaggctgcagtgagccgagattgcaccacggcactccagcctaggcaacagaaccagacgcttctctttaaacaaaaacctaaacaattgtagatttttttaaaatgaggctttttgttttttttatgccaaaacccttcatagacatgaaataacagaagagtaagattggcggggggggggggggcggtttcatcagtacaggttacctgaaagaactgagttgttggtctgacctctgctaggactcgccatgtgtcatggcaggcctggcacctgaaggagagctttagcaatttgcactcacatcatcctggacctcagcctgggtgatggtcactgtcttgagacagcttcagaacaggcaacctgggtgtggccgccttgtcaaccagagataataaaaacacaggtaaacctctgcacctccatcgtcatgccgaattataacaacagcacatatttgttgaagtcttactatgcactaggcacagtgctgagtgcccatgatgcagaggggaatttgagagtgtcagtcatttctgccccttcggatcacgcactgctttccagtgttcccaggagaccagttttgaggttagaattctgcttcttacagtgaggactgattctgactcctaggaggacgaaagccccttttaaatttactttggctgggtgtggtggctcacggctgtaatcccagcactctgggaggccgaggtgggtggatcacttgaggtcagcattttcagaccagcctggccaacatggtgaaacaccatctctactaaaaatacaaaaattacctaagtgtggtggtgcacgcctatcgtcccagctacttgggaggctgaggcaggagaatccctggagcccgggagcggaggttacagtgagctgagattgcatcactgcactccagcctggatgacagagtgagactcgtctcaaaaacaaaacaaaacacaacaaaacattactttgaagccacagcattttgcacaggtaggaaaactgctgggcctggagatcttctataaatatgttgagagctgatgttgaagagattattgaagaatcctgatgtcacagaattttctatagacaacctccttgcggggagggcgcagctttcgggttctgtatcgcacaacaccggctgggagctccctgcatgtgtgtttccagcactgcctgtctatgggagctaaggaagtggcttcaaaaccgcttgccagagacgcgcagtcacccagtcgttgcagcgcttgtacttgtgggagctgtcttgcaggctcaggcatctttgataaggaattcctcatacttagaagtggcacctttgttctgctggggaattgttcccaaaaggtatctttttttttttttgaaacggatcctcgctctgtcgcccacgctggagtgcagtggcaccatctcggctcactgcaagctctgccttctgggttcatgccgttctcctgcctcagcctcccaagtagctgggactacaggcgcccggcgccacgcctggctaatttttttgtatttttagtagagacggggtttcaccgtgttagccgggatggtctcgatctcctgacctcgtgatccccccaccccggcctcccaaagtgctgggattgtaggtgtgagccaccgcgtctggcctttttttttttcctttttgagacagagtcttgctctgctgcccaggctggagtacaatggcctgatcttgactcactgcaacctctacctcctgggttcaagcaattctcctgtctcagcctcccgagtagctgggattataggtgtgtgccactatgcccagctaattttttgtatgtttagtagagacagggtttcaccatgttggccaggttggtcttgaactcctgacctcaagtgatctgctcgcctcagcctcccaaagtactgggattacaggtgtaagccaccacgcctgaccccaaaagacatctaaaaaggctttttcacttgtgaaatctgctgaatagagctggcttcctgaggcctgggggcccttcccggtgtggaagaatggctctgctgttggctaccacagtgctggggcctgtactcccacctcctctgcctctgtctgccttgtgtgcctccccttccgcgggggccctgctctctgcctctttctgaccttccagagtttttgaggtgtgagtgtgttgttgaatttcatttacataataattaaagagtcagggtttcatgatctactgatgtaaaacccgcaaaaaccctaaaatctcgagtggtgttgtacagcatgtgggattcttttgtataacttgatgattttcaaaatatccatttcggctgggcacagtggctcacacctgtaatcccagcactttgggaggtcgaggcaggtggatcacgaggtcaggagatttagaccatcctggctaacacagtgaaacccgtctctactaacaatacaaaattagccgggcatggtggcgggcacctgtagtcccagctactcgggaggctgaagcaggagaattgcttgaacccgggaggcgtagcttgcagtgagccgagattgtgccactgcactccagcctgggtgacagagcgagagtccgtctcaaaaaaaaaaaaagaaaaaaatccatttaatcagagccatacttgttgattactacaggtgcttcccgtatctaatacctccagcaagaaggtttgcgaaatgggcagagagtaataggaagagtttcaggaagatggtttgagtgaaaatcatttcagaaccgagccctgcgaagtcttggtttctgcaatccaccacagtttgggaaaatcgggaattttgtttagtccatttctatttttgtgcaccacaaatatgtaaacaaagctgggatcttcgtcgggggcggagggaagggcgacagaaccctgacatctaatactggtcatcggtatttccatgtgtttcctgatcccattgtctctgctatttaaattaattaattccacaagtatgcactcagtaaatattgtgagccaggcactattctcggctctgtggttgcatcagtgaacaaaacagacgctaatcctgctttcgtgagccatctataatagaatgggcgagtcaagaaattgacacatgcattagaaaaatatgtagcgtgtcgctggtaagtgcttgagagctcatcagggaagggcaggagtttgtggagtgggggtgagggatgtggggtggggcggggcaagggtggcaagaggcctggggctgctggttgcaactgtaaccagagtggccagggaaatccttgctcctctgggtaatgccctatccagaagacccttgcaaatttctaaaatgctgtgttttattaccgagaaagagtcgtctgggagctctccgaggcaaataacttttgaagttggcatgagcaggatattgtgcaatggggctcactggcttcttcccaggcctccgcatctgatgtgaaccacagctttgcaatcgggtccccgtgccatccaaaaatattttgtgaccttgccggttggcagttttttaaaaatgttattttcagtctccaaaaaagggaaacatcaaagtgcaggctgtccactcctgcccttcttgatagacacagacagctgggccacacaatcagccattgtggcgacaagtgcccaactgttataaatagacggcgggctcgcacgtgaagcgctccagaggaagggcaagtgctctggggacactgccaactgctgtttccgtcgagagctcttctcaaagatcaatattattttatgtctcagtgactgaatttgaaaaaacgactgtgaaagcacctggtaacttaactgtctccaggattccattccaaacgcatcttctctcttcactgttaatcttagatgtttcccatgcttatttagtaatcattgcctgacggcccacttcactgcgatttacagtctcttgcggctcacttgaaatggtagagttatggataaccgcgctggtgtatgtgcgtgtgatgcgtggccggaagcgcatgcccattgaataatcacgttcgtcccacatcttagcccctcttccaagacatgtttactatcgtttacgtgtgacatgtcaaaacatcttaaaactatgccacgcatgtaataggctctcagtgattaaaaaatcagtttgtctcttaaggagaaaagaataacagcatgtgactcttgtgagtccctgacaaagaatctgttgttccccgtgcacttgaagagccgctcatgtcaagaagcaacttgtgattatgcaatgtgtgacttaaggcattgtcagatgcgttcggctgaaacgggaccccgccccagcagtttgccttactaagttaacatggtaggtcagattttagtattgtagaaaaagccacattcaatattctttgagtagcatatttatttcctagggctactgtaccaaagtacctcaaaccaggtggcttcaaacaacagagttacacgctagttgatatctagtgattcaaagaacagaattccacactagttgttatctaggaatgcggagtgagtgatagagggggttttggtggcgttatattctaattttgaagtaagtttaaatttacagagatgctcccaaacagtataaagaattcccaaatactcttcacccagattccctgaattaacattccgacatgtttgtctgtctgtctctccacatacacacatcccttttttccggaataatttgagaatagactgcagagagtgcctctagattctcctgtgtgggtttcctaaaaacaaggacgctgtcccggatagcctgcaccgacctgcccaaatcaggacgtgggcactgtcacaccatgccaccaaatgcagaggccccggagcccgcccaggaccacaggcgccgtctgtgtcaatggctctcgagtctccttcaatctggggctgttccttcgtctctgtctttcacgaccttgacatttttttaagagaacaggccagttactttgtagaatgtccctcggtttgggctggtctcatattccttcatgatgagaatcaggtggtaggttcctggcaggagagtccctgcagggttgtcacgacaggaacgcacacaggtctgatcagtcccatttctggagaagttaacttatcatttggttgaggtggtgtctaccaggtttctccactgtaaaattaatttgttggtattttgtaattatcagttaaaaagtactgtttctggtggggagattttttggggactcggaaaatatcctgtttctcattaagctttttgcccatttgttttagcatcctgggatgattcttgcctgagggaattagtatgagcattgccaaatggtgatgtttctagttgcattgtttcttttgcattgattagttggcattccactgcaagctggagcttgcctgctgtctttctctccttcctatcaatacactcatagactcctattttacccattgggttataattcattaccattatcatttgcttcgatacccagattgtcccagatttggccaaaagcagcgcctccaagctggcccctgtgttcttttgatgtgttcatgtcattctttgagcacatctttacttcttcttcttttttttttttttttagatggagtcttgctctgttgcccaggtgggagttcagtggcgtgatctctgctcattgcaagctccgcctcccgggttcacgccattctcccgcctcagtctcccgagtagctgggactacaggcgcccgccaccacgcccggctaatttttgtatttttagtagagacggggtttcactgtgttaaccaggatggtctcaatcccctgacctcgtgatctgcctgcctcagcctcccaaagtgttgggattacaggtgagagccaccatgcctggccaggttttttcgtttttgtttttgttttttttgagatggaatctcactctgttgccccggctggagtgcaatggcgtgatcatggctcactgaaacctctgcctcctgggtccatgcaattctcctgcctcagcctcccatgtagctgggattacaggcgtgcgccaccacacccagctaatttttgtatatttagtagagatggggtttcaccatgttggccaggctgatctccaacttgtaacctcaggtgatctgcctgcctcgtcctcccaaagtgctgggatgacaggtgtgagccactgctcccggccacatgtttagttcttggttctaggctcacccggaactttccttgctccagccctggaatcagccatttctccaataagccctggttccttttagtagaaagtggtttttagaaaccaggatctaagtattaggtgtgttcacgctactgggctattacggctacaaggacttctcaagcagcgtagttaggaattttttttttttttttttttttttgagacggagtttcactcttgttgccaagactggcatgcagtggcaggaacttggctcaccgcaacctctgcctcccggttcaagcagttctcctgcctcagcctccctagtagctgggattacaggcatgcgccaccacgtccggctaattttgtatttttagtagagacggggtttcaccatgttggtcaggctgggtctcaaactcctgacctcaggtgacccatccatcttggcttcccagagtgctgggattacaggcatgagccaccgcgcctggcatagctaggaaattaaacatatgcatgtacttccctacacgtacacatatgtttgtacatacacacacgggcacacatgcgtttgtagttctttgtatccatctgtcccgctcgtatctatgtatccattcatctcatataaaaatcatgataccatccaagtcaaatggtttgtttcagctttctcccctttccttggctgtgcccctcttttctaacaataacagtaacagctcttatcatattaactgtttttatttattgacccttgtatgtcaccagtcttctgacatgcaggccatccagtccatgttcctggcccaggaacatggcagccaagggtccccacccccacttcggcccccaacagtggactctcgggatagttctttttttttttttgagacacagtctcactctgtcacccaggctggagtatagtggtgtgatctcggctcactgcagccactaactcctgggttcaagcagtcctcccaccctagcttcctgagtagcagggactacaggtgtacaccatcatgcccgtctacttttgtattttttgtagaaacagggtcggtcttaccttgttgcccaggctggtggatagttctttatagcagtagcctaaacagaaaaacatatacaacataagctaagaaaaaggcctcccttatcgatatttctgggttaatctgaaagattttgaagtctggaagaatcagctggttgttggtaaagggacggtggacatgaaggatgcggaagggatgggttggaggcgggaggtgagtttcatgtggtgtttttgactcagagggtcacttttattgttctgccttgtagtcagaagaaaaatcttttcacgtggtttcggctcagaagtatgttagaaagtagactacagagactgaaggtgacattccagagactttttaaggataatctggccaaaggtgtttactatttgattagccagcatccttgggctcggctagggtcttggtctggtctgagaacatgttgggggattgtgccagtgtcggtggtgggtgcctgtgcctggtcatctatgggcagctaggggtgggtgctgccccttccgactttctctccactgcagagacgaagccttcagcagcatttccctggaccctcttctctctggtcccaggtcaggttctgtacagcaatggaaagcaggggagaggatgcccacgctgtgcgtggccgtttggagcagactcagggaccagtgggacctcctcttctgggtgagcttggcaaccactcttttaggaattccagtttgtaatgccttccgggtgagccctgtgagtcgcttgctcttagtagtgtcctttgctgccccagccttctgcttccctgtatttaaaacctttctgagccaggattacgatttcctgataccatgactgacccttggtcgttatgagtcctgatggtcccaggagcttttccttcatttgcttgggttttgagttgtgagctggagaccaggggttttgcttgatggggacattcctggctcttctcctggggagtgaccatgggccctgcctaggtgagatcctctggattgtgaggagggacttgagcagccctactagagtgccgtctatgggaaccctcagcatcgcctgtccaagccagcatctagtggacgctcacgctgtgtgagacactgagcttatccagcaagggcagaaatggcagctcttgggaaagaagggagtggggcatcgctgtgtctcctattatttgccattgtggcctccctctccaggtgcaccgaggggcctatctgtgtgattcttgcaggggtactgacgtccgtttcatctcacccgtgtccctctacaagtgcaggagttgtagggctatgttattcttaggtagcttaatggatccattttcataataaactccattttattttgtttgccattgtactgccatttgcggaacaaagagaagttatataaaccacagaagggggagaatgtgacccaggaataaactgttgtgtttcacagtaagtgtatggaactaatttagaatgatttttcattgtcaaacaaagaacaaatggaaatttgaacaatgcatggttacttttaacaaagacttcattttaatgttattagtgttttctcattttaaaatggcagtgcaaatataaccttaaaatagggtttatgactaattacatttcttttttgtatgtctgacaatttccaattattgggtgtttgtgttccccagcccaccctcccccaaaaatgacagggaacagaaaccagtgaaaagatctctctttggcgcccttcccagactaggacctgttttgttcagggtgagcacagaggagaactgggtcctcttgtcaggctgaaggggacgtcacagaagccccaagtgggtcacggcagagcgtcagccagaacctccagggctcactcccaggcctcagtcaccagatgcttcgtggctacctgggtaagggagggttcagggcaagttagggactgcaatgagaaaacaacacactctggccggatgcggtggctcacgcctgtaatcccagcactttgggaggccgaggcgggcggatcacctgaggtcaggagttcgagatcagcctggccaacgtggatttcaaccaaggacctgcttggtcatagatttcaaccgaaggacctgattggtcatggatttcaaccaaaggacctgattggtcatggatttcaaccaaaggacctgattggtcatgcagacagaactttgaaggctgtcatgggttgtgtccatgttgtttggttttccatcttgaacgaataccagtgtgcgtctaacagctcacacagaagcccattggttacaaaggaattgcaattgtcaatccaattgccccccagggagaactgaagatttttttaaataatgtcttcgtaacagctgtgtaagtcccccaggcccttaactagagaaaccacatcacagaattttatttactttataaattctaatattttagaattaagataatttgtagtttagatgatttttgctaagctagctctctctttctttttatctcttcctttctctcttttctttctttctttgatggagtctcaaaaaaaggagaagggtgtccaaacatcctggatgaaaatggctccatgctgtcatagaattttatttactttataaatcctaatattttagaacttaaaaaagatactttgtagtttagatggttatagttaagctatttcattttttttaaaaaacgaagaaattagcattcaatgtctgcctagaaacaatcttatatacagtccttatgtacaaatcttttttgtggaatatgttttcgtagttttttgttttttgttttagattgggtcttgctctgttgaccaggctggagtccagtggcgtacttatagcttactgcagcctcgacctccagagctcagtcagtcctcctacctcagcctcccaagtagctgggactgcaggtgcatgccagcacacttggataatttaaaaaaaaaactttttttttgttgttttgttgagacggggtctcacttatgttgcccaggctggtctcgaacttctgggctctagcgaagctctttcattttagaaaaggatcatgtcacctcgatatgtgaggtctgtggaaaatcttgctttaagatgatctgcgtgaactagtagcttagattattgagtcttattttcttcagaactctgataggcacaattactagatttaagttaaagggctgtaaaacagcctcagtactttttcatgaagtagacaagtttcacagtgctttggaaatgactactaagctactcccagcctgctcattgagaactcacgatttcctctggatgagtgggaatgttgttggttctgcatttgtcatcagtgcttaggacacacacacacaagcaacgtgtgctggcccatgcagtttttccttatttacaaagctcatgtgagaattgtgactctgcccattcgtggatctgcacaacatatggtgacgaatataagttcgggggcgtggggggaatgcgcatgtgctatggttcagtgctgggcactgggtgttgtggttcagtgctgggcactgtgtgccgtggttcagtgctgggcactgtgctgattgcttctgcgactccggacagatacttaaggctcagctcaggttcgtcattaacacgaatcacaaattcagacctggtgccgtggctcacacctgtgatcccagcactttgggaggccgaggcaggagtatcacttgagcccaggatttggaggccagcccgggaaacataggaagacccccaactctacaaaaaatatgaaaaaaagtttagccaggtgtggtggtatgcaactgtagtcccagctactggggaggctgaaatgggaggatcgcttgagcctaggagttcaagaccagcctgggcaacatgatgaaacctcatctctacaaaaaaaaaaaaaaaaaaaaagaaagaaaaaaagcatggtggtgcatgtctgtagtcccagctactcgggcggctgaggtgaaaggatcacttgagccaaggaggtcgaggctgcagtgagccaagatcgcgccactgtactgcagcctgggcaacagagtgagaccctatctcaaaaaattcacaagggttttcaaagctagttactgcctgagaccatcttcccctcttggatggatgcagcaaattgggaggcaaaattatttggctctttttttttttttttttttttttttaaggcagagtcttgctctgttgcccaggctggagtgcagtggtccgatctcagctcactgcaacctcagcctcctggattcaagcaattctcctgcctcagcctcctgagtagctgggattacaggtacacgccaccacacctggctaatttttgtatttttagtagagacagggtttcaccatgttagtcaggctggtcgcgaactcctgaccttgtgatctgcccgtcttggcctctgaaagtgctgggattacaggcgtgaaccaccgtgcccagccgcgtttggctccttcctaactaaacagagattaaactgtttattgttacctgggctttcattttttcatagcagtcactttattttcatctctttgtcctcagcttcccctcaaatatttgtcaagtgtctaccaaggctgggaatgatagtaaaaggagtttaaaaaacaaaagaggctctaaaaatggtactagactcttccattcaggactttgtccaaagcctcactttataatgcttttgtgatttatcctcattcccataaactcagatgatacgaatttatacgagtttgcattaataaatatttcttgcatgcttgtcttatcaaccataccgagccagcacagcctcatctcgtaaagagttggcagtcacgtgcgggagccgggagcccgttgctgtgaggccgggaagtggattgttggtctggggaaagatttattttctgggggcaaaagaggcggggtggagagtccctccgcctgcctggagtgctgatgtggcctcagagctaggtcctgaaaaattgctgggatttagatgcaggctctacatgtagagagattgtttaaatgtataatggttcagaagtgacactctcttgctatgtttctctgaaaatagatcagccttctctgttgggatctatgaagctccagagataaaactgatatacattaaagtggctcgtggttaaaggaagtatgtttgttaatattaaaccgaggtttctctggtaactagattttaaatgatttgattccataggtttataatggagaaatccagatctccaaaatgtaagttttactatatgggaagcctttttttgatttcctttgctgtgtttggtaaatagcctggaagaaaatggctccgtcctatcacagaattttattatttacttcataaacctagtgttttagaattttttttttgtttttttgtttttttgttttttttgagatggagtctcactctgttgctcaggatggagtgcagtggtgcgatctcagcccactgcaacctccgcctcctgggttcaagcgattctcctgcttcagcctccggagtagctgggattacaggcacacaccaccacacctggctaatttttgtatttttagtagagatggggttgcaccatgttggctagactggtgtcgaactcctgatctcaggtgatccgcccacctgggtctcccaaagtgctgggattacaggcatgagccaccgtgcctggcctagaattttaaaaagattctttgtagtttagatggttctagttaagctatttcatttttttaaaaaggaagaaactagcattcaatgtctgcctagaaaacaaaaataaaaaaacaacaaaaaaggaagaaactgaggtctgtggcacttaagtgccccactcaaggttgcagagttcctagtgatgttattttttaatgaacttttcttctccttctcttttttgttaaattttggcagactgttttaccaaagcctaactgtacttttcttaattaactttggaatgaattctggatatactcattccagcaatgcacagaaaattctaggcaaagaataaaagactccacattgtttattattattatttttgagatgtagtcttgctctgttgctcaggttggaatgcagtggcggaatcttggttcactgcaacctctgcctctcatgttcaagtgagtctcctgcctcggcctcccaagtagatgagattacgggcagctgagattacaggcacgtgccaccatgcctggctaatttttgtatttttagtagagatggggtttcaccatgttggccaggctggtctcgaactcctgacctcaagtgatcctcctgcctcggcttcccaaagtgctgggattataggtgtgagccaccgcgccgggccagactccacattgtgaaaaaacgagggaaccgcttctgattttgctccagtggtgtattcctctgtcttgttataatgctttatgtttacatataacacattatacgatttttaaagcaaccccacagggaagagttttaattttttgtttgtttgtttttgagacagagtcttgctctgtcgcccaggctggagtgcagtggcgccatctgggctcactgcaagctccgcctcccgggttcacgccattctcctgcctcagcctcccaagtagctgggacttcagtcgcccgccaccacgcccggctaattttttgtatttttagtagagatgaggtttcagcatgttagtcaggatggtctcgatctcctgacctcgtgatctgcccgcctcggcctcccaaagtgctgggattacaggcgtgagccactgcgcccggccgagttttaatatttttagtcctgttttacaaaggggagaaacgaagcacagagaagtttaggaacttgcccaaatcatacagttgataagttagcagaccaaaaccggaatcgtccaaacggagtggcagccagaaagcattttataggtaaagtcacatcctacactgtaaataaaaacctcttggaacacagagttcgccaggtggctgttggattttcatgtcagcgctggtctagctccgttttgcaggattttttgttgttgttatcacagtatattctaaaaataactatatgttcatttccactctttcagataattaatatttataaatcctagtcactaggaaatatagttcaaccaacaattgaatggaatgcaggtcctctgggaacttatctaaaattaaatcctattttaacagaattagctagattaaggtcatggtgtaaaaactgatttttcagaaggaaataaaaatgcaaaatatcctaagaattcattttgtaaataattgaatcaaataacaatggggcggggaagaagccatatatttttcctctctttttagaaatgaattgaaggccagacatgctggttcacatgtaatcccagcactttgagaggccaagcgggagaattgcttaagcccaagagtttgagaccagcctgtgcaacataggaaaaccctgtctctacaaaagaatttaaaaacagctgagtcagctgggcgccgtggctcacgcttgtaatcccagcactttcggaggctgaggtggatggatcataaggtcaggagtttgagaccagcctggccaacatggtgaaacccccgtctctgctaaaaaaacaaaaattagccaggagtggtggcggacgcctgtagtcccagctactcaggaggatgaggcaggagatctgcttgaacccgggaggcagaggttgcagtgagtcgaaatcacaccagtacacttcagcctgggcgacagagcaagactccgtctcaaaaaaaaaaaaaaaaaaaaaacttagctgggggcagtggcacatccctgaggtcccagctacttgggaggccgaggtgggaagatggcttgggcccaggtgatcgaggctttagtgagctgtgattactccaccgtactccagcatgggcaacacggtgaaaccttgtctcaaaaaaaaaaaaaacaaaaaaaatcagataaataaaaacaaaaaattgtttagactcatgaatcatcaactttttctttttctttgcccattttcttttttaagtattagcttggcattaaagcagtagtatatgaagatggaatttgctagtactttatttgtgattccagagttaaatgctactgcaatcaagtcttccttgaatttagcaatagatttaaaagtttagaaagagcctcttttttttttttttttttttttggttttaatacggggccttgctttgtcgcccttgctcgatcgcccagtgatctcagctcactgcaacttctgcctcctgggtttaagtgatcctcctgcttcaggctcccaagtagctgggatgacaggcgtaaaccactacgcccagctacattttgtgtttttagtagagacggaggtgtcaccatattggccaggctggtctcaaactcctgacctcaggtgatccacctgccttggcctcccacagtgctgggattacaggcgtgagccaccatgcccagcccaagtctagctctttagaaggaaaaaataagggtagaaattcagagaaggatgagtgtggagtggcttccttgctctatttctagaatatgccatttcttgggaagtcttatgaccctgctggtctttaatgtcccctatatgattttcctccctgggctttgattctctgctttatctcctgtggtcttttccatccagaaattttgaaggggtatttaccttcaacttaaaactgactactacaggtaagtagtggccctgctgtttccaccctcccatgtctactggaagcagaattgtttcacctgtctcgttggaaaatcaaatgaggtaatggaaatgaaaagtactacacaagtgtgattattaaagacagttcagtcaataggtgaaaagactcgtgtagatactttatttaacctggaatcaatgtcttatactcagtagacactccttagatgtgagtttaaagatgtcattactcctataataccagcactgtgggaggccaaggcgggtggatcacctgaggtcaggagttcgagaccagtctggccaacatggtgaaatctcgtctctactaaaaatacaaaaattaaccaggtgtggtggcggctgcctgtaatcctagctactcgggaggccgaagtgggaggatcgcatgaacccaggaggtggagattgcagtgagccgagattgcgccactgcactctagcttgggtgacagagcgagactctatctcaaaaaaaaaaaaaaaattaagaagatgtcattttaatgagcagttctttgttaagtaaagaagaagaggaaaccaggaaatatgatagtgcttggccacctcaccaagtgtttgtcttaaaagaagctttcttgattaagtaaaaatttaaaaggaaggaaagaaaaacccaacctcaccgcaacaaactaccctagtctgaggtaattgtgtagtgtaatgtccctacacctgaatttttcatgcacctgcagatttaggggctctgcctatctttgagtataaatgtccactgaattattagcaaaatgatttgttctcagaaaccaaaattttagcctagatgaatgccgccattggagttatttatatgaaaaggcgtgttaagctcaatggtcttctcttctcttctcttgttttcttttcttttggatttgagacagggttttgctctgccacccagcctggagtgcagtggtgcaatcatgggtcaccgcagcccctacctcctgggctcaggtgatcctcccacttcagcctcccaagtagctgggactacaggtgtgcaccatcatgcccagctaatttttgcatttttcgtagagatgggatctcactatgttacccaggctggtcttgaacacccgagctcaaacgatccgcctgcctcgacctcccaaagggctgggattacaggcgtgagtccctgcacctgacctcaattgttcctttcagcaaaagtaaaattttaactttcaagggtgcaatcctgcttttttttttttttttttttttgagacagagtttcactcttgttgcccaggctggaatgaaatggtgcgatctcggctcactgcaacctctgcctcccaggttcaagtgattctcctatctcagcgtcccgagtagttgagattacagatacatgccaccgtgcctggctaatttttgtatttttagtagagatggagtttcatcttattggtcaggctggcctcgaactcctgacctcagaacatctgcctgcctcagcctcccaaagtgctgggattacaggcgtgagccaccgcacctggcctgcaatcctgcatttaaagcatttttaaagtgtcgttggaacacttaaaaagacaagaattaaaacagtagcagaacacctaaaatggcaaggaaacggcatgagggcgtgtaacacagaaaggggtgggtgtttgagaaacagcaccgcaagtacgtggggaagcggcaaagatggaggacatgggagatgggggtggaaaggggcttggggcctggtagtgaaagactttgcatgccacgttagagtctctgctctgttctgttagcaggagtttgtagtagtacctattcacagactggtgcgggttaactgtgagggtaatgcgtgtaaggtgcttagaacagtgtttgacacataatccgtattctctaaatcttagttgtaggagatgttgttgctattatttttataaaagggcaagcattacgagtttcagagcaaggcttatggggtgataatataatggaggatgaattggaagaggagaaactggaagcctggagaatggtttggaagctctttgctggggcccgagagacattcagggttcaggcagtgggagtggaaggaaagtagtggattccacagcgagacttggcagggcttgatggtgagggaaaggaaggagaagaaagtgacctggaggcttctggtttggatggttggggagtgatgaccccgagagaagagaggagagaaacagggttgtgaggatgagacccaactactctgttcctcttttctcaactgaaaccatgctgacttcatactgcaaagagtgtacagcgacacggtatctcagtccgttttactgctgcaacaaaatacctgcaactgggtgatttccaaacaatagaaatttatttcttacagttctggaggcagttctggaggccgagaagtccaggatcgaggccttggcattgggtgtctggtgccatgtcctcacatgacagaagagcaaaggctacggactcgttccctcaggcctttcatgcggttgctcacccctaagccctctcgtattagggtcttcatcccatttgagaaggtggagcactcatgacttcttccttacctcctaaagaccccactgcctttttttttttttttgagacagaatcgtactctgtcgcccaagctggagtgcaggggtgcaatcacggctcactgcagcctggacctcctgggctcaggcgatccccccacctcagcctcccttgtagctgagaccacaggcgtgtgccaccacgtctggctcattaaaaacaattttgtttttgtagagacggagtcttcgctgtgttgcctaggctggtcttggactcctggactcaagtgattcttccacctcagcctcccaaactgttgggattacaggtgttgagccactgtgccagtaagaccccacttaataccatcccttcgtgatgaagtttaaacacgtcaattttgggggacatttagaccatagcacataggtttcaaaaatgagtcaaagccttaaatggattgtctcttttctagtaccagctgataggcctcacgtctgttcactgccttctgatgctcctccttaaccctgtgtaggactctgtagtacaggtctccgctcaaagacagttgtaaacgtggcacagttagtcaagagcattacaataaaaaatgctcagcatcactcatcacagagaaatgcaaatcaaaaccagaaggaaatatcaccttatgccagtcagaatggctattagaattatatgagaataatattaagaagtggggtcttactgggcacaatggctattattaatcccactactagatatctacccagaggaaaagaaatcgatctatcaaagggatacctgcacttgtatgttcatcacagcaatgttggcaatagcaaaggtatggaatcaatgtggccatcatcgaatggatgggtaaagaaactgtggtatatgtatatgcagtgggatactgtccagccatcaaggggaacaaaaccctgttatttacaataacatggatggaactgaaggtcattattattatgattattttttatttttattttttagagaagagtcttgctctgttgcccaggttagagtgcagtggcacaatcatagctcactgcagccttgacctcctgggctcaaatgatcctcccacctcagccacacgagtagttgggaccacaggcatgtaccaccatgcctgtctaattttgtttattttttgtagacatggggtctcactatgttgcccaggctggtcttgaactcctggggctcaagcgattgtcccaccttggcctctcgaagttctggagttacaggcatgagccaccatgcccagcttggaagtcattaagtgaaggaagccagacacaaaagacatattgcatgttcttatatgtgggagctaaaaggtttgatcacatggaggtagagagtggcaagaagggtaacagaggctgggaagggtgagtggcggggaggagaagggtcaagagaagtcggttaaagggtaccatcatgcagtaacgtagaaggaataagttcaaggcttgagagcagagtaatattattctaatattatatatattctcacctaacaaaaaatgtattgtggctgggcatggtggctcccgcctataatcccagcactttgggaggccaagacaggcagatcacctgaggtcaggagttcgagaccagcctggccaacatggcgaaaccctttctctactaaaaatacaaaaattagccgggtggttggtgggtgcctgtaatcccagctactctggaggctgaggcaggagaattgcttgaacctgggaggcggaggttgcagtgagccgagattgcaccactgcactccagcctgggtgacagagcgagattgtctcaaaaaaaaaaaaaaaaaaaacaaacaaaccccaaaaccaaaatgtattgtatttgagtgatgggcaccctgaatgccctgacttcatcactgcgcattatatacatgccataaaatttctcacataccctccaagtttgtataaataaaaagggggtgttgaatacagactttcaaagaaaaagcattctgctcaaaactcataaggggacgtggtgtgtgtgtgagttctgaaagaagtttgaaggaccagggttgaccacatgatcacgggaaacagcagctcctgggttgcttcaaggtgctgtggctgttggtggatgaaatcagcctactaggagataggaagatacaaggagcttctccagtgtactggaagatcacagctctggcatcatgggatctaaggagctggcttgtctttagtgaagggaggggggctggggccccttggaatctttttttttttttttttttttttttttgagatggagtttcactcatttgcccaggctggagtgcaatggcacgatttgggctcaccacaacctccgccttccgggttcaagtgattctccaccctcagcctcccaagtagctgggattacaatcatgtgccaccacgcctgtctaattttgtatttttagtagagacggggtttttccatgttggtcaggctggtctcaaaactcccgacctcaggtgatccgcctgcctcggcatcccaaagtgctgggattccaggtgtgagccaccgtgcccggcccccttggaatctttaaggccaagacctgggaggctggaggtcgagcatgaaacaaagcgaaatttccctgagaaggaagaaagaagtgaggattccctgaaaccaagaagcagctctgtgttcccatctttcctcgtgtgtgtcattggcttcccatgcatataggctttgcgaggcaatctaagcatgtgtgcacgtgtgttttgtgtttttgtgtataattgagtatggctgacttttgagtgggcacccataatcactctgtatggcaattacacttatattaactttaatccatttcagagtaatgactcataatatttaatacccacatatcattgtgtattatatattaagtaattattaagatataatagctgtcctgtggttctttctgcagttctgcaatgcataagtaaatatatatctacttagcacctggcagaattctgacactggttccctggagtgagggctgttgtggtagcaaaggccaagtggaagctgccagaactgcctctgtctaccaaaatagtcaacccaaagcaattatcacattcctgggaggatggcagagattagtgccaccatcagggacttgaaagatgcaagggtggtgatcgtgtcacatctccgtttaatccatatttggcttgtctagaagacggatggatcttagagaatgacagcaggttgtcataaacttaaactaggcggtgactgcagttacagctgctgtgccagatgtgtttttgttgctggaacaaatcaacacatttcctggtacctggtatgcggtgagtgtcttctccttctctacctggtagtaaagatgaccagaagggtcttgcttccagccggcaaggtccacagcccgccttcatagttacacttcaggggtctgtcagctaccagccttatgttatcacttcagtctccttcttcattccatggggtgccaacggataaccactcagatagaatgtaaaaggactttgggccaggtgcagtggctcatgcctgtaatcccagcgctttgggaggctgaggtaggcagatcacttgaggtcaggagtttgacaccagcctggccaatatggtgaaaccccatctaataaacccctactaataatacaaaaattagctgggcctggtggcaggtgcctgtaatcccagctactcaggaggctgaggcaggagaaactcttgaacctgggaggcggaggttgcagtgagccgaaatcgtaccagtgcactccagcctgggtgacagagtgagaccttgtctcaaaaaaagttcataaaaggactttggctcctcttctggggagagggttagcatggttttggttgtaagacggatagtagcattatatggcatggaagcctagttgctatttacttgatttggaagttaagtacggttgaaaagaggagtagatatggacaccaagttgacaaggggtacgtgtagtgagttcgttttgcgtcaccttggctaagttggagctctgtatgtaacttgagccacaagagaccatttgtgtaagaccgagaaggcagaggggacacagcagccacatgcactgtggctcatgcacgtggtctctgatctgcaggctcaccttgttggcgcacggcagccatcaggcctgtacctcttctgaaacccaccaaatctttcgttgttcccctcatctgcgtatgtggcagacagtttttctatgttttcaggcaattgttgagcaaataataatagaatttttgaacaggccagcatcggtgctaatatgtgccaggcacagatctgagccctttagagtatttactcatttaatcctcaaaaccctgtaaagtcactgatgttgccataatctgtcagactcagaaactgaggcacaaagaggttaagtaattgcttaagccttcacaggaattgggatctgaacccaggcattttggtgtcgagtccatgaactgacgaagaacatagataactgttgtcagcttgtcaaggctcatgcctgtaatcccagcactttgggaggccgaggcgggtggatcacaaggtcaggagattgagaccatcctggccaccatggtgaaaccctatctctactaaatcataaaaaattagcgtctgtagtcccagctactcaggaggctgaggcaggggagtcgcttgaacctcggtggtggaagttgcagtgagccaagattacaccactgcactctggcctggcgacagagcaagactccgtctcaaaaaaaaaaaaaaaaaaaattacttcaaggagagactgctgagggttcctctgtctcctgtgtggatggaatttggcctccatttggaatcgggaatcttgcatatttagttctgcagtattacgtgaatctacggaagcaactcatttggaattagattccaagccgttataaataataaattttttgtctctgtcatttttgtagtaacagcaagagaaaagaatttaggaccaaaacttatgagagttttaaatattttttgctaagtgcttatatgtgatttatgggaaaatcataatttttaccctggaaggcagccttactcataaagaatggccatcttgtagcacctccaggacatcagtctgaagtctaagttaggtgtgtttgcacagcaaccaaatggtgagagcatttagcagctgggggacggcggcattgttgtgattgggttgccacgtggtggggcgggtgagggacggcagcagagccttggcagagcggagctgtgtggccgacggcttcctctttcttcctccagcgtgcgattataacttgttgctcatgcaccggcatgcagctctgtttgctcagtctgtttttctgtaaagtctctttttaaaaaagtatatgatacaggctgggcacggtggctcatgcctgtaatccgagcactttgggaagccaaggcaggtggatcacttgaggtcaggagttcaagaccagcctggccaacatggtgaaacctcacctgtactaaaaatacaaaaaattagccgggcatggtggtgggcacctgtaatcccagctacatgggaggctgaggcacgagaatctcttgaaccagggaggcagaggttgcagtgagccgagatctcaccattgcactccagcctgggcaacaagagcaaaactccatctcaaaaaaaaaaaaaaattgtgtgatatagatggaagaccacgtaaaataaatgtacaatctgattgttataaggtgaccgcctttgcatatctaccaggcaggttgcaggagagcacagccagccacccagcagccgtcctgccctccacctgccgcagggggccagatcttgccattcctggtggtcccgtctctgctcttcttggttttctttctttcgttctttctttttttttttgagatggagtcttgctctgttgcccaggctggagtgcagtggtgccatctctgctcaccacaacctccacctgctgggttcaagcaattctattgcctcagcctcccgagtagctgggattacaggcacgggccaccatgcctggctaatttttgtatttttagtagagatggggtttcaccatgttggccaggctggtctcgaactcctgaccctgtgatctgcccggctcggcctcccaaagtgctggggaggtgtgagccactgcgcccggactttttggttttcttatccaactgtgagtccttcaacacttggcgtcgggtgtttggcttgtctgttttttggcttgcttttgcttttttctccaacttttaatttaattttaattaattaattttatttatttattgagacagggtctcagtctgtcactcaggctggagtgtagtggcacgatgatggctcacctctgcctcgacctcccaggctcagatgatcctctcacctctgccccctgaggaactggaactacaggtgtgcaccaccatgcctgattaatttttgtattagccagtggtttcgccatgttacccaggctggtctcaaactcctgggctcaaacaatccacccgcctcggcctcccaaagtgctgcgattccaggtgtgagctactgtgcctggccttcgcaacttttcattttgataaatttcaaacctacagaaaagttgaaataatagtataatgaacactaatatcccacttcacctgattgacccgtggttaacattttgccaaatttctttggctgtctcagtgtaggtgtgtatatatgtatgtgtgaatataattatacacacatttgtgcaagaaccctgaatgggatataatacagtacacacatatgtatgtgcatatgtgtatgtgtgtgtatctatatttgtcctcttttttctttgctgagccattgaaccgttaactgactaaattgcagacattgtggccctgcacccttaaattcttcagcatgtatctcctatgaacaaggacattctcctgtacagacaaaacaaattatcctactcaagaaatataacattgacagaatactcttataaaatatatagttcatgttcaaatttccccagcatctaacagtatcctttagagcttttatggtgttcatccaggatccaatcagggatgatcttttcctaaaagaggacactcaagatctagatctagaacagttccgcacatttttttttctttactgctattggcatttttgaagagtttggtttcctgtttcttaaaataaattttgcattgaagtgtaatatgcatacataaaatgcataagtgtacagtttgaagaattatcacaaaaggaacacatccactaaaccagcacccagatgaaacagaatatcccagaagcctccctcgtgtccctcccaacgctacccacttcctccttctaaaggtaaccatgtcctgacttctggcaccataaattgcgtttgcctgtgtttgaatttcgtacaaatggaacctgcagtgtgtattctttttttttttttgagaccgagttttgctgttgttgcccaggctggagcgcgatgccatgacctcgactcactgcaacctccacctcccaggttcaagtgattctcctgcctcagcttcctgaggagctgggactacaggcacccaccaccatgcctggctgattttttgtatttttagtagagacggggtttcaccatgttggccaggttggtctcaaactcctgacctcaggtaatccacccgcctaggcctcccaaagtgctgggattacggacttgagccactgcccctggtcagtatatattcttttgtggctgcctctgtcactcagtgtaaagtttgtgagcttcattcctgttgcctgttgcttacgctggggttccttcatcgtcactgctgttgtgccttctcggtcatatcacaacgtatccatcgatcctcctcttgatggatacatgggttgtttctgggctttgacttttacaataatccctgtgaatacttacgtactgtatcctggtgcacacttgcatgcatttctttggccgaaatcaatgtctagaaggggaattattgagccatagagtgtgagtgtcttcaacttccatcggtaataccgacttgttttacaaatggtgataacaaatggtgataacattgttatcacctcatacccgtcagcagagtatgagggttcctgtgggtggctctgcatcctcaccagcgcttgtcactctgttgaattgcagccactctggtgggtgggtgcagtttcttttggtaattttcatttgtgattctgtatttgatttgcagttccctggctgagtgtcttttcatatgtctgctggccacctgggttggctcttcagtgaagtgcctgttcagctttcttacacatttttctactgagtggtctggttttgttttcttattgttgggcttgttttgttttgttttgtattgtcttgagacagagtctcactctgtcgcccaggctggagtgcagtggcacaatctcggctcattgcaacctccacctcccgggttcaacattcttttgcctcagtctccccagtagctgggattacaggcacgtgccacctcacccagctaatttttgtatttttagtagagatggggtttcaccatgttggccaggctgctcttcaactcccgacctcgggtggtccaccaaccttggcctcctaaagtgctgagattacatgtgtgagcccccgggcctggcctcttactgattttgaggagttctttatattcaggctaccagccctttgtcagttatatgtgaggcaaataccttctcccactctagttttgcctttttactacgaaattgccatttttgtagatcgaaatggtcaaatattggcaattggcatatggttcagcctaccataaaattgatccactttttttctttgttaggtgaggactttttttgtcctatttctctacttctgaggtcatgaaactataatattatttcctagatactctattgtttcacttttcagatttatgtctataatccacgtgaaatgtgaactgatattttttgtgtacactatgaggtagggatcaagttttactttaaaaaatatatagctaggccgggcgcagtggctcacgtctgtaatcccagcactttgggaggccgaggagggtggatcacgaggtgaggagttcgagaccagcctgaccaagatggtgaaaccccgtctctactaaaaatacgaaaattagccgcgtgcagtggcaggtgcctgtagtcctagctactcaagagactgaggcaggagaattgcttgaacccgggaggcagaggttgcagtgagccgagatcgcgccactgcactctagcttgggtgacagagcaagactccatctcaaagaaaaaaaaaagaaaaaaagaaaatagataacgaattgagcactttttattaaagacagttttactaaggtatcatttgcacactatgaagctcagctgtgaaaagtatacaattttatttttagaaaatttagggtatcatctggttttagaacatttccatcatcccatgaggtccatcatatctggtttcaggcaatacctgcttccagtcccaaaccacaaatctactttctgtgtctatagatttgctttttctagacatttcatataattggaatcatgcactattgtagtcttttgtagctgacttctcaattagcttattgtttttgaggttcttctgtattgtagcacagatcaagtatttaggtcctttttcgtgagttaaattcggtggtgtggatatatcacagtgtgtccatccattcaccagctgctggacacgtggattattcccacgtcttggctgtaataaacagagctgctctgaacatcgcttgcaagtcttagttgtttccatttctcgtgagtagaggcttggattggaattgcaagattgtatggtaacgtataattttattttgctaattatcatttgtgaactgacttttttctcttgctatacggttctaaggatcataacacatgtataggttttgtagccaccagtacaatcaggatacagaacagtttaatcaccccccaaaaatctttcccaagggttgaccttttaatatgatttggctgtgtccccacccaaatctcatcttgaattgtgactcccacaattcccacatgttgtgggagggacccagtgggaggtaattgaatcgtgggggcaggtcattcccatgctgttctcgtgatagtgaataagtctcacgagatctgatgggttttttttcttttttttttttttgaaacggaattttgctcttgtcacccaggctggagtgcaatggcatgatcttggctcaccacaacctctgcctcctgggttcaagcgattctcctgcctcagcctcccaagtagctgggattacaggcatggaccaccacacccagctaatttttgttttactagtagagatggggtttcaccatgttggccaggctggtctcgaactcttgagctcaggtgatatgcccacctcggcctcccacagtgctgggattacaggcgtgagccaccacgtccagttgatctgatggttttataaagaggagttcccctgcacacactctctctcttccctgccgtcatggaagacgtgacttgctcctccttgccctctgccatgattgtgaggcctccctagccatggggaactgcaagccagttaaacctttccttcgtaattacccagtctcggataattataaagtctttatgaacagtgtgaaaacagactaatacaccctttatgggtgttaccagtggagggtcttgactacaagttgtctgggttcttaaccagattcttggcattttgaacaaagaattggacaaaatgcacaaagaaagcaacgagaaaacgaagcaagggaagcacagatttactgaaatgaaagtacactccacggagtgggagcaggctcgagcaggagcaagtggctgattagagaattttctggagccttaataccctgtagaggtttaccattggttacttggttacaccctatgtaagtgaaggagtggcctgtgaccagtctgattggttgcaggaggcgaccaatcagaggttgaagtgaagttgcaacgttacacctgaagacctggcctgggaccagtctggttggttgcgggagggaaccaatcagaggtactttccatttttcatctgccacgaggtgcaaagggagtagtagcctctgatccttttgttacctgggtatggttttccttttgattcagttctaaaaagtcagggtgaatcggccttaagttccctgcctccaggcccctgccgacccagcaacaactatccattccctgtagttttgcctttgggagcctgtcattaaaatggaaccacacagcatgtaccctttgaagactggtttcttccacttagtctagagctattgagattcgtcctggatgctgcatgggtctctagttcattccttgtgatgctgagtagtgccccattgtggggagggaccacagtgtgtttatccattcatcctgggaaggacattaggttggtttccaggttttggcaattatgaatagtgccgctacaaacatttgcgtacagcgttttttgtaaacataaggtttgatttctctagggtaaatatccatgattggggtttctgggtgtatggtcattgcaggattaactttttttttttttttttttttgagacggagtcttgctgttgttggctcaggctggagtgcaatggcgtgatctcagctcactgcaatgtccgcctcccgggttcaagtagttctcctgtctcagcctcccgagtagctgggactacaggtgacgccaccatgcccagctaatttttgtatttttagtagagacagggtttcaccatgttgcctacgctggtctcagactcctgacctcaggtgatccacctgccttgacctcccaaagtgctgggattataggcgtgatccaccgcgcccagcctctactttagtttcataatgggctttaatttgtgaattaacttcttgatgtatctgctcatccatccattcattcattcatttctatattcacccaacaaatagttaagtgccttacttctgtctttgctatttctttgcctttggagcactgttttgaaagagccagcgcccactgtcagctgtccagctggtagcactgtcatctggaagattttagatactttctcatgagtgattctacaccagcctgaatctcacactacctgacatcctctcaatcgtagccacacccaagggtcctactttgctgtccccactgccaccagaccaaacacacccccttccctgaaagtctgggagtcggtttcttcttcacaatagaagttggcctctgctggtcatgccccaaaccttctggagctgcgggttctgccttctctgcagctgccttcccgtgggctgccctggtcagtgcaggacatggcacaggacctccgccctgccacacccccgggccatttcctcggcaggcctcgtgccagacttctccaaaggactgaccgcgtgtgccttctccaccttgcacacactcgcacaccaacctgccagcctggcctgtgctcttcgccgcccaaacgcacctctccctggtgtggtcactgacagtctttgcgtggccagtggccaaacccaggctggctttgctagtggcctcatcttctctctgcagcgttcacagtgatccacttctttttttttttttttggagacagagtcttgctctgttgccctggctggagtgcagtggcaccaatgtccgctcactgcaacctccacctcccgggttcaaggcaattctcctgcctcagcctcctgagtagctgggattacagtcatacaccaccatgcctggctaatttttgtatatatatattttttaatagagacgggggtttcaccatgttagccaggctggtctcaaactcctgagctcaggtgatccacccgcctcggcctctcaaagtgctgggattacaggctttagccatcacacccagcccccctccctacccctttgtccctcctcagagccctgctggcccacttccctggccgttcaaaacattgcagctccaaggctgcttcccaggcctccccacctgctgtcttctccctggtgatattatggacagtggatctctggccctgagctcccttctgatttcatggtatggccacctccttgtccctatcgcttgagcgtgtcaccagcatcttcagcttgggaggtccagaactgagctcctgattttgccccctaaacttttacttcttctggtctcactcatccgtccacgtactgaaggcagaacccaggaacccaggaagtgtccttgttccctttgttcacatcctgtcggttctgcctagaccttaaatcatgaacctgacctaaggccactccagcttttgcctggaccacagcaaaaggccaggagtgagcccccgcttctactcctgacacctccggagccattcgccacccagagctgtgtaggctttaaaaagagccagccagccgcgtgggatcctggatgggatcctggaacataaatcaggtgaaaaattggtgaaactcaaatcaagttcatcgtctagttaatttcctgttcttgattatcaagctgtgcttgacgtcgtacaataagacattcacgttaggagaagtggagcgagggatatatgagaactccctgtaccgtatatgtaactttcctatatgattaacattagtttgaattaaaaagttttaaaaaattggatgggtgcagtggcttatgcctataatcccggcactttgggaggctgaggtggccggatcatgaggtcaggactttgagacgagcctgaccaacatggtgaaaccccgtctctactaaaaatacaaaaattagccaggcatggtggttggtgcctgtaatcccagctactcaggaggctgaggcaggagaatcactcgaacccaggaggcggaggttgcagtgagccgagattgtgtcattgcactccagcctgggcaacagagcaagactcagtctcaagagaaaaaaaaaaagttaaaaaattaaaatgcaaaataagaaagaatcgaactgtgtgctgtcttacttaaaacactgcagagctcttgtgtgtgcctagcatgtaagtcagatgcctcttgtcgttttgagacagagtctcctaccgtcccccaggctggagtgcagtggcgtaatctcggcccactgcagcctccacctcctgggttcaagcgatgctcgtgcctcagcctcccaagtagctgggatcacaggcatgtaccccgcctggctaatttttgtatttttagtagacacggggtttcatcatgctagccaggatggtctcgaactccttacctcaagtgatccgcctacctcggcctcccaaagtgctgggattacaggtgtgaatcactgcacctggccaggcagaaacctcttaatggctcccagggcctggcccacctccccagcctcctctcatgccacactttcttccctcagtctgcatcgggaacagttgccacctttcagccacgtgagcatgctgggaccgtcctttccatgctgatccctgcatccctcgtgccttccccagacctacaccaccgcaattgcctccatctcactgtgatatctccacttcagtctcatttcttcagaaaggacgtccctgactctgtccaaaccgcatgttgggtattctctattgcaggaagcttttgctttcttcctggctcttaatcacagctggtgactcgggtccttgcttgtggattctccctgccactggttcctaccactgagtcaggtgatggacgccatgttcacagttttatcaccagcgtctagcgtggcctgcagcgggtgctcccatagaacccataaacaaacaacttcttgtttcttattatgtgaagaaagttggtctgtgtaattcaccctccagagaaatgacagcactttcagtactttgttctgcccttccttgatctccacgctgtttgcagatggaccaccgttgtagagatgtgatttgattcttgacgtttctgagtgtccacggtgctgcgccttcccccaggtactacagtactgagattaataagacagagtcaatgtaaggtgttagtaggatttagaataggtctaatctcattcttaacggatttcaggagcttattatgtgttgaaagaatgaataggataaaagttgttaagaaattttctccgtttaatttttatttattaatttatattttagagacagggtcttactctgatacccaggctggagtgcaatggtgcagtcacagctcactgaggctttgaattcctgggttcaagcaatccttctgcttcagcctcccaaattgcggggattacaagcatgagccactggctctggcctattttctccttttaaaaaaaattgctgcaggtatacacatatgcacggatatacacatacaaatatgtaccttatacatatatgtatataataaatacatgcatatgcggaattgtggcatagtcttagtcttttttttttttttttttttttttgagacggagtctcgctctggtgcccaggctggagtgcagtggtgcaatctcggctcactgcaagctccgcttcccgggttcacgccattctcatgcctcagcctcctgaggaactgtgattacagcatgggccaccaggcctggctaatttttgtgtttttagtagagatggggtttcaccatgttggccaggctggtctcaaactcatgacctcaagtgatcctcccacctcggcctcccaaattgctgggattacaagcatgagccaccatgcctggttgtatttagtctttaacctgtcctcaggctgtttctctctgggcagggagaagcatggaaagggggatgggccctggtggccacctttgaagcatggaggctccggtgccaccctgcccttaggctgggcacaaaggtggctgagggaaggctagtcagctgctggaggtgtcctttatggtctcagtgattaaaggttatgttgtccatgaatttaattttatttcatgatggaaaagaggacattgcaaattaagtatgtcacagaaatgtaaggagccatggggtctgatagggctgagggtgagtggcttgccgtcgagtttccagaaggcgttattatggaccctaaaggggatttcatgcgtttcaaagactctaacagaagtgttctgatgaagtggagtctggtgctgggacctgccacttcagcctggaattgtcctcgtgtgaagcgcagtaaaaacccagaatggatgtcggcaataagggaatttctgggatatgatgggggaacgaatattgtcacctccatttgtgtcaggaagtctcagtatgcagatgagtcagctgcagggggtggcctcccaggctgctggtggagcccagaagcagggggcaggcgtttggcctctgatactctcctagctctgagttgggacggagctcgtgtatctacagtgtgctcacacagacttggtgccggtagatggtgaggggataggttggcaggtgggtagggggcctcccgaggcagtagggacctggaggaggctggtagaaagtggagattggccaaagtgacctgaattagattctacctggttcatgaatttgcctgaggctaaggcttcagcgcaagggatggtggagtaatacctttcctgaaacacctgctgccggcgtggccttgtctgtctctgccagatcttgttagcactgtggcttcaggcctagttaaacattcaagcccaatgcggttggagagcacccatggcacgcccattgtgcagcagtgtgtttaatacatgtgctgcttttaatgggtgtgaaagatcagagagcttgggtgtgtgttttaccaaccactttttaaactcacatagtaaaatttatagtatataaaaagcagaaaatatggtgtatcttctaaatattcacatttaaaacattttttagaaataatgtatgtcaagcaaggtcaagctaatgtgtttatataggctctaaattagagttgtgaaccagtatctcatcccacttatagggttttttttgaaaacgttcaaatgtttccagctcttttgtttctttattctaaaacattatctgctattttgttcgatagagtaactgtttctattccactttctttttttttttttgagacggagtctcgctctgtcgcccaggctggagtgcagtggcgcgatcttagctcactgcaagctccgcctcctgggttcacgccattctcctgcctcagcctcccaagcagctgggactacagacgtgtgccaccaagcccagctaattttttgtatattttttagtagagaggggttttcaccttgttggccaggctggtctcgaactcctggcctcaagtgatccacccgcctcagcctctcaaagtgctgggattacagacgtgagccaccacgcctggcttattccactttgtaattggctatccctgctattaatatacagggtactctccctctcgtatttgcgtctaaatgtcatctataataaataacagtgaatacttactggtttcatatttagttttacttttatcccacccattttcttttagtagttcttatgacttcacgtttatttaataaaggtaaaaaagaactttctgtttccaattcattcctttcaccaataaggaaggatgtggatcttcactgcttcctacatagctgccagcctcatgtagctgtttaaaatttaaattataattgaaatcattaaaaaattaattccttgttcatactagctacatttcgagtggtcagtagccacatgtgcctggaggccacagaactggacggctacaggatgtacccatcatcacgggaagttcatagaaagttctttttctttttctttttctttttttgagatggagtctgctgtgttgcccaggctggagtgcagtggcgcgatctcagctcactgcagccttcacccactgggttcaagtgattcttatgcctcagcctcccgagtagctgggattacaggctcccgccaccacgcccggttaatttttgtatttttagtggagacagggtttcaccatgttggccaggctggtctcaaactcttgacctcacgtgatccttccaccttggcctcccaaagtgctgggattataggcatgagctaccatgcctggcatgtatctcttcttctctaagtactcagctgtcttgtttgaggctagtacctccactagtctggaaccctccttcctgggctttctgcccacttccatctctcctttgacaacagtggtttttccagggtctgtgcagagctcagctttctgccataagacaggggagtttctgaagactcctcaccccttttgggagtgagggctgctgactgaagctccaggtcactgttttatgagctagctctccgtttgttgatggccggggacccagcctttgtcccctcctctcgtgcttgggcactcactactcactgcctcggttttgctttcagttttgattgtgcattgagtccacaacttcaatgggattttcttaaggcataaatgacagttgcatggtgtgcagtgggagaacaaatcgcccagcctgggacatccctgggtggcagagtggacctgctctcaacttatggaatgtgcagcaacaccttgaggttattaataaatacctgagtctgggcatggtggttcatgcctgtaattccagcactttggcaggctgaggccggaggatcacttcaggccaggagttcaagcccagcctgggcaacatagtgagattccatctttaaaaaaaaatttttttttaaaagaaggtgggcttggtggtgcacacctgtcatcccagctacttgggaagatgaggtgggaggatcacttgagcccaggacgtcgaggctgcagtgagccgtgatcatgccactgcactgcagcctgggtgacagagaaagaccttttctcttaaaaaaacaaaacaaaacaaaacacacacacacacacacaactgcgattcttccagaaaagttcagaaaaaggaagtccgaaatacatagtccatagtatttcagccaccagtgctgctgaagtgaaattagagatagcagagatatctcaggagaaaatggaggtttttgggtttctccgttagatgactcgaacaagtctgcatgtgctctgtaaacaagaaaacacagtctgggaaactgtcagcctctgccccagccagtgtgcaaaatactcttcaaaagagagaaaactagaaaacaagttgaaaaccgggtgatctgacaagtgtggaaattcacagcaagcatgtgcctgtgctgcagatacgatctgggagagagccagcagcctggatccacatttcccagaagcaacaggtggtgaaggcagcggcatgactgctcccgcggaaggttagtcacgcatgttcagcatcagccgggcgcggtggctcacgcctgtaattccagcactttgggaggccgaggcgggtggatcacttgaggtcaggagttcaagaccagcctggccaacatggtgaaaccccaactgtactaaaaacacaaaaattagccgggcatggtggcaggtgcctgtaatcccagctactcaggaggctgtggaagagaattgcttgaacccgggaggcagaggttgcagtgagccgagatcatgccactgcactcctgcctgggcaacagagcgagactccatctcaaaaaaaaaaaaaaaaagagaagaatattccgcaacttagagcttttcctttgcatgatatgatgtttacaggcgaggtggctccgcagcctcggtggcctttcttccagctgaagatgcccacaggaggtgtcagtgcaggtataaccacctgtgggtcagaagaaaatgcctttgcaagtaaatctcctcctggatgaaaaggcccatctgtgttccaggcaaggacagtggccgcttctgcgtttctgtggccaagcgtctggcgtgcgggtgtggctgggctcaccatgctgtgcgggctacacctgctgcaggagaagtgtgtttgtgctcgaagaagacaatgtgggtgtcggcccggcgtttttaggttggactacaatagtgagagctgcaaattggatgattcttggagctatttcatgaaggtcaaattttcttttgttttgttttatttaatctctcccagacttctgaacttttgctatgttgaatttttagttcttcaaggttatttggccttattcttgacttgcatgtttttctgccctagctctaccacattatctttttttttttttttttgagaaggagtttcactctgctgcccaggctggagtgcaatggtgcgatcttggctcactgcaacctctgcctcctgggttcaagtgatcctcctgcctcagcctcccaagtagctgggattacaggcgtgcatcaccacgcctggctaattttcgtattttcagtagagacagggttttaccatgttggtcaggctggtcttgaactcctgacctcaagcaaccccccgcctcggcctcccaaagtgctgggattacaggtgtgagccaccatgcctggcccacattatctatttctaagcctttaatatttttcatttacctgctactgctcactctaccttgtattctcagggagggtgtatttcttcccagctttattttatttcttctctaaatctcagaattattgcaccttgttgatgttcacattactgtatttagtttattttattgtattattaatattattattatatttgagacagggtctcaccctatcacctaggctggagcatagtgacacagtcatagctcactgcagccttcatttcctgggctcaagcagtcctcctgcctcagcctcccaagtagctgagatcacagaaatgcaccaccacacccagcttccttttctttttcaaaaaaacagctttattgacgtataattcacatatgatgcaattcaccctctcaagtgtatgatttggtggtttttagtatattcatggtgttgtgcaaccatcaccacaacctaattttacattttcgtcaccccaaaaagtaaccctgcatccgttagcagttacaccctctctctcctaaacccatggcagccactcatctgctttctgtgtctacagatctccctatgccagacatttcatataaaggggatcacctagttcgtggccttttgggactggcttctttaactaaacatcatacagctttatttccattttcagtgtattccctttttttgttttcaagtatttagtggctacctagtctcagattttaaatttagtttttcctttctcttctttctataatctatttttcatcatctacactgtgtgcttgaatcagcacctcttagaaacctacggatgagctgttagctctctagggacaagaacacggtctgggacccccgtccctgctgcaggtgtgacctgaccccctccctctgccgacgtgacctatccccctccctcccgtctgtggcatctggtgcatttggtgctgtcatttcacaaataaaaggtgatcagctggtggtctgtttcagttctggtatctttccccagctctcttgtttcatagcctcttcccattatttaaactctgctctgttacaggattcttaatagttattgcagaccttcatttccattttgttgtctgcaactcattgttgaagtgccatttgttgcttctgaacagcccatagacacttggacttgaatgcatatgactctcttcttgtgggtccagatcgtcactcactgactgtcctcacattcacagctgttctcaggacaagcaccgtctttccctttttcggatgtccctgtttacctgaatcaactcatttaatcctcacaacagccctgtgctatgatatgaccatcatatcacagcattttcgttttctttttcttttatttttttgagacagggtctcattctgtcacccaggctagagtgcagtggcgtgatctcggctatctgcaacctctgcctcccgggttcgagagattttcctgccttagcctcccgagtagctgggacttacaggcacctgccaccacagctggctaatttttgtagttttagtagagacagggttttgccatgttggccaagctggtcttgaactcccgacctcaagtgatctgcccacctcggcctctcaaagtcctgggattataggcgtgagtcaccgcgccggccagcatttccattatctagacaagggaactgaggtcaagcattggagtgaaagtcacctaggtggctttttttcttttttaacctatttatttctttcaacccttagcccagatcctaaccttcggtaagtactcagtaaacatttagtctgctgggtgcatgaacgagcgaatgagcaaatgaatgacagcgatagcacctggtgggctgttcgctggtgtgctgggtgtgctgggtgtgctgggtgtcgtctctcagagactcatttctacagtctttgtgaaggctcgtgctagtaaaccctaattcaagaggtttcttagaggtgggaggcgaaggtctctgaagtgtgtggactcctggactctccctatgttagcattctggaatgtagcatttagcagtggggcatttattaactcggaatacagaagataagaagccaagccaggcacggtcgctcacgcctgtaatcccagcactttgggaggctgaggtgggcggatcatgaggtcaggagatcgagaccatcctggctaacacggtgaaaccccatctctactaaaaatacaaaaaaaattagccaggcatagtggtgggtgcctgtagtcccagctgctcgggaggctgaggcaggagaatggcgtgaacccgggaggcagagcttgcagtgagctgagggagccactgtactccagcctgggccacacagcgagactctgtctcaaaaaaaaaaaaaaaaaaaaggccaaaacaggggaatgtggtcactcaggggatgcctgtcattcccatttggctgtgatggcagctgtttagccattactgggagagagagggaagctgggtatagaaggtacctgtttagaagcaggggtggggaagcgggagggagagagagagagaatgcgtgcacatgctctaaaattttattttctggctgggtgtggtggctcacgcctttaatcccagcactttgggagacagaggcaggcggatcatttgaggtcaggagttcgagaccagcctgtccagcatggcaaaaccccctctctgctaaaaacacaaaaattagccaggcatggtggcacacacctgtaattccagctactcaggaggctgaggcaggagtattccttgaacccgggaggcggaggttgcagtgagctgagatcgcgccactacgctccagcctgggcaacagagcaagactctgtctcaaaaaaaaacaaaaaaatttttttttggttaagcagaagatcaaattaaacaggcaaggtgcctaccctttgtttctttcactttcttccataaatccatctcatattttattatttgggacttctttttttttttttttcttttttgagacaaagtctcactctgtcacccaggctggagtgcaatggtgcgatctcggctgactgcaacctccgcctcctgggttcaagcaattctcctgcctcaacctcctgagtagctgggattacaggcatgtgccaccacgcccagttaatttttgtatttttagtagagacgggatttcgccatgttggccaggctggtctcaaactcctgagcacaactgatgctcccgtctcggcctccctaagtgctgggattacaggagtgagctaccgcgcctgacctgggacttcatttgttaagaagaggttaagtttcaccagcagccatttgtagtaggaacttgagatttatcatcaaatattgggacaacaagaacaaatcagttcttatgattatttatggtgcatatgagtaggaaggacttacaaccctccggagagcattttaatgttaacatatgaaagatattctctcttttgtaccaaaacttttgttcttcttacgcagaaagaatagataattataaaatatatctatgactccataggctttggctatttggtagattaagagtatttttatctttatttttcttattggctgattacagtttagtttaaataactctcatgccgcttggtcgtttccgacctagtcgtgaggaagaatgcaatgcaaagtgaaagacgtttttggaatgtttctgaaccagcccaagctgattgcctcttttctgtttattgttttaagtcataagtgacgtaagcttctaggcatttgttatgctatgtggctggctcccaaagtcatgtcttaaaacattctttccttcctgattattcttctctttcttgtttttcttttcttctttttcttttaatttttttttcttttttgagacggagtttcactcttgttgcccaggctgaagtgcaatggcacgatctcagctcactgcaacctccgcctctcaagtttaagcgattctcctgcctcagcctcccaagtagctgggatttacaggcgtgtgccgccacgcctggcttgtttttctttttctttttttttttgagacagggtctcactctcttgcccaggctggagtgcaacggcgcactcacagctcactgcagcctcaacctcccgggctcaagtgatcctcccatcttagcctcctgggtagctgggaccacaggtgccaccacacccagctgatttttaaattttttatagagatgggatctcgctatgttgtccaggctggtctcaaactcctgggctcaagtgatcctcctgccgcggcctccgagagtgccggggtcacagctgtgatccccgtgcctcgctgttgttctctttctgttgagttggcagtcaggtccttgattcttggtggctgagggtatctcagtccaaggcaagaatcccacagaaagagactgggacaaatgaggccagaaatgggcctcgcccatcactcttttccaaaatgggctttgtcagtcactcttcctatacttgggtcaccaaacctgatcaccactatgtgcaaagtgcagttttagttttcaaagaagtgacactatacttaagaatacttaagaacgttaactgcgttaacctccacgcacacagccatagacaaattcccccgtcagacaggagcccattaggaaatgcccacccctctctgtagcctttgtaaaattaagctgataaaagacatcgctgttgttgaggtttaaaatcaatggataaccaggaaagaatataagaaatcatattaattattctcctgtttacactacacttaaatcatttagctgtcttttttttttttttggaccttctgctgcaaaagagccattctaatgaacttggaccccagggtccatgtgtgtggttattcattaaatcatgtcgcctgcagagtctcctgacttaagactttcgctgggcttgaactcagtaacctgtcctgatgtatttctcaggcgtttgtgattaggcagctgggctctgccttacctgtcagggtgataacccttctggttctgacaaaaggtttcactttaaatttagctttccatattgaagcataaataaaaagataatttacttcccgattttgctcgttgtggacacggaggtgtgtttgaccttcgtaaagctagtaggatcatgttatcactatgggttggtcattcagcgcttcctaaagaaaaactcaagtcagaaacaaatcaggagcaattattgatttaacagttttgcaaatgcttttgtatgtagaaggtgcatgaaaaagattccagtgatacgcagatcaaacactgcgtcgataatcacagctaatgtcgagtgcttgctgcgtgcgtgttgatcatttaagcctcacatgcgagctgtgtggtaagccctcctcctgccctcgccttagagatgaggaaactgagaggcagcgatgaagcagctcactagccctgctcctgtcctccccttagagatgaggaaactgagaggcagcgatgaaacagctcactagccctgctcctgtcctccccttagagatgaggaaactgagaggcagcgatgaagcagctcactagctctgctcctgccctccccttagagatgaggaaactgagaggcagagatgaagcagctcacttagatcacgggattagggggcggacctggacccgactccgaggccccctccagcagccaggccctcgcccatcacgcttggttgcttgtaatgggagccttgcctctcgccagcagtttgtggggagtaggtttcccgtttccactgttatttcctgactcccgtgcctcccaacttcccacccgctgtggctggcatttccaccggctccctggcttgtcctacgcctcatgcctcctatgtggctcttctttctcctcccgcccccctgctgcccgtggccccagaatggaggcttcccaggatggcccacacagtgccctgcacaggtgctgtggctcagccctggccattccctccacacgttctctgctccagccacactgagctccaagccatcctttagctatgcctgctgcaggccacctctgtagagggcctttcatgacctgttctagtaacccccctgcctggtgtcagccacccccgcccctggcctggtttgctattgccgggctgacctcgccccgtctttcagttctccgtgtggagggtgctgatccgtccgtctccatctgcttgtgaagcaataacagaacagcataggctgggtaatctatacagcacggaaatttctgtcctcatgcttcaggaggctgggaagtccaagatcaaggcaccagcaggttcaggtgtctggggagggctgcatcttctggaagggagaaggaaactggagggcaagcgagagagccccttacagcaagcccctttatgcaggcgcctgatcccatcgcaggggaggagccctcctggcctcgtcacctcttaaagccctgcttccttaagactctcactccacaacgcctgaactttggaggggacacgttcgagccacagccccttccttcctgaggcttctcaagatgccccctcctgtgcttcctggagcacccgtccttccttgtcctgggacttggcacgcctgaccatagtcatacctgcttgtcctcttggcccctcttcaggtaatgggctccacacaggtcacgatctcggccaaaatagtcacacatcgtccctgcacccatcagtgtgtagtaaacaggaagtgcttaataaatgtttgatgaattaagagtgactcagtaatcccagtacaaaaaagcaacagcagacgttggagatgtgcttgaggcacgtgcccagcttgtgagcagaggccgccgctgccactccgtgctccccgtggactgccgtgctgagcgctgtgaatgtgctggctgtcccgtcgtgctccagctcttcaggcctccctgctcagcctctctcagcttcagttgccacgcacttctaggagaggccatcttgactttctcttgcagtcccggagccacacagggagcaggtgcgcagtcacctgggtgagggccccttcctgggtttcagaggcagcccagttcatgctcccagggcagcccttgtgcatggggagccgtagcctcaggcaggggcaccctgagccaacagcaccttgcagggccagccacagacataatggaaaacctcatccttcagccgcaacttttcctacctcccatcaaaaaaatgtccctcctctctcagtatgtggggactgcggtctccagagtggccatccacagtcacactggctgtcagtggctcctgtcaccaccctgccacctggtgacttgtgggccacactcaggagtcatgggaaggagacccttagagcagccccaggacaggcctccttgcgtgtacttctttgatgaaggcgggtataagccctggcagctcattgtcctctcttgagtccacataggttgcattttttaactctggcaaagtgaagttacaaagtcagtctggtgtcgcctgggacaggtccgagaaattagtataaagatggcttcactcctgcgtcgtattccagttcacgtttccatttcagtgtatacatgttacagtcgtgattgatcctgtgcataaattgggatgtgggtttttgttggagaaaaaaatgcacaaaagttcaggagctaagtaagagtgaaagattttcattggaccaggtgtggtggctcacacctgcaatcccagcactttgggaggccaagatgggcggatcacttgagtctaggagttcgagaccagcctggccaacacagtgagacccccatctcaaaaaagaaagaaagaaatagttggacatagtggcggacgtttgtagtcccagctactcaggaggctgaggctataggaggtgggggctgtagggagccatggttgcaccactgcgctccagcctgggcaacagagcaagaccctatctctaaaggaaaaacaaaacaaaacaaaacaaaacaaaacatgaagagtttcttggggccagttggcatctaaaaatatctaagtcttttgattctcagctatgacctggctacgttctaggctgtctttacgtgtttctaggactcttggcaaattctcagaacagttgacttaaaaagattagccacgtagtatttttacaaggagagagggaggtgaagtgatgagatggggccatacttataaaatgattcgggattattgatgaagtagtccctaggtttctgattaattaattttaaagcgctgaccaaatatgtacccagcgtaagaagccagagtcgatcagtgttgtagacacgtcgcctctcgatggcatctttccatgccacacccttcacgacctgaagctggagcttaaacccttcaagaagggtccctgcgaccgggtgcagtggctcacacctgtcatctttgggaggccaaggtgggcagatcactaggagttctaggccagtctggccgacatggagaaaccctgtctctactaaaaatacaaaaattagccaggcgtggtggtggacacctgcctgctcacaggctgagtcaggagaattgcttgaacccaggaggtggaggctgcagtgagctgagatcgcaccattgcactccatcctgggtgagagagtgagactccatctcaattaaaaaaaaaaaaaagaagggaccctgctttgttcatgattttattctcggtgtgtggcatacactaggcctgaaataaatgttatttaaatgttaaattacattgtccctccttccgatacatttgccatctggttaaattccagtgaagtcaaaggatggatttctttaaataaagtttgcttctttttcaaaaattccttgggctctttctagaaaagctgctcctttgccatcttcccagcagattcccggggcaggatccacccacctgttcacagctccttccagcgcagtgtgggtccggctgttagctcagcctcaaaggagaattgtaaagatacaggtcaagtgtccttttgaccaccttttttttttttttctatatgcgggattttgtgagacaataaaatgcatgtggacctcagcttaacaaaagctgaatgttcctggggtgagtgtttgaatccaacaggaaatagatgctcaacagctctgagtctggggaggttttaatggcctcttggtccctggtagggtcttgtttttcggggtagttttgcagcctctgacacaggtaagatggtcagtaccggaagctgccatgacgtctagactgaccgttaggaaggtactcactggactggtattcacagatggaaataaaccaaagcagtgtctagggtcaaccaatctgctttgctgccttcacggggaggtcctgggaccctttcatggaggaactttttaatgcttattttaaccctgaaggtaaaacatgaaacatgcagccattactccaagaaaacgtaacgtgggtgagtggtgtgtctcgggggcccacggtctccctgaggccgcatctctctggagagatcgtggacgtccgtcgtaaactatgacctattcacattttcactttactctcaactttccaggagtgagtcctctccagagagcaagacggagctgcgtttcaacagacggtgctttcaatctgtgctgactgtaacttttatccatcataggtttgaagacatacctgatatcgggtcagagagccaaggagtctcgctgcagctgtgcagaggccttgctttctggctttgaggtcattgacggctcacaggtgtcctcaggccctaggggacaggggacagcgtcatcagggaatgtcagtgacttggcgcagactgtcaaaacctttgataaccttaaggttagtttttttgttttttttttcctacttctaaaactttctattaattctgcagtagagcacgtgaaataataagcagcctccaggtctgaggcaaacaacttggaatgaccttcgatttggttttcacgattttaatatttagtctaaagttagtagcattctgcatttttaacatccttgctttttgacatatgacgcacctccattgcctttccattgcacaaggatgcttctcatttgaattattagttattttctcttcctgggacctgtggtgccttttgggatttctagaagctggtgataaatgacagtaaaggtggctttccttggcaccttgggtggagagctagttgataatctgatttcagagaccactttctcaaatacttctacgtctcttgaaatccactattttatgattacttgaaatgatgttggtgtgggtgaatcctaggacacagctcactgagaggacaggctgccgagaacattgtagtatttcattattggaaccgggatctcctggtagctgcctagaagtgcccgtttctggactgacctgtcatcataaactaccagggaattggcgcggtcgaccttgggtgtgtgaaatcatttcagtttatgagctgttcctttgctttcacatttgatttagtttccccactggtaccttctgtttatttttatagtttaaacatctactgtctccattcttaaaatgagacagagaatcaaaacagctctcctatgctgctttgtgttctcagataacacagtggggtatgtgtgaggatggcggccagtggttacagcttcacccaatacgtccctgcctctccacattcattcacaggtttgaaagccgctattggtatttacgaggaacagtcttcattatgtggcagtcagctggggtatgcagattacttactgggtcagaatacatagtgcctgtcgcccagttacacgtaatgattgcactcgggttctgtcaactccgctcgtggatcgcggtcgttgggtgctttgttagtgtaatgcagggcttctcaccttggcaccgctggcattttggaccaggtagtcatgtgttgtggggctgtcctgtgcactgtcagatggctggcagcatccctagccgccacctgccagatggcagcatacccacccgtaccctactccccagctgtgccaaccaaaaatgtctccagacatggcccagtgtcccctgggggtgcagagtcacccctgggtgaaaaccaccgggacagtggtgttggaccctctcttccctgtactcttggcacatgtgtaaagctcatgtatctgagattccctggatgcctgcaaactttagagacagccgccttgcctgggctgacgttgtgcaggagtcagaaaatggagctctgggctcctagacagcggacccgggcagggaggggctggcgtggggtggaatcgggaatggttttgctatttggggaagaattgtttcctccagcctgcaaactgagctgtatttaagtcgtgaaagacagccccgagccaaaaatatataattcgttgtgtttgccattttagcttccacatatgtgtgtttctgtccgttaggggatgcggtcgcagagttcaccatatcacatgctcacgggtttagtgaccacggttttagcaatggcgattctacactacattgcactctagtcatatatatttgttttggtcggaatgagcaaaaaccatttagcgtatcttcttggcatgtggagattttccaaatattgttgaaagtttctgagaatcttgtgatctatcaagttgacagaaggccgggcatggtggctcacgcctgtaatcctggtgctgtgggcggccgaggtgggagggatgcctgaggctaggatttccagaccagcctggtcatcgtagcaagacatcatctctacaaaaaaattttaaaaattaactgggcttggtggcctgtgcctgcggtcccagctacttgggaggctgagccaagaggatcacttgagcccaggaatttaggctgcatgagctatgattttgccactgcactccagcttaggccacagagtgagaccttgtcctgtctccaaaaaaagggaggagggtgctcagtggtaaagtaaattcgggaagcttgggatattcaacacagaaagggtttctttactgcaggacttctcggagccttcactaggctagtagacagtagctaggccttcagaggaggacgcggtatatacagcattctcaggcctctttgagcacaattgttttttttcaagctgcaccttgcagggctaatgtggtcacaccttttgggggaatgctcatgtagtaaaaggagtttcatgccaaggaccaatacattagagaaaaggtgttcaggaaacgttccctgaaggagcatgcgtagattttcacgtgtgtcctgttcctgctgctgctcacttgagatactcatggcttctctttcccctgaactcctgtctgcattcaccgttcagctccaccacgccttcccgtgcctccgcagctgataacgctgttccctcgtctccaaattctcagtcccttcagtctgtcccacttggctgtaacatacacgatcttaaatctttgtttcttatgcgtcttcctgggagctctttgcattcagagactgagtgttaaataacttaaatatttcccaagtgtcgagcatggtgcctggcatgtagtaattaacagtttctttttggctttttaattctttaattaaacacatggagcgatgcagctctgcagagccaggcgaaggactgaagtcagaagcccgagcagaactgtgtagaaccagggcagcgcccacgaagggtttatttcctgcccttagcatgtgtgtcctctgtgaccttaagtcatctcctaggtcatagctggaaaattcttatctaatgtaacataacctgtgtactgtaacgacctaccaggaaatgatagtgatgtcaaaggccagggctttggtcctgaagtcatagctcaaagggaaccctttctacacccaagtgttggcttcttttttttttttttttttttttaaagagatgggatctcgctctgttgcccaggctagagtaccagtggtatgatcttagctcactgcagctcgaaactctcaggctcaagtgatcctcccaagtcaacctgctgagtagctaggaccacaggcatgtgccactatgcctagctaatttttaaatttttttttttttgctatattgcccaggatggttgccaactcctggggttataccatcctcctgccttggcctcttaaaatgctgggattacagtcatgagccactgtgcctggccttgggttcttgaaatgaccagcagtgagaggtcctcatcctaagggccctgacattgcataatgtgggggacagatactgcccgagtgaaggaaggagaggtcaagaaggaaaccaaggagtaagcattagacatgaggacgccactgtcagcgtcgcggaggggaggcggaccacggcgggcaggggcgcaacttgaagcaagacccttctcaagccttggctttgcgactgtgaagaaactgcagccaggtgcagtggctcatgcctgtagtcctagccactcagacagctgaggcaggaagatcgcttgagcccaggagttagaggctgcagtgagctgtgatgatgccactgcactccaaccagggtgacagaatgagacactgtctcaaaaaaaaaaaaaaaaaaagaaaagaaagagcaaacacacacttaattcctctaagtgagagttttcctcttcagtgcggtggtgataaggaagagacctctcgggattgctgggagatgagccggaatggtgcctgtggacgccagggctgagaagaagcctcgctcacactcggcacgcacgccttcactccacgcagagcagggacagtgaccacagacggagccatggaggactgggaggggccgagagacggtcccagcttgcctgcaggaagtcactgactctctggggaaggtcccatcttctccacggttccgattcgagggagattctcacagtgattgcggctgagcattgctgtgggttggatgctctcggccgtaaccaagtcacttgtatgacacgggagcatgtgtgccttggcctgttgaatgtgacgtcagcgctccagcaggcatttgctttccattttctcatgaaccctgtgggtgatgagtggatctagatgccatatatcaataaaaacagcttttccaacatcttcatgaagaaaaagaaaacccaactgggctcagtggctcatgcctgtaatcccaacactttgggaggccgaggcagagagatcacctgcggtcaggagttcaaggccagcctggccaacatggtgaaaccccatctctactaaaaatacaaaaattagccaggtgtggtggcatatgcctgtagtcctaagccactcaggaggctgaggcaggaggatcccttgaacctagtaggtgaaggttgcagtgagctgagaccacgccactgcacttcagactgggcaatagagtgagactccatctcgaaaagaaaagaaaacccaaaattgaattacttgtatcacattacttctgatcagggaaccatttgagctgtgaaagcatcttagtacatctctgaaaggcctccctggagcgcacctgcgtggctggtcttcctgagtttaccttcatctattattcagaaccccgggctgcttggccactgggtgtttctacatggaccagtcagtaatgaagctagtgatgtagatttacccatacggggatgattcagagaggacctgtcctgctttcaaaaggtttctccttcccctttaaggccactcacctcaggaaccatccttttgtgacagtgaattttgaaaatgaccctaaatgataacttcttttatctacttgttttctatgtgtcaagtcattatgagtaggctcagttggcccaatttgaggaagtaaggggcttttcattcgttatagaaattgaaaaaatgatttcatattttatagacacatacatatataaatatatatagcttagaaattaaataggtatttattataagtggtagtctgaattgatagtggtgatgcttgcacatccctgtgaatatgctataaaccctggagttatatactttaaatgggtgcattatatgctttgcaaatgacatcttaagaaagctgttgtaaaactaaagggtagtctccgccaggtgaggtggtcacacctgtaattccagcactttgggaggccaaggcagatggatcacctgaggtcaagagttcgagaccagcctggccaacatggtgaaaccccatgtctactaaaaatttaaaaattagccgggtgtggtggctggtgcctgtagtcccagctacttgggagactgaggcaggagaatctcttgaacctggaggcggaggttgcagtgagctgagatcatgtcactgccctctagcctgggcaacagagtgagattccatctcaaaaaaaaaaaacaataaaaaaaaaaaaccatctctacaaaaactataaaagttagccaggcatgttggtatccacctgtaatcccagctacctgggaggctgaggtgggaggatcgcttgagtctgggaggcagaggctgcagtgagccaagattgcaccattgcactctagcctgggcactagaatgagaccccatctcaaaaaagaaaggtggggggcggggtaggaataggaacttcacagtggacaaaccgggcagatgccaccttcaccaaatgatccaggtgagcctccctgctcactgccatccggtaccctagtgtggtgtgctgagaagggcatgtcacctctgcggcattctttccgcaaaccccaaacctcagtctgctctgagaaagcaccaggcaggtccagatctggacatttgacaaaatgcctggccgggacttcaaacgcagcagggccagaagagacagagaaagacagaggaacccccataggctgggggtgagcagggggcatgagggctaaatgcaacacgggacctagaggagacccgaacagcaaagggacggtgcggaaactggggacatcagaataaagccagcagcttagttaacggtatcgcgccagcatgagttgctttggttttgataactgtacggtgagtatgtacggaggatatatgcagagtccttgaactgtctttcccactctctgcaagtctaaaattatttcaaagtaagaaattatatatgtgtgtgtgtgtgtgtgtgtgtgtgtgtgtgtgtgtgtgtagagagagggatggaaatgtatgtgcggaatcattgaactggcattgccagagagtgaaatattgcatttccatgaaatttccccagatgccaaatattttcttatcttgacttcatgatggactgtttccacagctggtaacagtcttcctgcctgacagtctgctgagtatattttcatctattcttgactcggatcgccatcaccagcctggttattgagcccagtggtcctttagggctaagggattgagtgagaggtccagggacttttcgactccgccccgtgtggctctgagattgtgtgtgtgagttttacacgtgtgtgttcatgtggtgacttgtctagtattctcaggccatctgctgtctgttcttactgctttggggatgtaagaaaatttctttttctgtgataattactgcttatcttttcttctaatattctgcttctatttttctctaatgttgcattagcagaaatactctattttgtacttatgcccgtacctaacctgttagcttaaacagcaatgccagggacatagagttagccccatggctctgccgcactgacaggctgccccgttcacctggagatcgttggggccaggagctctgctgcctgggctcaccgcctctttacgcggttccgaccgtaccgtgtggctctgggccagtgcttgctctgtctcagtgtcctcatctgtaaaatggaaccgatcatagtacctgcatcgtggttgcttacgagggttaagcagatacaaggagtttcaaagaacacctcaggaaattgtgtttgtggttattgtggttgcaatatcatgactattcctgctcaccatgttaacatcattttgagtttgggagcaaaggatgcttctgataacacgacatcttgcaaaacagtcgtgttgagaagacgaagcaggcaaagccagggctcttctactggtgtatcctcctcatttctgagaaaagaggtttccccactccctcccttgacagttttgaaaagggacagctgttggcttagaaatgatttatcttgtgatgagaaataaccttgaagaaaaaacgattttatagctttgtgccatatattttgaccggaatgtagggtgcacgtcctgaaatgtgttaaaaacaaatgcaaatgtgcccaagtgtgttagagaaatggctacactcttccctccaaagcccacgtccacatgggggaaggagcaaagataatccggaaaaatgcagagtttgctcttgggcgttctccagggaatctcaggttacccaggcaacagccagcaaactccctggcccgccaggcgtgctgctgggaggaccttagaagtcttgagacttcccttgatgccggagggcccagggtgctgcttggaagaaccaggaggacaggcatagctgctcaggtcactctagggaaacaaggcccaggagagcaaggtgccaggattattcctgggtcctccttgtgccaggaaagggggccagagccatatgacggtggtccgggtcccagggccctggagtctgtggccgtctgcggaatgatcattgctgcctcacagtgtggctgcaaaggacgagatcatacagtcgagactgcagatattgcgtggatgggggcccgacttgttcacgggtaggatcttggcccatagacattcctaagtcatagtagctactgtcattatgacactgctttttctctaatgtgcctgcccgtgtggctccctgtgagccagctgctagggttgtctcccaaggcagtgaggtgcttccatgcctgcagcttcctggagtcagaaatactcttcccagggagggcttctcagcaggggtggagatgcctgcagctgtgcagggggagacgctgtttagccggctgggaaacatttcacagaggcatctgtacttggcaaaaaacatgttgtgaaatgtcttaatccagattaaaattaagctaatgaatcgctcaaggaaaattgccatgggggttggggggtaggaggtcaggggagggaaacaaacccacccaccattgcatggtgggaccctcctggtacagaaggggcctctaactacagctcagaaggggatgttgagatgtgagaatctctccattgggtagatggatttctctttttttcttttcttttcttttcttttcttttcttttcttttcttttcttttctttctttctttcttttctttttttttttttttttttttttttttgagacagagttttgctcttttgcccgggctggagtgcagtggcaccatctcggctcactggaacctccacctcccgggttcaagagattcccctgcctcagcctccctagtagctgaaactacaggtgtgcaccaccacgccaggctaattttttgtattttagtagagacgggctttcaccatcttggccaggatggtctcaatctcctgaccttgtgatccacccatgttggcctcccaaagtgctgggattacaggcatgagccactgcgcctggcttcttttttcttttttaaagagacaaggtcttgctctatgacccagtctgcagtacagtggcatgaccatagctcatggcagcctctccctcctgggctcaagcgaccctcccacttcagcctcctgagtagctgggactacaagcacacaccactgtgcccagctaatttctaaaatttttaaaaagcttttgtagagatggggtcttgatacattgcccaggttgatctcaaactcctgggctcaagcaagccaccacacccagctctaagatttcttttgtttcatttgtttgaaagtttttatctagaaaattatccctcaaaaggaaggtagctgaggaatcttgctctgtcgcccaggctggagtgcagtggcacaatctgggctcactgcaacctccgcctcccgggtccaagcgactctcctgcctcagtctccccagtagctgggattacaggtgtgtgccaccacacccagctaatttttgtatttttaatagagacagggttttgccatgttgaccaggctggtcttaaactcctgacctcaggtgatccacccgcctcagcctcccaaagggctgggattacagggatgagccactgcgcccagccaaaatccgcattttcaaagtgcagtaaaatgatggctgctgggtccgggtgacacaggtctgtgggaccatgccacccagcgcggcctggagtctgcacctggctctccccccacctcccatactcccacttcccggacaaacctgctgggaatggaataggcagtgagcactgtcccggccctcaggaggcccgagcgtgggtgtctacagctggccatgtgacccagacagcccccttccttctgcaagcgcagcctcatttgccatttgtgggcggctctgccagacctcacttctgtatcagaacttcttatcactgcagggtgcaggcctcggcctctgttcaaggggatgtaagcaaagcactgagttccccacctgtggagaccactgccccaggcccccagagctcagcctcatcccagtgggcatgcccgggctgcaccggccttccagcccctctgagggaagcccttgtggagggcatggagccccctgtcctcagtgtgccctctggtgccaagttggtttgactgtcacggtgacacattcatggctctaaatgcttagaaaatctcataaagccagtgtgccgtggggggcactgaagaagcaggcggcctcgtcttaaagcacaggagggttggccgggcacggtggctcacgcctgtaatcccagcactttgggagggcaaggcaggcagatcacttgaggccaggagttcgagaccagcctgaccaacgtggtgaaaccccatctctactgaaaatacaaaaataagccaggcgtggtggtgggcgcctgtaatcccagctactcaggaggttgaggcagcagaattgcttgaacccaggaggtggaggttgcagtgagccaagatctccccactgcactccagcctgggtgacagagcgagactcagtcccaaaaaaacaaacaaacaaaaaaagagagaaaagcacagcagatgaacttgaggcaagaaaaatacctgaaacagactgacgccaggagattcctgtgactaaatggctacagaagaatagataccaagggctgttctgtctgtaatcaaggacattgaattaccagatgaactttaatgaccagagagcatagttaacagaagttttcatattcactaccagcatttactgagcacgcacttgcacttcgggctttggctgagccaagtgcagcagacgcttccacacctccagcttcctttcctggtctaccggttgggccctgaaatggctggtgtgccccatcaagcaccaagccccccaccttagccacaccagagagttccctcaggcatcttttaggcatgggtatcaggcacacctattttattcttctcttggtgttagatttttttacatttaataagagcagtggtctcattggcaaatatatacatatttatacatatatatatgtattttgagaatgggtttgctctgtcacccacgctggagtgcagtggcacaatcacagtgcactgcagccttgacttccttcgctgaagcaatcctcctgcctcagcctcccgagtggctgggaccacaggcacgtgccatcaaggtcagctaattggttttatttttagtagagacaaggtctccctatgttgcccaggctggtcttgaactcctggccctaagcagtcctcctgcttcggcctcccaaagttctgggattacaggtgtgagccagcacaccagcaaaatgtttagaagtttaactctgccagtcaataccaagaggtgctttcaaatagactcactgtatgttattgataactagaacattttacctctgttgataatgtcagtttttaaagagctgtaagcaaatgttatctagatgccattatttgctcagatatgttaattaatgatttcgctagctgttttggcatgtatattttcattttttgaatgcatacaaatgttcaaatttagcttgtatgttacatcagattcccaaactatacaaccctgtagaatctttgtttcttttatttaatatagtacaggtctgcagtctaactttaaatacaacctgggtcatatctttgcccttaggtagtgacacttactttaaatttccaaaataatatctggcctcccataatttatttcaatgttttacacttcttgctgcaaggaaattgcttttgagtccaaaaaaaaaaaaaaatatatttcttgccacggtttgtcttcttcattggaagctgttagttgctttcttagatggttcctaggttacctggtcacattaataataataataagtttattacgggtatactgtatgccaggaactgtgctaggctatatatatacttatttcatttaattattatttttttaagacagggtctttctcttttgccccaggctggagtgcagtggcaccatcaaagctcactgcggccttgacctcccagactcaagcagccctcccacctcagccccacaagtagctgggactacaggcacatgccaccaggccaggctaatttttatgctttttgttgaggcagggttttgccatgttgcccaggctggcctcaaattcctggactcaagccatcctcccaccccagcttcccaaagtgctgggattacagccgccacacccagccaatttcatttaattcttagcaacatatcttcactctttgtttatagatgagggaactgaggtaaagtgatttgaacagagtctccaaactagtaagtacttgactagggtttgaatcctagtttatgagaaataaaggctttgctctttttagggtacctgtattaaatcttgccttctcttttctaggtccattaattcctataaacttttaagtacgcctagatctggaaatcgtgtacctttgattattcagcccatcttatgagactagctcaccatcacacggagcttaagaaccttggatttgtgtcctcgcatagttggtggccagtttctttacttaataacagctttgttgagatataattcacatactataaaatcgatctttttggccaggcacagtggctcatgcttgtaatcccagcactttgggaggccaagacgggtggatcacctgaggtcaggagttcaagaccagcctggccaacatggcgaaaccccgtttctactaaaaacacaaaacaagtagccgggcgtggtggcaggcacctgtaatcgcagctactcaggaggctgaggcaggagaatcgcttgaacccaggaggtggacgttgcagtgagccaagatcgtgacactgtactccagcctgggtgacaagagtgaaactccatctcaaaaaatatttaaaaatcgatctttttaaagtgtacagttcagtggtttttagtatatttagcaaggttgtgcaaccatcaccgtgatcaatttcagaacatttttatcatcccaaagagaaaccctgttgaaataccacaaaccaggtggcttttaaacaacagaaatgtatttctcagggttctggaggctgggaagtccgagatcaaggtcccggaagattcagtgtccagtgaggacccgttcctgcttcacagatggtgccttctcccagggcgaagggacgagggattcctctggggcctcttttatgagggcactaatcctattttgaaggcttgtcccccatgacctaattacctcccaaggctttgccccccaatgccatccccttgggaattaggatttcagcgtctgacttttgagggggcacaaacattcgaatcgtagcaaaccccacgccccttagcagccactcccccttcctgcccccggtcccgcctggcagccaggaatctgccttctccctccaaggattcaccttttctgaatatttcacatagacgggatcacgtaatatctgtgctgtgtctggcttccctccccgagcataatgttttcgaggttcaccatgctgtggcaggcgtcagtgcttccgtctttttcgtggctgagtaatatcccattgttcgaatagaccacagtttgttgatccattgttcagtcagtgaacattcccggttccatttttgggtcctgttgcgttcgtgcccgggtttctgtgtgtttccactgtcactttgcccgttggctttcagctcatccccgagcggttctgtgtgccttccccttgctcaccaccatgctgcgtgacggcagatggcaacagcggacctgcctgaattcagggtggcagtcgcggtttctgggtgtgtccccacagtctgtgtttttcttctagacctgcccttcgtgcggaatcacatttgctcccaaatctgaagccggcgccgagggaggagcacctcaaaacggctgccaagacgagcataaaaacagcaccaaggtaacaagctcatggctgttgttcctgtcagttcctctcctggcgcatccacccaaggtgacattcctgtcttgtcgacttcttagttctgagagtaactcctcttgggtaacagcactccgcacccgcgggtcctccgggtgttgaagagaccggcagggagctcgagggagggtcagcagcaacccacgtggaaaccagcgctcaggggctgagctgggcgggattcctttaaaggccaataagggtttaaaatgcgtggattcgagtgccgggaggggatttgtggtactggaagctggactcagtttatgagagaatatagacgggcagagacaagagggggtcttcacggcgagaaaggctgggtgaagagagaggttgggagttagggccggtggcaggaaggctttcaggaaaaccagacttggacaccagggccaggactcagcccacccgcgagagcctgtcggcgggggctcatgcaggcgactcacctggggcgcgggctctcgtcctccatctgctctccatctgccaaaggattgcaggtgcaggtcatcccatgccttcccacagccacgggggacacccacgacacgagcccgtttccatccaccttgcctgtgccctgacagccctggacccctcgtcatacttctcctggacccccgacccatgcaccctgctcccagaaccgtggttctggcctaagcagactctgggggcctcggctcctcactttcctcccttcccctccacctccgcaccgactcttcccatgtctcaatgtcctggcagcctgaacacccagcgttaccactgggcactgttgggtaacaggaaggagcagacgggcagtcagggctgggattggagcaggtctgtaggcgcaggggggtgggggttcctcgcaggtcagaaagtcccacgcccagtgcagcagcgccccgcagcggaggtcggggtgggacaggcgtgtgtgcccagtgcccggtgccacttcacttcccgtgtctgcgtcctctttgtctcgaggcaggcttctggaggacctaatcccaaaactcagaacgggctcctcagccctccccaagaggagaagctcaccaacagtcagacttctctgtgtgagatcttgcaggagaagggaaggtgggcaggggtgagcctggaccagtcggctctccttccgctgaggttcaagaacatccgggagaaaacggacgcccactttgtggacgttatcaaagaagacaggtacgactggggctgtctgggaaaaagcaaaggttgcaggcagaagcctctctgcctttttcttttcttttctttaagactgagtctcgctctgtcatccaggctgcagtgcagtggcgcgatcttggctcactgcagcctctatctcccaggttcaaacgatgctcctgcctcagcctcccaagtagctggggttactggcacccaccaccatgcctggctaggttttgtatttttagtagagatggagtttcatcatgttggccaggctggtctccatactcctgacctcgggtgatccacctaccccaccctcccagagtgctgggattataggcgtgagccaccacgcctggctttttttttttttttttttttttttataaggactaggtcttgctgtgttgcccaggctggagtgcagtggctcaatctcggctcactgcaacctccacctcccaggttcaagtaattctcctgcctaggtctctcaagtagctgggactacaggcatacacaaccatgcccagctaatttttgtgtttttagtagagatgggtttttaacatgttggccaggcgggtctcgaactcttggcctcaggtgatctgcccgcctcggcctcctaaagtgctgggattacaggtgtgagcctgtgcctggcctaatggtaacatttttgaaaaatacaggtccagtccttttatcaaatattcctgaagttggattggttagattcaggctctccctctggccaggcagagactgcagaagggatgccgtgtcctcctcagggtgtcctctccagggacacgcagtgcccgtctgttcctcattagtgatactaattttgattaattaggcaaggtggtgccgggttgtctcatctagggttattatattcctcttatgactaataagcaatctgtgagaaaatacttgaagatcttgtacatatttcattccccatcagaattccctagatttaacattcattgatgattcttgcctctgtcttcactataatgcctcaaagggtgattttcagccaggcgctgtggctcacgcctataatcccaacactttgggaggccgaggcaggtagatcacctgaagtcaggggttcaagaccagcctggccaacaaggtgaaaccccgtctctactaaaagtacaaaaattagctgggcgtggtggcgggtgcctgtcatcccagctactcaggaggctgaggtaggagaatcgcttgaacccaggaggcagaggctgcaatgagctgagatcgcagcactgcaactccagcctgggcaacagagcgagtctccatctcaaaaaacaaataagaaataaatggagcagcacagctaatagcagtgtcgcttctgccacttgactgctaaaatgtggccttgtgcacatcctctctgcagctgcgtggttgctcttccctcagtccacactccctgagtcaggggaggagagagggtcagtgtcctgggacagaattatttctcttctgagtctgagaatgttggaagttactggatacctgtcacagaaaggagagtgtccgccgtgctgcaaggacaggaaggaacacacgtgatgagccgtactttgtgtggggggcacatgaggcacttgacatatttcacctgatttactctttttttttttttttgagacatagtcttgctgtgtcacccaggctgtaatgcagtggcgccatcttggctcattgcaacctccatctcccaggttcaagtgattctcctgccttagccacccgagtagctgggattacaggcacctgccaccaggcctggctaatttttgtattttttgtagaaacgggggttcaccatgttggccaggctggtcccgagctcctgacctcaggtgatccgcttgcctcggcctcccaaaggtctggggattacaaggatgagccaccgcgcccagcctcgtctaatttacttctgatagtcactgtatgagggagagaggctaacacagctatatttgctttctgaaatcatgttaacgttcccttagtttctagtaattttctgcagtatagaaaggatattactatttgctggcaattcataaatgaatgaaagagtcatggaaagcggggttgatttccctgctattaaaatcactgagctttatcattctgcaggtttcacatgcaatctgcatatgtgacaatagcaccaaaattacgctaactataaacacaattttgtgataacaacctgttagcttttacggtggcaattactgtcagtgctctgaatgacaggaccgccggttctgaattatgttttcgtttgaagcctccaaatccatgtaagtactctcagcacagtgatctgcgtgttcttcacaaaagattgtttcaaagaacagaaaagctgccttcatcttctcctaatcctagacattaggaatgtgttttcaaaaacaagcctcagcagctcacgctgtcatcccagcactttgggaggccgagatgggtggatctcttgagcccaggagttcgagaccagcctgaccaacatggtgaaaccccgcgtctgctaaaaaatacaaaaattagctgggtgcggtggcaggcgcctgtaatcccagctactcaggaggctgaggcaggagaattgcttgaacctgggaggcggagattgcagtgagccaagatcgctgcgccattgcactccagcctgggcgacagagtgagaccttgcctcaaaaaaaaaaaaccccaaaaaaccaaggttctgatgatgtgtgctataatcatggtggatggtcattctttaacgaaggtgaaacacaaaatatgattatgctttgaggtgcgaaggactttccacagatctgttttaacaaggggcagctgagtggcgtctgttccacaggcgcttttagacgcagctgttgtaatatacctaatgagcagcgttttggtagctaattatgatctgaaaacattggcacagttatggtgctgggtattgatcgactgcatttgttgtgtcttctagcctgatgaaagattacttttttaagccgcccattaatcagttcagcctgaacttcctggatcaggagctggagcgatcctacaggaccagctatcaggaagaggtgcgttcatttctccttgcgcttttactaaagaatgtgtttgttgttctcacatggtcattcactgttagttttgtgctttaccaagggatgggaacacgaaggcgaacattgatttcccacactctgtaaaccctaagtggcaactgtacatgaaatgtctctttgcaaaggaggaaaaaaaccctttctttagtcctttgtcttaaagcgcagcctcgccattactagcccctttcctctgccgtggcatctccaggctatccccagccttggaaggggcccccccaccacaacctgtcctgaaaggaaacccccaacctgccctggaaggaaacccccccacctgccttggaaggggcccccacacctgccctggtaaaggaaccccccccacctgccatggaaggggtcccccacctgccctggaaaggaacccctccccacctgccctggaaaggaaccccgacacctgccctggaagggaaccccccacacctgccctggaagggaatcccccacacctgccctggaagggaaccccccacctgccctggaagggaactccccaccgacctgccctggaagagcccccgtcccacctgtcctggagtcttgggtgagactcttctctgttgccctccctgctttcttcccctgagaagggcccaggaggccttcacctctctctctaactccggctccatgttccctctcccgcccccaccgccttaaccccttgtacttgacttctcagcccatcacccaatcccacttcctccaagaagctctccccgactgcagactggattgtacttcccttcatacacttccttctccgtgtgtgccccattttggaatctttccgtgtgtggttctggattcgtgttcctccctccctagatgctcagctctgtgaggtaggacccccgtctctctcctccagcccctccttacagcctccagcacagtcccaacacccatctctctcctccagcccctcctcacagcctccagcagagtcccagcgctcacaagtgctccttagggggttgctggaaggaataatacaagaacctagagcctggtttgaatcctggcggcttccagactgcattctctcctctgggcccaaacctaacctctgagtgttcccaagtcaagagtggatgccctccccacccggaacaaaagggatttctcactctgattcccttggttcctccagcaggtcttcattaaactccgtggtgtcctggcttgggctctagagagaccctggtgagcccagtagagccagttcatgcctcgtggggtgggaggtgcccccttccgtcagcctccaagggacagtgaatatccgttaatgtcccagacatggctcccggagtggacttgcaagttggcagttggctggttggtggcccgtaaggcaaaatatcgtctcatttaatgctcatagcaatgctgtagggaagctgatgattatcctccttttaccaaagagctgacgctgagcaaggctgaacaggtggctgtggtcccatagccggggtcggacacgagtggtctggctgccaaaccaggcgtccgggccgcttctcgccctgcactgctgagcctcccaaacagcagacacctttgccatgccttcctccaggcaccaaatgtacgctcagcctctgctctgccagggactgttcttggtgctggggaagggggaaagacgtggcctgatggggagcaggaattagaaacaacatccggagctggaggtctgcgagtgccctcccagcacacggcgaggcaccaagcccaggctgggggctccaaggggggaactcctgagcctgcctcagtggggggactaggaattaatggaatgtgggatgagggaacattctggagagtggggccagcacccacaaacgttagagataccaaagagcctggttcgtccagggagttgcaggcgcatccggggcagggtggggcaggagtggcaggacgtggcaggggccaggtcacggctcccatgccatggactttatgccacaggccatggggagctgttgaaggatctggaacaggttgtgttacaaagatcacacagctcacacctgtaatcccaattactcaggaagctgaggcaggaggatcacttgaggccagtagatagaccagcctgggcaacatagtgagaccctgtctcttccaacaaaaagaagaaaaacatggccgggcgcggtggctcatgcctgtaatcccagcactttgggaggctgaggcgggcagatcacctgaggtcaggagttcgagaccagcctggccaacatagtgaaaccccgtctctactaaaaatacaaaacttagccaggtatggtggcgggcgcctgtaatcccagctacttgggaagctgagacaggaaaatcgcctgaacccgggaggcggaggttgcagtgagccgagaccatgccgttgcactattgcactccggcctgggcaagaagagtgaaactccgtctcaaaaaaagaaaaaaaacaaacatgtatcagctgagtttcggagggtgataagagtgtggacaagacaggaggccacatgacaggtgggaggctgttaccgaaactcagggcaggtggccacagggtcccggtggggaggaaaggagagatgccaggacaagggagcctcccagctggcccgcgtttggggactcattgtgctgggggctccacgtgggtgcgttcttagccgagcatcccaccgcccacaaggtgcaagtactggtttatccctggttttggataaagagactgaggcatggacgcgtgggtatcatagctaatcatggtggagtggccttgagcccagacagcccggctgcagagcctgtgctctgatgatggtgggacggccgcacccggaggccctgggatgtgggtagtgagcagggcggagcctggcccacggtgccctggcagccagtggcactgtccctgggtttcgcccatggggagagagggcgaaagagtgtcatgatgtgggggagcgtcgttctcagtgggactgggacaggtggcactcccgggatgcacaggggtggggcagatgggcctgggagcctctggcatcagggccaggggtggcccagagggggaggctgtggcagggacaggtgtctctggcaagtagcagggcaggcaggagagactgcaagggaggtggagggaggagcggggcctctggcagcgtccatggatggggcagttctacagaggagatggcagccccaatcaggaaaggccctgtacccgagcccttggcttggaaggtgggaggtgtgggctctcagaaggacggcagcccacgtggaaaccttccggcctcacatgtgggcaaggcagtgatgtctcagggacatcacatgcatgcacccggccctgactcgaacccctgacgggcactagatggagccccacagaaaggggacgtgcgtgggcctctgccaaggtgagtgggcatgggcagtgtcgcccctgaaattcctacacctggccgggtacagtggctcaggcctgtaatcccagcactttgggaggccgaggcaggcagatcacgaggtcgagatagagaccatcctagccaacttggtgaaatcccatctctactaatcatacaaaaattagctgggcgtggtggcgggtgcctgtcctcccagctactccagaggctgaggcaggagaattgcttgaacctgggaggcggaggttgcagtgagccaagatcgcgccactgcactccagcctggcgacagccagatcccatctcaaaaaaaaaaaaaaaaaaaaggaaaagaaaagaaaaatgaaaaaaaagaaattcccacaccttctgaggggattccagggctgggacctgacttgcccttttgggcactacagagcctccagcttccttggagagaatttggaaccaaaccctaacccccaggttgccctggcagggtccagcctggcatcagggctgactggcagccttgctcccaccgtccaagtgcccctcctgccctcccacctagttcctgggagtggtcgaggcacccggagctggtttgtcccaaagaacgcacaccgcacccagggctgccaggagacctttccgctccgtgcgtctccagctcctgccctcagccccgagcctggccgggatgctgagtggacacccatggcctctcaggggttgccagaaggttgcaaggccaaatggaaagcagctgaactggctacatcccttcctctcccaaccacagcctctgcctttggatcctacaccttcctctaggttagggacacactcaggagtcaaccggtccatgccaagtcctggcctggctccttgttcgctgtgtgccctaggggtagcccctggccttggcctcccaatctgtacaccgagatgggtggtagttcctgcctgtggggtgccgtgagcgtcaatggagatcgcacctccccagagccttgcagggcctgggcctggtcacctcttggacgtgtcagcatcgttatttctccccctcaattgccgaacactagtgtgtgcctctctagtgtactggcccccagcacagagccaggccccgtaggttcccaggcgatgatgtgccacttaaatccccgtcggccacttccgccacgaagccccgctttcgcacctgctgaacctaggactccgccatgcagcaggaccgccctgcacattgctctcgtccaactgccttacagatgcagggacctcacctgcgccagtcagtaactcatcttgcagctaaatatataatgtgtctatgagaatgtgctgggtcataatcagttgctctgtgaccctggcagggttttttttgtgtttttttgttttcggaaacggtataattctgcagtggtgtgatcatagttcactgcggcttcaaactcctgggctcaagcaatcctcccacctcagatcccaagtacctgggactacaggcacaaaccactatgcccagctaattattttattttttggtagacggggtctcgctatgttgcccaggctggagtgcagtggcatgattatagctcactgcggcctgaaactcctgggctcacacaatcctcctgcgtcatcctcctgagtagctgggaccacactcacgcactgccatgcctggctaattttaaagttttttgtagagatggagtctcactgtgttacgctggccgggaactcctgggctccagcgaccctcctacgtcagcctcccaaagtgtcgggattacaggcgtgagccaccgtgcccagccccctgggcaagtttaacttctctgtgccttggactccccagtgttaaatggggtagtagagggagacagccctccgagagccttcctgccctgtgcctggcccagagcagcagtgctccgcacgtgttgcctgtttctccatctgaactgcgctcctggccgcccatggcctcccagtcattctgctccactcctgctccacacaggtcataaagaactcccccgtgaagacgtttgctagtcccaccttcagctccctcctggatgtgtttctgtcgaccacagtgtttctgacgctgtccaccacctgcttcctgaagtacgaggcggccaccgtgcctcccccgcccgccgccctggcggtcttcagtgcagccctgctgctggaggtgctgtccctcgcggtgtccatcaggtaagcgccgcgtggactgggtctccagctctgagccgttagctccctcttctggctccatggcttatggctgagcggttggactggtccccagccagctgtccctgctggctgatttctggagatgggtccccgtgtcctccccgagccctgtgccccagcatcctccctccctgacgttggcccagatgcggggggaccacctcgctggagggggcggtgcctccacagccccaaccgctgccagcttgtccccagatttccaggttcagagactgcaaaggagaaggtgagaagataggaaacaatctggaggaaggaaaggaaaagacatgagcgggggtagtgggcctgggacagcaggcgcctcttcagagtaccggagccaaacagcatctccacgcacttgcctcaggcagtggtctcttggatgtgacgccaacagaagaaagaatagacaagcccaacttcctcagaagttaagctgttgcgctacaaagaacaccatcaagaaagagaaagaacccacagaacgggagggaacacttgcagatcaggcctcggacaaggtctaacatctagaatggataaagagcacacatagcctgataataaaaagacagctcattttaaaggggacagaggctccgaatagaccacaggtgcgtcttgggaaagctgggccctcgggaccagcctggctccctgagggggctcgcagcggctctgtattcctgagcaggaaggtggccctgtgtggtccccgtcctgggcaccacaagccccttgggtggtcctgtcaccctcaacaggatggctgccggcctagcagagtcccactagcaacggtgccccggagctgggcttcaaacagacatggggaggcagccctgaccttgagcgtctgctgcccttatccaacatcccagggcagaaatgaatggctttgagtctggcgtgaggcgccggaatgctggcttctcccatctggggtgggcaggctgggattcctgccccctccttcccacctgcactgtacccaggaccctttcagcttcctccgaggccgccatgggccatgctgtctgtggcgtgtgctcagtgtttcccagaactccctgtgggctcatgccccatcacccccagcgagcagccctcttcctggcacagcctcccctcctgcctcagtgccctcctgtgcttctggggacccctcccaaaggagccgtcgcctgcaaaccctttcagggtccacttccccagaacccaaaccagacatcctcaggcccctggttggtttgtttttcctctttaaaaagatcagctttaggctgggcatggtggctcatgcctgtaatcccagcactttgggaggccaaggcaggtggatcacctgaggctgggagttcgagaccagcctggacagcatggtgaaacctcatctctactaaaaaataccaaaaaaaaaaaaatagccattcttggttgtgggcacgtgtaaccccagctactcgggaggctgaggcaggagaatcaacttgaacccaggaggtggagattgcagtgagctgagatcgcaccattgcactccattctgggtgacgagcaaaactccatctcaaaaaagaaaaaaaagaagatctgctttattgtgacatgatttatatacaataaactcattcaagtggacaactcagtgatttttagcaaatttgaagaattgtatgaatatcaccactatgtaactatcgggcacctccatcaccccaaaaagaaacccatcctcatgggcagtcactcccccaggtctgccttccctggtccacccccaggttttcctctaatgtgggtagctgtagcgtcttgagggctctgaggccagcattgtctccattcctttttactttcaccctttagctattattccctgctccttcagacccaattctaaagcattgagggcaaccccggtgtagactgccgagggctggggtgaggtgcgctggaactgcctgcacagacatactccccaaggatctggtgaaggtggtggctgctgcacccctgaacaggcctgtggtgggatttggttccatttaccaggaatcgtcaagcctgggagaggcccagaccctgaaaggcttccctggcccctctgagggccgtgttgaggaccccaggttgacgggaacctgcgctgtggggtatacgggcaccccatccctttcctgtacaggaggaaagccaggcgcctcctcagtgactggcccaggccccgcccgttgcctccaggaggcttcctgcatcaccctctctgctctgccccagcaggcgtgaggtctcattttcagatccctgcagtctcagggaccagcatgaaggccccctccaacctcacatctttcccgctgctgactgggaacttggttccctctgtcccccctcctagggcctctgtattctgcatatttgtggttattcttggaagtattccaaagtcttcattatcctttaaatatcaggaagccagggctgtccaggaccctaaaagggtgaggctgtgcctgcgtccatgtggggaatggctggagagtgagcgttccctcgcctggccacaccacgcagccaagagggagaggcatggtaggtgttcaggcccgaaggctgggggcggggggctctgtgccagaggcttttttgctgttcagtcacaacagcggcccccgcccagcctctcctgaggcagggacagcaggcctatccccagctccctggcagcaagcttgagagaaggactgtctccccacgaggaccccacaccttctcttcacctccccatgtggccccaccatggcccaggggtccttggactcagccaagacctgttcctcctcctcacagtggttcttggcccgcacactcagctgcttctttatacagaaacttttattgtgtcaacatcacactcctgaaacgaagcccgctagacacacgcctgcaaaaggagtcagtgaatacagtcgctctgcttagaaggacaaagtcttttaaaatgaaatacgtggtgctggacctcacgtacaacagagccccgctgtctggagagtcctgaagccgccagctagaggtgaacatgcacgatgaacatgacagcccagatgcagacggcacgcgtgtgcgggtttggtggtctaagcgccacgagccaggttcagcctgtggtgtgattttctgaaacactgatgatgatgccccaaacagcagagaccactgtcactcagtttccacaggagctgcgctccaagaaaatccagggtgtgtcagcaccaccacagagcaccctgtttgtagctgggacacagcctctgggctaagatgctgtcagcagccttctgcctttgcaggtgcccaggggcttggctgctgtgtggggtgcagggcagaacctccctgggtggcacctgcccacatgcaggacagctctgtccctggcgcctgcccaccagatgccaggaccgcctcttctgctgcgacaactgcacgggctccacagaattccaggacgcctccaaagctgcccccgtcaagacctcctgcctcagaagctgatgggagccggtgacggcaacgtggtggcccccaggagactctcctcagggcctgtgatactctcacgtgttctgttaggcgagcgaagcatgtgcttttcacaagcatattttatcacaacgcaacatgtgaccctagaatcaggtacaatgagctaagcctggcttccttgccttctaccaaaagtgagggaggtagactcccaccccacgcctgctctcacgcccatcccaggggcaacacgggagagagcagagggcggcgctggctgcggcctcgcacctgtctcctggccgatgacccaccccgggccccgtcgctcctgctaacccccatgcctctcgcaggatggtgttcttcctggaggacgtcatggcctgcaccaagcgcctgctggagtggatcgccggctggctaccacgtcactgcatcggggccatcctggtgtcgcttcccgcactggccgtctactcccatgtcacctccgaatatgagaccaacatacacgtaagtaaaggctcagccgttttatttccacgctctcctggactccctaatctctcttttctttaaatcacttgggatagcaatttaaaaataaaccctttggccaggcatggtggctcacgcctgtaatcccagcactgtgggaggtggaggtgggcagatcacaaggtcaagagatcgagaccatcctggccaacatggtgaaaccccgtctctactaaaaatacaattagctggtcatggtggcaggcgcctttaatcccagctacttgggaggctgaggcaggagaatcgcttgaacctgggaggcagaggttgcagtgagctgaggttgcaccaccacactgcagcctgggtgatggagcgagactgcgtcacaaaataaaataaaataaataaaataaaataaacccttgaagaggcacgaactcttttactctcctgagccagcttttttagaagccgacttagcattggcctgcccagatgctcacgcccgggcagtggccgggctggggagtccccggtgggcacgagtccctgccagtgtggcttcttcttcatcaagttccaaatcagttattttccttcacattttacaaagaagcgtctgtcccacctttcctaaccatgcgagaagcatacctggcacacagaattgacttgtgcccgggtcggctgctgctgatcaggaagggaactgtgctaaactccgtggagagggaaccagcacggccgtgggagatgatccttctggtgcaagtgagcatgagcttccgggcgggctgatggtgtttgacactttagccccaaatcacatctcactgggccccaaggaaaagtgttttgaaggaaactgatcacacagcgtttctcaaacagggaggcctccctttcctttccacgaagacacgtgccatttcccacacctgcagaagagtgtgatgccatgtgaacagggagcctcacgccgggtagggaacctagaggcttgatctgtccttgacactgcccactagcaaaagtaagactgactgcagatagtgagcaattagctggtatcggtgatatttttaggttacacagaaacatggattaggccgggagcggtggctcatacctgtaatcccaggcactttgagaggccgaggcaggtggatcacctgaggtcaggagttcgagaccagcctggccaacatggtgaaacccagtctttactaaaaatacaaaaattagcgaggtgtggtgccgggagcctgtcatcccagctactcatgaggctgaggtaggagaatcacttgaacccggaaggcagaggttgcagtgagctgagattgcaccactgcactccagcctgggcgacagagtgagactcagtcaaaaaaaaaaggaaacatggattagtggcgaatgttttggcggccgggtatagcaggggtggcggggtggccctgggcggctgtcctaacccttcgcctcttgcagttcccagtgttcacaggctcggccgcgctgattgccgtcgtgcactactgtaacttctgccagctcagctcctggatgaggtcctccctcgccaccgtcgtgggggccgggccgctgctcctgctctacgtctccctgtgcccagacaggtacgcggccagcactgcttgcgggcaccagggtgcgtggccaccttgcccgaggttgcgtagggcctggctgcatttgcacattgcttctcacgccccgatagagatatttcccatcatgacccaaaatagctgtcagcacacatcataccaaagagctaatgagatgccctcagagtaatatgcaaaagaaagaaaaagaatatcatttagaacagcactctgggtagttgaatgtagacatcctggaaaacataatgctgccattgcattataccgaggtgacttctgatgaatgggctggaatctaagaaagtaggacctgaaggatttcatagaagatggtcaaggccatgaaagagcggagctgcagatggatgtgaaggtggagaggaagctggtgctgactttccttgagtggggtagggttcatgaaccgggacaggtcacagcctggaaggaggaggtgaagacgtaggatgatcttgcaagtcacctggggcttatttcaaaatattatgtcaggctgggcacagtggctcatgcctgtaatcccagcactttgggaggccaaggcaggcagatcacctgaggtcaggagttcaagaccagcctggccaacatggtgaaaccccgtctctacgaaaaatacaaaaattagtcaggcatgggggcgtgcacctgtaatcgcagctacttgggaggctgaggtaggagaaccgcttgtacccgggaggcggaggttgcagtgagctgagattgtgccattgcactccagcctgggtgacaagagtgagattccatctcaaaaacaaaaaataataaataggtcaaaacagttccccatatgatgtcatgagacgtaggattaatgaccagtcactgaacataggtcttttattttgaaatcctctgcatactgaggaggacgctggccttcagaaccgtatcactggtaggtgctgaggaatgggatggcgcagacacagaaacaggagtcagggaggccggtagacctctggggacaagcccagttctcatcattgtactacaaaaaatgtaaaaacttacaggatggcagtgataggtgctatatttaaaatatttgccattagcgacatccagtaagatccctatctttcatgtgttgcactaactgaataattcttgatttgttaaaaataagtcccagccggtcttggtgctcacgcctgtaatcctaccacttttgggaggctgaagcgggtggattgtctgagctcaggagttcaagacagcctgggcaacacggtgaaaccctgtctctactaaaaatacaaaaaattagccaggcatggcggtgtgcacctgtagtcccagctactcaggaggctgaggcaggagaattggttgaccctgggaggcggaggttgcagtgaaccgagatcgcgccactgcactccagcctgggtgacagagcaagactcagtctccaaaaataaaaataaaaaataagtctcaaaattgcctattacacatttgctactggtttcagggtattttaagccttttcaactaaatgtgttgttggaaatacagtaataccttgtataacagaatgtaagcagtgaacaatttattcaaatatttcgtgatatcttaaacccattaagcttccattcatgtaataaatttctcccaaatattgggcttttcctataactgcttataaaaatgtttcactattagtgtgtattgaagaaccgcctgtttacaattacagagggtttaggtgcgcagaatgttttaaagtcacatgggacatttcttccttgtccttgcaggagatctaacattctggctccctgagttattaagagaaccagagggacccctggcatttccgaaatgccccgttggagtggcattgctgttgccaaggacctctgcttgaattcattcaaaagcacaaaatgattctatttgccgcagtattgtcagtatcagacggagtaggcacggggtgtctttggttattagcaaagcaacagtccagccatgggcagtgtgagcatccgtcctcagtttacttaagaaaagaatcacaatacaaaagacatttaaattccctgcaaattaagatcaaaaagggaatttaaaataggactgtcattcagtacttgaaaggaaactttaatgaatagattaagcaaaataaagcagacttggatttttctgaaggtatggccatctagaacgatggtcacgatgagctctttctcgagagtatgaaatccagcaaactgctttttaccttttaaatccatcacaggtccctcatcgggcattcaccgtggcctttagtcatggctgcggggcttttctacctggagctggagagccacagtgatgggggacccctctgccgcctttgtgcccagagttcaaatagcagatctggggtagggatgatggttgaagttccactcggcccagaactcctccatccacttgaggcctcagagcccctaatcccatcacggttgctaagcctcagcaggatagagaggatgcgggatggtaaacaaagacgtaaactcagctttaccaagggaactgcccccagcattgggagacacagatgtgaagaaagaggtgggagcaggtggctttatgtggatgtacaaccacgtctaaaaaaggaacatagtttgttcaagctcttctcaggttgccttgtggaatgccttctttgctctttatgataatatttttctgcattttaatttcagttctgtattaacttcgccccttgacgcagtacagaatttcaggtaagcttttaatattgcacttctgtctgaataaacgagagtgactgtattaccctgcccatttcgaagcttcctgaaaacaatgggatcttgaataaaaggaacaatacgtgcattcttagaatagaaagtggaaaatatctcctcgttgaactgtatcatagttataatgtctaatggggaaaataaaattagttttattattttaataagacattacagtcatgtaattttatgtaagactttcgcatgcaacaaaggaaatctcgcaaatcaaagaaaaaagttattttgtaaaatattttaaaataaccgacttgaaatcagccaggcacggtggctcacgcctgtaatcccagcattttgggaggccgaggcgggcggatcacgaggtcaggagatggagaccatcctggctaacacggtgaaaccccgtctctactaaacaaaatacaaaaaattagctgggcatggtggcgggcgcctgtagtcccagctactcaggaggctgaggcgggagaatggcgtgaacccgggaggcggagcttgcagtgagccaagattgtgccactgcactccagcctgggtgacagaatgagactgtgtctcaaaaagtaataaaataactgacttgaaatccaaaatactaaatgtttgacccttgctttactataaacagcagaataaattctaaataaattgaagagtcggaaataaaaattaaactatataaaatctagaaaaagtaaaattcaatagttttcaagcctctaaaactgagataactttccaggcttacaaataataaatagaaccacaacgaaaagatggacagatttgagaggaagggagagaaaatcaaagcacacagaaaaggaccgggctcggtgactcccgcctgtaatcccagcactttgggaggccaaggcaggaagattacttgaggcctggagttctagaccagcctgggcaacatagcgaaatcctgttttggcaaaaaattgtaaaaattagccaggtatggtggtatgcacctgtagtcccagctactcgggaagctaaggtgggcttgaggccgggaatttgaggctgcattgagctgtgatggtgtccttgcaccccagcctggttgtcacagcaagactctgtctcagaaaaaaaaggccaggcacgttggctcatgcctgtaattccagcactttgggaggccaaggcaggtggatcacctgagatcaggagttcaagaccagcctggccaacatggcaaaaccccgtctctactaaaaatacaaaaattagctggggtggtggtgggcacctgtaatcctagccacttgggaggctgaggcaggagaattgcttgaacctgggaagcggaggttgcagtgagccaagatcggccactgcactccagcctgggcgacagagtgagactctgtctcaaaaaataaaataaaataaaaaaaagattcattagcaactgtagttgtcaataataaataaattaactgattatacatttactcaaataatacaactgttaaaatgcagtaaatatggaaaacatttaagattttcatttactaggtgaaactatatatgtactataggtacaactaggtatttatatatagtaaaaatatgtacaagatttatacttaggatataatgaatgagtgatgattacagctttagtacttaaaagtaaagcacctagcatctttttttaaccttttattgatgtgtatgtcagtatgcacagaagagtacctgatcataaaaggacagctcagtgcattttcaccagagaacacacccatttaactaccacccagaccaagaagtagagcattaccactaccccagaagccctccaaccccaccgctgctgaccccctctcccccgacctgaccacctccctaggggcagattttaaatggcactgaaatataccaaagtgtcaaccgaagccacgtttggctggttaggactgcaagtgatgtttgctttctatttttttcagtttttcaatccctcttctccatgataacggattacactgtattttactctaacttccatttatgacttataaattaactcctgcatttagtcacatgaaatgcctctttttgagccaggtgtggtggctcacgcctgtaatcccaacactttgggaggctgaggcaggtggatcacctgaggtcaggagttcgagaccagcctgaccaacatgtttgtgaaaccccatctctactaaaaatacaaaaattagctggacgtggtggcgggcacctgtaatcccagctactcgggaggctgaggcaggagaattgctagaacccgggaggcagaggttgcagtgagcctagatcgcaccactgcactccagcctgggggacagagcaagactccatctcaaaaaaaaaaaaagaaaagaaaaagaaattcttctttttgaagtggatctttgctatttgaatttaggaataggatcggctcctttgttcctttggtattaaaataggaaacacacattctagctgggaagctgtcctcgtacctgtttcttacagatgccttctgttgcgaggcagcccccttggtttctgagtgcacatgctgtgtgtgatggcttttcttccttggaagcaaaggtggaaagcaaacgctgtgctctgccttcctctccctctggcactagcccatgtgctgctgtccctcctctgcctggaggggcctggcctgcgcccgtctcgagtcagctgtgctgctggctccggctcccgcagattagagtgagctgtacaagcgataactgattgagaagcccagatacagtctcccatttccaccacagagactggaaacaccccctgcacataatggggatgttagaccttggtgacacctgctcctaaaggggactgttcttggtgtcaccactttgagaaaccaaaagaaaggtcaactcctaacccaacgagcggggctcacaaaaccttcccccagtccatattctcttcctgctctatttacaatcaaccagagggctcatggagctggacagaaatatgtttgagtcatcatcgtaacaaatggttattttgcttagtacttgagatgtaggatatgtaatgtcatctgtttcaatagcagttcacgaaatgagtcagtgaagcacagggtgtcttcccactgaggactcttggttcctggtcataggcgttgagtcacaaagcccgtatcagggctcccaagaccagccccaggtggactcaggactccgcaatctgctctctcaccgctgtgattacagcgaaaagacataaggcagaatcagcaaagggaagggtgtgtgagttgacgtttggaggaagccggcaccagcttccaagagtcctctcccggtagagtcacacgggatgggcttaattcctccagcagtgagtggtgacaacacttgtaacatgctgcctaccagggaagctcattaaagtctcggtgtccaggcttgtattaggggctgttcaggtctcccgcctctgcccagcacgtgcctaaattccagacttccagcaggaaagcgggtattcagcgtaaacctccttatttagacagtgtaggcagtgtgagccgctcttatcaaggaatggcaggaaccctccccaaatcccagctccctggtgccagccaccacctttgcaggcaggtctttccaaggatggcagcctcaggcctttcctgcacggaaccttaggctggaagggacgtagccatgctccagtccatcttcacagcttacaagcgaggaaactgagacccagaaagatggcatggcttacccaagattctgaaactcccccgcggtccagccaggatggggcccaggggttctgttccacccacggccagggcttttggcggttgtgcttcgcagagggccgtgatggccacacaggtcaagctcattgttttttaatatcccaagaacagttagtgaaacttattagacactttgattaaaggactgagcttttggccgggcatggtggctcgtgcctgtaatcccagcactttgggaggccaaggcgggtggatcacctgaggtcaggagttccagaccaacctggtcaacatggtgaaaccctgtctctactaaaaaatacaaaaattagccaagtatggtggcgcacacctgtagtcccagctactcgggaggctgaggcaagagaatcacttgaacctggaagcggaggttgcagtgagccaaggtcgcgccattgcactccagccagggcaacagagcaagaaagaaaaaagaagaattgagttttggccaggcgtggtggctcatccctgtaatcccagcacttggggaggctaaggcaggcagattggttgagctcaggagttcaagaccagcctgggcaagatggcgagaccctgtctctaaaagaaaaagaattgagctttccagtgtgatggagctgtctaaactgtggatccgccagtcgcatatataagtatatagtgaccaagcccattattgcatcaaatcaactggcctactctgtgcgcgggaggaatgcatcagggtacagcatttacatgaacagaacagtcacggtgttgtaaaaaagaaaaagactagaatgcagttcaacaaatgttaatagtgattgcctctggatggcaggacgatggacaaatcttttttgtctatttttttctacattttctatgatgagtatgtagtatttttaaatgggaaaaaatgtattccagcacactggggaggcagaagcagaacagtttgaacccaggagtttgagaccagcctgggcaacatagtaagacctcatctctacaaaaagttcaaaaaattagccaggtgtggtggtgtgtgcctgtagtcccagctaatctggaggctgaggcgggaggatcgctttagcctgggaggtcaaagctgcagtgagctaggatcgcaccactgcagtccagcttggatgacagagacagaccctgtctcttcttaaaaaaaaaaaaaaatacatatatatatatatatatatatatatatatatatatatatttcaaacaaactttaagaaattgtgctactcagccaggtgtggtggctcacacctgtaatcccagcactttgggaggtcgaggcgggcagatcactttaggtcaggagtttgagaccagcccagccaacatggtgaaaccccgtttctaccaaaaaaaaaatacaaaaattagctgggcctggtggcgcacactactcaggaggctgggccgcaagaatcgttgagcccaggaggtggaggttgcagtgagctgagatcacaccactgcatgccagcccgggctagagagtgagactctgtctcaaaaaagaaaaaagaaaaagaaaaaaagaaattgtgctactcaccactcatctgcagccccctgaccatggctgtctccatcagtgccactgaagtggagacagccccgctgaaagcaggctcagttatcaaagggagcagagactgggcgcggtggctcacgcctgtgatcccagcactttgggaggccgaggcgggtggatcacgaggtcacgagtttgagaccaacctgtctctagtaaaagtacaaaaataatctgggcatggtggcgtgcacctgtagtccgagctacacagaaggctgaagcaggagaattgcttgaacccaggaggcggagtttgtggtgaggcgagatcacgccactgcactttaacctgggcaacaaagcgagactccttctcaaaaaaaagaaaaaaaaaagcagaaactggttcagccttgtttagaagggcaatttggaaatttctaaggaaattctaaatgtgcaatatttaaaatgactcagcacttccatacgcacaaagataggggtaggggaatattccctgtgacactgtttgtggtaagaaaagacagactcgggcccagttccatcagggggaatctggctaaattacagaatttccgagtgctggaacactgcacagccatgagaaaataatggcactggttcagatgttagcattgtcctgagtgatttcggcaaaaagaactaacccagaatcaggggagatggcgtcttgtcaaacttttttatacaggtagagagtatagaactcataaaagctatttgtaaaatgataagtttattggattagaaatctaagaaccaaggccaggcgcggtggctcacacctgtaatcccagcactttgggaggctgaggtgggcggatcacctgaggtcgggagtttgagacaagcctgaccaacatggagaaaccccgtctctactaaaaatacaaaattagctgggtgtggtggcacatgtctgtgaacccagctactggggaggctgaggcaggagaatcacttgaacccgggaggcggaggttgtagtgagccaagatctcaccagcaacaagagcaaaactccgtctcaaaaaaaaagaaatctaagaaccaaatatatcagagaatgttaaatttcttgggtatgatgatgatattgtagttacatagggaaatatccttattcttaggagatacatgctgaaatatttagagctgaagtgccatgtcagcaacttactttcaaaaagttcattcagcaaaaagccgggtgcagtggctcacacctgtaatcccagcactttaaggcaagctgatcactttgagatcaggagtttgagaccagcctggccaacatgatgaaaccctgtctctactaaaaatacaaaaattagccaggcatggtggcacacacctatagtcccagctattcaggaggctgaggcaggaggatcacttgaactcaggaagcagagggtgcagtgagccaagatcgcaccactgcactctagcctgggcaacagagcaagactcaatcttaaaaaaaaaaaaaaaaaaagatgttaggccaagcacagttcaagcctgtaatcccagcactttggaaggccaaggtgggaggatggcttgaagttacgagtttaagaccagccttggcaaccagcaagaccctgtctcttcaaaaaaaaaattttttaattagctaggtgtggtggtacatgcgtgtaatcccagctacttaggaggctgggcaggaggatcgtttgagcccaggagtttaaggctgcagtgagccatgattgtgccattgcactccagcctggacaacaaccatgtctctaaaaaaacaaaggagagagagaaaagaaaagatttttgaaagaagctaaagacttctaaaaaaaaagaaaaagaaaaagaaaagaaaaacgattaccaagcacttactaaagatgttagttacagggctgggcacagcagctcacgcctgtaattccagcactttgggaggccaaggcaggaaaattgcttgagcccaggagtgcaagaccagcctgggcaacacagtgagaccccacctctatttaacaaaatgaaatcaatcagtttcaaaagttagtctttatccctccataccttcagccagcccaaaccaggaatgggcagcttgacagcttcaggttgttgaaggcctggactcaacaaagctttgcgtagctagcggggctgttctgagcttggaagcgccgagcagtaacctctccctttcccgtgtctttgctctccagttccgagaggaacccgtgcaatagttcggtgccgcgtgacctccggcggcccgccagcctcatcggccaggaggtggttctcgtcttctttctcctgctcttgttggtctggttcctgaatcgcgaatttgaagtcagctaccgcctccactaccacggagacgtggaagcggatcttcaccgcaccaagatccagagcatgcgggaccaggcagactggctgctgaggaacatcatcccctaccacgtggctgagcagctgaaggtgtcccagacctactccaagaaccatgacagcggaggggtgatcttcgccagcatcgtcaacttcagcgagttctacgaggagaactacgagggcggcaaggagtgctaccgggtcctcaacgagctcatcggggactttgacgagctcctaagcaagccggactacagcagcatcgagaagatcaagaccatcggagccacgtacatggcggcgtcagggctgaacaccgcgcaggcccaggacggcagccacccgcaggagcacctgcagatcctgttcgagttcgccaaggagatgatgcgcgtggtggacgacttcaacaacaacatgctgtggttcaacttcaagctccgcgtcggcttcaaccatgggcccctcacggccggggtcatcggcaccaccaagctgctgtacgacatctggggagacaccgtcaacatcgccagcaggatggacaccaccggcgtggagtgccgcatccaggtgagcgaagagagctaccgcgtcttgagcaagatgggctatgacttcgactacagagggaccgtgaatgtcaaggggaaaggccagatgaagacctacctgtacccaaagtgcacggatcacagggtcatcccacagcaccagctgtccatctccccagacatccgcgtccaggtggatggcagcatcggacggtctcccacagacgagattgccaacctggtgccttctgtccagtatgtggacaagacatctctgggttctgacagcagcacgcaggccaaggatgcccacctgtcccccaagagaccgtggaaggagcccgtcaaagccgaagaaaggggtcgatttggcaaagccatagagaaagacgactgtgacgaaacaggaatagaagaagccaacgaactcaccaagctcaacgtttcaaagagtgtgtgaggcggcgcccacccgctgcccgaggtgctctgtttgtcgaaacacagtaatatttgtatttggctgttgtgctttccaagcgccacagttgccctccccggacgtggtgttatgtggtcatttcagccctaacttctgtgtggatcacagttattcagggttcattttcatccattcttccctttcgctcccttccctggaaaccccgctgcctctgggtcatccgttcagcacgtggtggagaacaagtgccttcagggctggcctcggcctcgagtctcgggacagaggccgccagtggagatcatggctttgggtattatttgacttttagaacaaaagctgtggttaagatctcatttttattgctttttcccacgtcccacgagacactattttcggttctctggctaataccctgtttttgagtttattttgtttctgtctatgtcacagtgttcctctacgacccgacctctctatgtaagcacacatgcgcacacacacttgcattcatgaatctgatataaagtgccagtaatccgccaagagggggtgcgaagggggcatgtcacgacagctccgccaccccccattgcccacccgcactttcccgagcaccgcgccccgtgggctgtgggtgagccgcgctccctgcactgagcgggtttaggggctcgcccacatgcatgcaggccaagacagcaaatgccagccgggcacgacgcccgtgtgcccaggcctcgggggtctcagagccgcctctcacccccgaccctccacccaggggtctccccatcgggagtggaggtgttggtcctggaagctgactcatcggagagggaaataccaaataaacatccgaggttgcatttatttatttatttatttacccggaagcatgtgcgctcccgggaggggtgctgggtcctcagggtggggggtcatagccacaggggagggcagttcccaggaaggtaaccagatgtctcttttgtgttttggccacctggggccgcccccaacctccccaccccaagaggggtctgagtgggacctcaaagcatggccagtgcaattctgaggctaggggaataggagaagcccaccagctgcccctgccacccacgggggctcctccctgccggggtccagctcagaaccacgggggtctgtgccggcagcaccggtgccatcttggcttccacaaattccagaagtttcttggctgcctcccgctctcagatggcacagggcctatcagtggcaggatttaatctggggagcaaattccagctctgaaatggagttctcacaccgtatctagggacagaggcatctggatgcaaacgcggggtttgttaggggcggaatcccgagggtggtgtgggggagctccgtccgggcagttggctgctggtcctgtctgattatgttttgccatattgagtctgaagtttgtgtggaagtgagctcgcccgagttgtccggtcggagttgtagccagtctttcaggggaccccgggacgctgatgaggcccagggtgcactccttgtcagtcttgcccgttgtccctgtgcattttgctttccgctgtcaaatctcactgtctcgttttcacaccgcatcagtccccatcatcactactcctccccagagacatacagattgccctccccggcatgaagaagtcacaattctgacccgccacctctccaggggcggtgcctgggatggccacccatcaggacagccagagccagggtcccggcgtcctgagagtccagggcacctccccccattagctgtaaggtttcctgtcaggtgtgactgtcagtttgctggtcttccaataccgaagaaagggtggttgtgacaatacctcttgcttctaaagaatgtattataaaacaccgcagatttttttttttccttaaaaaacactacctgatgctttccttgttcgtggggattgtggtcacatgaagctctttctgcatcagtattaaggtgtatatttgaatgtcctcccctcccctttcccctccaggctgtgtagctttgaggggctgggcgtttgctcacgaccttgctgtctcgctcagaacatgctccgcaaagttctccgcacacacttcttccccatcaagcccatttccttccccaaccacaaaggtgtttgtgattcctcaccccgggaaaccaaggagctgcaaagtggagtctggttcagccccgtgcagactcacccagagcttaacgttgtctttcaaacaccctgagccttcctaaacagccagtgcagacgttctctctgggccacgaagcccctcgggtcctccccgtcccctgctccgatgcatacctcagtgcagaaccacagaatctctgcagcggaaacgccgtgcatctcttgtctgttggcagcgagcacatcgtgctggagacacgagtttctaagcagctggcacgagggctgctgacggcatgggtcgtgcttcagggtggcaatacctcttaggaacttagggcaggaagcaatacttcagcattgaatgtgtgtaaatagttgctttgagttgcaattgctattttcttctcagtcccagctcagatcgaattatatatccatatatatatatatatatatatatatatatatatatatatatatatggtaaacaagcacacacaattttatccaatgcaaacaaatgtagagcatcagttacaaaaccctcgaatagcttgagagccccacaggctctgccacacccgtgacttcatccacactgacgtcacccgcgggggctccccctgcacatttgcacacgatccggagagccgaaggccgcgtgcttcctgtcacatgggctgtaatcatttgtagtttccaaagacacgtctgcatttgaatttctagattttcgaggtaaggagttttttttaattggttgtttggaaaatcacatcatgcctagaatctgaaattgaattagcaagaaccgactgtttgcattttccatatatccttttatctgctctttttaaattgttaattctaataatttcaaaatgcattcactgaagaaatggacattaaaatattctaaaatttaaat

SEQ ID NO: 36619 - DNA, 3071 bp, Homo sapiens
ggcggacgctggaaagcgccgttcctgactctaatgtacttagacacttgaagccacaaaaggatttatccccgaggttcctcatctgctcgcgaggatgccttttctcttctgccttgcgaaataacagcagcctagctgttgcccgtgaccagtgagaaaggcagcgtcgcgggctgattaggtttcacccaaagggtgccggcgccgaattggtttctaacgagaacttttaaaatgatccgttccaaaaaagggtaggagccgcgagaccctccaactgcccagagaaaacaagtctcgtctggcaaagttctcggcccacgcggtccgcggccaagggccaacggtccctcgccccacgttgccgcagcactgcgcgtgcgcgagccgctgtcaaacgcgctgacggaggccgagaagaaaaaaaggcgggagccgtcaatcccgggttgagcaaaatggcgcgggagaaggagatgcaggagttcacccgtagcttcttccgaggccgcccggacctcaggtgcccagggggttggagatggggttggaaagggcgcgggtgggtcgggactccgtcctgacaccatgtccctgcagcacgcttacgcattccatcgtgcggcggaggtacttagctcactcgggccgcagccacctggagcccgaggagaagcaggcactgaagcggctggtggaggaggagctgctgaagatgcaggtgtgccgggccggagcctgggccgcgggaggcggaggcggggcttgctgctgaggaggaggggcctgacggggcgcggtgagcgcagccttggtgcatagtttgccctcttggcgcacacacaggtggatgaagccgcttccagggaagacaaactggaccttaccaagaagggcaagaggcctcccaccccttgtagcgacccggagagaaaaaggttccgcttcaattcagagtcgggttagtgcttcctccctgctgtgggggccttctgcatcgttggttcactcaagaagcattcactgcgcatctcttatgtccccaggcgttagatgagggagcaaggctagtgagtcaggaaccgggaacagcaagtacagatagctgtttcctgctgcccctccaactgtcagggcagggctcgaggcaacctatccgaagtgaagggagaagggacaggaggagcctgtctcaaccctctctcctctccatattccagagtccggctctgaagcctccagcccagactactttggacccccagcaaagaatggggtggcagcagaagtcagcccagccaaagaggagaatccaaggcgagcctcaaaggcagttgaggagagcagtgatgaggaacggcagagggacctgcccgcacagaggggagaggagagcagtgaggaggaggaaaaggggtacaaggggaagactaggaagaaacctgtggtaaagaagcaggcaccaggcaaggcctcagtcagtaggaagcaggccagggaagaaagtgaggagagcgaggcagaacccgttcagaggacagcaaagaaggtggagggaaataaaggaactaaaagcctgaaggaaagtgaacaggagagtgaagaggagatcctagcccagaagaaagagcagagagaggaggaagtggaggaggaagagaaagaagaggatgaggaaaagggggattggaaacccagaaccaggagcaatggccggagaaagtcagctagggaggagaggagctgtaagcagaaaagccaggcaaagaggctcttgggagactcagacagcgaggaagagcagaaagaggcagccagcagtggggatgacagtgggagagatagagaacccccagtgcagaggaagagtgaggacaggacccagcttaagggtgggaagaggttgagtggaagcagcgaggacgaggaagacagtgggaagggggaacccacagctaaaggctctagaaagatggccagactgggcagcaccagtggtgaggaaagtgacttggagagggaggtaagtgacagcgaggcagggggaggcccccagggggagaggaagaaccgctcttccaagaagagctccaggaaaggcaggacacgaagctcctcttcctcctcagatggaagtccagaggccaaaggagggaaggtgagggtgaggaggggtgggaggccactattagggaagagggagaccctgcctcaggcccagcaggcttggccttcagctgctctttccttgctaggctggctcaggtcgccgtggagaggaccacccggctgtgatgaggctgaagcgctacattcgggcctgtggtgcccatcgaaactacaagaagctgttgggctcctgttgctcacacaaggagcgcctgagtatcctccgggcagaactggaagcgctaggcatgaagggtgaggcccggcgtgccctgggggctgcaggagagggccttcctgctggggaggagagaatcaccagcttcttctgccccaggtaccccttccctagggaagtgtcgggccctgaaggagcagagggaggaggcagctgaggtggcctccttggatgttgcgaacatcatcagtggctcgggtaaggggtttcctctcactgcccaggagcagataggtggggttggaccttctcagacatctgatctctcgtttcccctttcccctaggccggccacgcagacgtacagcctggaaccctttaggagaagcagcacccccaggggagctgtaccgacggaccctggactcagatgaagagcggccccgtcccgcacccccagactggtcacatatgcgtggcatcatcagcagtgatggcgagagtaactgagctctgccacccccaggagggacccttgatacatgtacaaagcatacatagcaccccttgccctgtgtctgtggaacagaagcagcttccttcagagaagactgcagctcccaaggacacaagctgttgggatgctacttctcagcttcacgctgtccctttaaggtgtttattttttaagactcaataaaggagtgtttttaatcacctc

SEQ ID NO: 36620 - DNA, 3387 bp, Homo sapiens
agtcccacgtgtagcggagaaacagtagttaggatggctgaaggggatactcaccggctgaaggccgactgtgattccccctacccccacaaggcgattttgaccccctgagggctgctctagaggactcaggccccgaagctgtcccagggaggtccccgctgcatcccaccacccaagctgtgcctcatggagtcgatgtttagcagccctgccgaggcggcgctgcagcgagagaccggggtgccaggactgcttactcctcttccggacctggacggagtgtacgagctggagcgagtcgctggatttgtccgcgacctggggtgtgaacgagtgaggacagacttagggaagggtggctcgcctctgtcgggatgggtcgcccagaggatccggatcttgggggattttgtgagggcgagagggtgggggaatcagtctgtccgcagcgcgttgaccatccctcccttccacctactacgtggggcagagtgcccctctgggaccaggggctttgaaggttgagtgggagctcctggaagattgctttaaagaagccctcagtgggagagaggctgtccctgactccatggtttatgcttataggttgccttgcagttccctgaccagctattgggagatgctgtggctgtggctgcacgactggaggagacgacagggtcaaagatgttcattctgggtgacacagcctacggcaggtgtgaacttggccttaggtgggccaggcctggggatccggggctcatggggttttacgtctatgacagtgattgccttcaatggtggtgtttctccttgatgataatggtaatgactccccttctgatgctagctcctttcattgacaatgtcttcctttaatgaaaccattttattcactgaccacatttcccagtgatgacagcaactcgcctccagaagagaacccatttctctgatgctatcttccctgcagctgctgcgtggatgtgctgggtgctgagcaagctggagctcaggctctcatacattttggccctgcctgcttaagccctccagcccgcccactgcccgttgccttcgtgcttcgtcaacgttctgtggccttggagctctgtgtcaaggcctttgaggcccagaacccagaccccaaagcgcctgtggtgctgctgagtgagccggcctgtgcccatgccctgggtaaggggttttgcctgtgtatgcacaaagggtgagccaactgctttatgccttaatttccccatttccatataccatccatagaactcttgatatgggcttggccccagcctactgggtcatatttagtctcctggggatgagggagctcctgctttgccaggctccaacctcaacactacctccttctcttccagaggctttggctactctcctgcgcccacggtacctggacctgctagtctccagcccagcttttccccaaccagtgggttccctgagtccagagcctatgcccctagagcgttttgggcgccgcttcccccttgccccagggaggcgtctagaagagtatggtgccttctatgtagggggctctaaggccagccctgacccagaccttgacccagacctgagtcggctgctcttggggtgggcaccaggtcaacccttctcctcctgctgtccagatacagggaagactcaggatgagggtgcccgggctggacggctaagggcacgaagacgatatctggtagagagggccagagatgcccgcgtggtagggctgctggcaggcacactgggtgtagcccaacaccgtgaggcactggcccacttgcggaacctgactcaggctgctggcaagcgtagctatgtgttggccctggggcggcccacccctgccaagcttgccaacttccctgaggtggatgtctttgtgctattagcctgtcctctgggtgctctagccccccagctttctggtagcttcttccagcctatactggcaccatgtgagctggaagctgcctgcaaccctgcctggccacctccaggcctggctccccacctcacacattatgcggacttattgcctggtgagtagtgggggcattgcctaagctggaaacctggggcacggagtcagggggtgagtatggattttctttcctcctccctttcaggctctcccttccacgtggctctcccaccacctgagtcagagctgtgggaaaccccagacgtgtcactcattactggagatctccgacccccacctgcctggaagtcatcaaatgatcatggaagcttggctctgaccccacggccccagctggagctggctgagagcagtcctgcaggtaaatgtacaagtctccactcccagctgagctttttctccagatgcagcgcactcagactgagccccctccctctacagcctcattccttagttcccggagctggcaagggctggagccccgcctgggtcagacgccagtgacagaagctgtgagtggaagacgagggattgccatcgcctatgaggatgagggaagcggctgataccatgtggggctggagacatagatggacttatgaatggctgctaggacctttagtgctccctgcaccaacctcccatccccctgccaagatccttgaaggaccctggaaggagggagagcaggcagcccttcacaggataggatccgtctctgtcctgtcctggcactggcacaagctcagcacatgcccagtaatgcgtgttgtttggctgatggaataaagggcttagggacttccctgaggcctctggacccatctgtcttcctgagggcagcccaggacctttggccaatcccagttcccaggctgcagttgagggtctgtccttgtcaaaaggcaggtgctagacagtctagaccagggtttctcaaactcgtacttgacatttggggccagataattctttgttgtggggctgtctggtgtatggtagggtgctcagcagcatccctggcctctgcccactagacatcagaagcactcccccagttgtgacaaccaaaaatatctccagaccttggcaaatgttatctgtgggggaaaattgccctcaattgagaaccactggtctagctagacctgcactgtccagtacagtagccactaaatacatgtggctaaacttaaatttaagttaattaagattaaaagctcagtttctcagtcacattagtcattcaagtgttcagacagccacatgaggggacagtgcagctacaggatatgccatcatggcagaaagttctattggttggacagcgttggtctatactgactcttatttctcagggagatcacagcaacctaaataaaccagataccttttctctt

SEQ ID NO: 36621 - DNA, 13348 bp, Homo sapiens
agcgcgcaggcgcagccggccggcagtcccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtgaccgagagcggcgggctgcaacttcccctgttgcgggcggggccctgggggcgctttggatactgggacctcggtgtcagggcgggcgaggtggaggcttcccgggcgcagggggactggaggcggccgcgggactgggtgggagggggctgctcgcgtgctgggaggccggcgctccgggggagaccctgggggagctgggctgaggccagcctacctccgccgcagtctgcttggacttcttgtcccgggtcggtagtccgaggtgaccagcctgggggtaggagaggcttccggaaccggcgggcccgttctccaggaaagagactgcccaagtacttccttcagcgtggcctgggctcgggagcagaacgagaggaatgcggggaggggggcgggacccgcacaggagaggcgctcggagcccagggcttgcagccgcccgcccgctgcgtggtctccacgctggccgcggtggcttcaggcaggcattaaagcgcctggttcagatgagagactaccctccgcctcttttggggaaccgtcgtccttcccgggaaggggaggtgcgccttcaacttcggcgggcgggcggcccctgctgtgggctacgcgaggccgggcgaaggcggcacctgtagacctggggcagcctccactgcggggaaagggggcggggggctgccagaaagtgcgtctttaaggcttcctcgtacttaactccgcttcagttcttttttcagcgtatttaaccaagggtagacgataatgggagaatgcagggagagggaggggataatttggtgcccatgatcaccacttctagaaaacccactggcaatagtgtcttcgaagctgaagctggagggggcgggctgcagctgaaagtggtcttcatcagtctggggtttgtcaatggaaacgatactaatcaacgagtagaatgcttacatcctcgaccgcagacgccacctgaggacggggaggactagggggtggggaggaggaggtccagctcagcatctgatgtcgcagaaaggccgtgccacgttgtgggcggggctgataaacagcctgatggtttcgagaagctctgatcttactcccagcctcttgatcttgtaggcatgtctaactttgggaaatggtttgtgcaaggccacagagctgaacggggtctcttgggataaagccataaacataaaattcgcacaattatgaaatgttggaggaaataaactgtaatatactttgggtgacatttaaaaatagctgaaaaatgagaaaaaccagcgcagagaagactaaggaggcaaagggaactgcatatgcataggtcctcaaacaggaaagccctccctgcattcagaggatgtggagaggacggaatggcttcagcacagaatgagaggtgacttgagatgaggttggaggggtgagcagcagcggaatcacacagggccttagaggctgcaggtaggcatgcgggtattgaggcaattcttaaaatttgaagtgttattctgcagtcagagccactgaagggttttaagcataagaatggcatgatctcaatatatactcgagaaatttatgtggtcactcagtggagagtgaaatgggaggtcattcagggcaccatgccagagtccagatggtggcttggattagggtggtaatcattgaaatggggagcaagggaaggacttgaaatagattttggagatataactaacaggagttgctgacggtttagaaagggggcgagggagagggaataggattgccaaataaaatacaggatgcccagttagatgtgaatatcagattaacaatgaataaatgtttttagtgtaagtacgtcccctgcaatatttgggaacaggtttcacctgggaaacttcttaaacttactgatgcagtgacccaccccagagcaagtcaatcacaatctgtatgggtggggctcagtatcctatcttttagaagcttttggtgattctgatgtgcaggcagtgtgggcggggaaccactggaagatggagccaagagaggaggaagctggtggctgcaggaggggaagggtttgagcatcctaaacccttgtctgtgacactgtcactgagggagagtttgcatgcaccctactctcagaattgttacttaacatgtcttttttccccctaccaaatttgtcattaagtttttctaaaagctgattgtgtaggtgcgtcttaaacagattctgctctgttaaattactttttcatgaacttgtaaagacaactaaatctattggaaaatgacgttaaaaataatttctctgagtgcagacaagtacattaattggccattgctctagtgtattgttttccccagcagtgtttttgtttacctctgatttcatttaaaaataggaatctgtaaataagagaggtgtgaggtgctattctgcccacatggcccattagtggcactaacttggtccacagatcctgctgctgggccagcctggcagcttcctgccccagccatagaggctcaggtgggggctctggctcattgggctccaaatccacagaattacatttgctgacctatatttctgaaccaatgccatgggatctgtgcaggatccggcatcgggagtgtatgaaataatgccaccatccttccagctgcacacatattacagcttgcaagcacattagcatgtagtggccaggaggctgtggctagatggccttagacaagttatctaatgtccacagctcagtttcctcctttgtcaaatggagatagaaatcatccctacctgggagggctttgcacattagatgtggtaaagcagatgtcttagtccatttatgttgctataaaagaatacttgaggctgggcaatttatgaagaaaaaaggtttatttagctcacggctctgctatgagctgtaagattcaagactgggcatctggtgacagcctcaggctgcttccagtcacggcggcggaaggtgatagggagcaggcaggtgcagatcacgtggagagagaggaagctgaagggggtggtgccagcttccttttaaaaccagttctcatgggaactaacaaagtgagaacccattcactactgagatggcaccaagccattcatgagggatctacacccatgactcaaacacctcgcattaggccccacctccaacattaggatcaaatatccaaaccatagcagcaggtaaagcacatagtccatagtccctgatttcagaagtcacttgttagtgttatttgtgtttatcttcttaatcctactgtgacagagcagacctgaaaggaatcatcatttattttacagatgaagaaagggagttcagagtttaattaacttgctgaagtttccatggccattgagtggtggagctgcatttgagaacagtttcttccacatcgcagctcatgtactgggtgtgttccctagttactttggaaatggaatcaggattaattccacaggggtttgggtcaggctgtgtaagtgcctcctccctcttcctctacctcctcccatctccaatgccgagtaattttcaaatgactttcaagggcagccttgagggaaaaaacaagtgactgaggtgctcaccccaaagtctagcatggaatccaatatcacctttcccaggaagcccacacttatctccacagataatcaccaccccttaccatgacaccttatctgtacttgtcttataaaatctgacttctcattatattatagcattcatatatgtgttttctgttggactgaagctccttgagggtaggagctttgtagccccaccccacccctggcccagcactgggttttgttcccagaggcactcagcaacatcagagatgaatccagtggtgagagggtttagagtgagagtgtttgctggcagctgtctcacctcctgtctaggaatgtgtgtgcccaggtcctccttgagtatcatttgacattgaatcttttaacatttcttgactgcctcctcctgctgacctttagctggccactggggaactaaaaacactgtttctactccttagggtttccctggctcgacccggagagccctattaacaataaaccagtttagctagaggcagccttgaaattctggctctcacactcatagtagggaaaccttggtaaatcacttaacctccctaattcccacttttctcatttgtaaattagtgataatagttcctgtcccacctttcccagtgtggtgaggatgaattatataagatgatgtgggttacccacactgagaccaccactaagtcatgtttgcttccttccctctttcttcctgctcctcctccagtgtctgcccctttgtttaaacgcctctcctggctgggcgctgtggctcatgcctgtaatcccagcactttgggaggccaagatgggcggatcacttacggtcaggagttcgagaccagcctggccaatatggcgaaaccccgtctctagtaaaaatacaaaaattagccaggtgtggtggtacacacctgtaatcccagctactctggaggctgaggcacaagagtcacttgaacctgggaggcaggggttgcagtgagccaagattgtgccactgcactccagcctagacgacagaatgagattctgtctcagtaaataagtaaataaataaatgccttttctgtctccctcgtacatttccttctgccaccaccccagtgcaggccattatgaccttattcttcaactggtataagagccccagattctctttctctccgtttgagtaacattcccagagcctcgcttgaccttattctttgtcttctctcttttgcctaacaaaactcatgcttacgtcagcatctctcctctgccttctggaactggtgggcagcttctttcctggccccccacccactctaacccctagttgtggtcagaagggcagctttgcttctctgcacacaggtcacatttcctgcctaggtgcattggttccagaaagaagtctgccaggcaaggctcacccccatccttgtttggggagatggctcccctcctcccaggcctgcctcccttcaagccttcctccttagcctcaccgttcctgcaggcctgggcatacagtgtttggggggcatttgtcacacactgccctgtactgtggttatgggtttgcctatcctatctctttattttaaactgccttaggacagggactctcttatacagtttgtgccctcacattgccttttacataaccttgcataaatacttattgacaaaatgagattggattttatcctttccagtagagttggcaaaacctgctgtgtgttcttatgctcactcatgaagctgaaggatatttcaatttggggaaaaaaattataataatatgtgtgctaggctgtgtgtaaaaatatgtgatttttgctgaagagttatgttgggtgacaggtactttttcttcatctgctcatgctgctctcccagatcttattcccttcctaaacattcacaggctttgttttctcttctttattttaaaagtctggaaggctcttctagtgtctcgtatgatgtttctttaaggtttcatctctggcttccgggtgctgcttcgttattgctggttattgaatttacaccttggcttgcaaatccctttggagaaactgcttctcttgtaagccggctctgcactgaccaggcccatgggtgtgttgaagcaccttcctatcccaagccatgctgaattgcactcctttaatacactgccccttctcatgcattctataaagctcttctatataagtaataataaaagttttgctgctttggccatgtaaaaattgtaaaatgccacatggaacactaaatatcacatcaccctgtgacagatgtactgatgtattggcagaagctcttgacttgaactgaagcttgacagtctttacttactgatttttctaaactgtaagacatcttttttctttgacaaccgttcttatattttttaaagccatctcttgaatgtcttttttacccattcaaacagtaaattggttcatataatctaaacgcgctaatagaatgccctttgactctgtggccttttcaagcgttctatttcagaatcatcttaacacagtgatttgtgaagcaaaatgcatataattttgtttcagatgagacagttaaaaacaagtccaagagaacttttatggttttacctgcaaaaggtggattcacactcactcctggctatgtgtcttctttttcctgttgtaaaatgttgggttaggaaaagcaaattctacttgggtaacttgggaacaagaggactgaattcagtgtctgagtttacagggtgacggctttgtcagcgtgatgacccacgcttaatgtttgctgtcctttggaaagctggggacctggtgctttattgtgcttggacatgagtggcaggccttttgaaggactgctgtgtttcatcatttttgccatctcctggatggcagacatctattgagaactcattgcaaatttaggactgtttgaaatttaaaaaaataaattttgatggttagcctgtttcctcacaacttttttcttttgtcctgccaagattagagagcattactttctaagagagcaatattttccattctactcttcatccataaagccaggaaatgggaagtagcagcagcgtttgtctggggtatgggaagagaagaattattgaagacttcattggccaacactgacagagttgagtcagcctttaaactcaatacctggtacagtgcctggcccatgggtggtgcttaataaatgtttcttgaaagaatatttgtgagtgaaatgcacccacacaatagttttaaagtacctttaattgatgtcatgctcctttacaaaatactgatgggcagggcttttgtatgtgggtcaattctcagattttaattttgacttaccttgtatttgtgcttttccaccttataaccttccactttgcctttcaactgcacacaggtcttctttgatgtgaggattggagacaaagatgttggcagaattgtgattggcctctttggaaaagttgtgcccaagacagtggaaaattttgttgctctagcaacaggagaggtatgtctcaattttatttcctttaaattgggtcttctttctttgaagccaaatataaagatgtcatctgagaaaataagtattaaattagtatgtcagatgaaccttaccacatttgactttattttccaattaaatatgtattatttgggcactcagtgcccttaggcttctggaaattgggagaaaatcatcatcaagtgaaaatatggtttgctctcttttaacttattcacattaatactctacttccataacatatttattttttggtcagctaatgataaatttctctcagtaaaccatagctgggatagaatcaagttctgtaggcattttgtttaattttctcagtttgtcctttctagatcaacactgagtttatctttcagtatggcctctgttacttgttattcaactgaagtaatctctttagaaaggatatggatataaaggaagcaagtttcatcgtgtcatcaaggatttcatgattcaaggaggtgacatcaccactggagatggcactgggggtaacgtctttgcatttttcctttcccatttaccaaaccgaaatctaaggttaagccagtatatgaacccagtctgttgaaatccagagctaaggaacacagttgtaaagacgactgtacctctttgagaaggatggagttttggggactcatctagcagcatctcgacaggtatgagggaggcgtccttattttaagcaggattgttttggtgtttattgtctttccgtaattgagatgtattcattttgcagttattaaaataccagactactagtcagtagccatacagaaaaatatctttcataggaaggaaaaggtgtggaacatgaagctgcgttcccctgggatggcagcgtgcggcagaggtgggcgttgcaggaggaagacgggcctcatgccaggagattgagactagagttagcagcagggtcacagcgcactttcctccttctttcaaaatctttcatcatattgacaaaacagtgaaaaacaagtccaagagaacttttaagatttaacctgcaaaaaagtgactcacactcctggctatgtgttttcatttttctgttctaaaatgttgggttacagaaagtgagttctacttgggaaacttgggaacaggaggactgaatccagtgtctgagtttacagggtggtggtttcgtcaggacccaagcttactatttgctgtcctttggacaaagctgggaaccaatacttttttaaagttaaagcaatagctgagttgtcaaaattgtaatagaaacaaactcttacaaacaaagttggagttcaataaagtagagatagttaaatttagagagtttcaaatctccttcagcttattgtttctcattcaggattatagctatccagctccatacactgttttctcttaaaagtttagttcttttcttgaacatacaccatatatgtaactccaaataatttaaatttactttagatttaagatttttaattcaacaaatactggtttcggtggatatttgttgtccatttttaaagcaacaggccattttcaagcactatttctaattttatgtttattgcaatggtttgtttataaccaaaaatggctactattaagtgctttgatttgccaggcactttgtgaagattacttctagttcttgcaagaatgctgaggggtatggggatgtagactggagtggaggaaggcatttaggttgccccaggcaatgggatttgctgaggacgctcgtggatctcattggaaaaccctgcagcgctggtgcccgtgccctcggtgctggcatcccaccttcctgccataggaatggtgctggcaggaatggtgactgagcttcactctgccctcttttctgctaccttttttttctcactaccttccctgcccagtgtgcatcttgcattaaaattctctgaattttggacagacaatgttttgggcaatttaaatatagtgtagacccttctgtaggagcactctcctacaaggccacttcaagtgtcactgaccaaccagttataaattgcttggctttgatatccacttctgggctttttttttcttttgagacacagtctcactctgtcacccaggctggagtgcaatggcatgatcttggctcactacaacctctgcctcccaggttcaagcgattctcctgcctcagactcccaagtagctgggattgcaggcgcccgccaccatgcccggctgattttttgtatttttagtagagatagggtttcaccgtgttagccaggatggtctcaatctcctggccttgcgatctgcccgcctcagcctcccaaagtgctgggattacaggtgtgagccactgcacccagcctacttctgggttttctaactgaatcagaattttgaagttggcaactgatagataaggggccctacagaaggggaggtgggcctggtagacccttgaggtattggaggatggtcagatccttcttatggtctgtggagaaaggtcttccactctgcctgccgctttgctagaactccagacttcctgccttgctttggttctcctgttcaaggttgaccactgggtgctcccaattgtcatcatcctctgtgtcctgatgggtcctgaagttgctgtgaccaacaacttccagatcagctgctattgctcttggtgctgaggcaagaaaaagcaccagctttagaatcagaaagtcagatgttcaaattctgctctgctattttcaagttttgtaacctctgtttcccattgtaaaataggacggagaatacctactcttcagggttgttatgagaattcggtgtgggtatatattgaatgcttggtgcatcctggttgggtgctgagtaacacccaatcctggataagtcacaggactgtcctgagctttgagcctcaggaaacaggtgcacagccactaggatggctcaaacaccttttcatctggctttaggatgttttcctgcccttcagttccttctcacttcagagcgaagtcatggacctgcttgatcaaggtttggcccttggtatgaggccagagagtatcccactatcctgtgccatatttaaggctttctttgttcattttaggccctagtgccctgttcccttaaggagttaattttattccctccttcatgtctgcttatgtttgaacatgtcttccccatccctacctcctatagggttctagtaattgattcctctaaggccttatgtttccctttgaagagctgacttttggaagacatctgttgactttcttccttgttttgtctcaggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatggtaaattgatacatttttttcctttcaaagctttatatttttattgagagtactttcagtgatttattttaatcttaaaatatgcttgttagagatccattatatagctgactggcctcttcaaaggtgaataaattatatatggtatggcattttaattcttagggtcattggcgcagcagctagggacttgacaaggagaaattaaggactaagttgatttattttactacttgatataaatgtaaagccctttttaatggaaccaatatataccaggaccccatatatacacacaatggaatattattcagtctccaaaaggaaagacattctgaggacattatgctaagtgaaataaaccagtcgtaggaagacaaatactatatgacttcatttatataaaatatctaaagtggtcacattgatagaaacagaaagtagaatggtagttgccaggggctggggatggggtaaatgggatgttgtatttaataggtataaggttttagttttgcaagatgaaaaattctggctattggttgcacaacaatgtaaatatactcaacaccactgcactgtgcacttacaaatgagtaagatggcacattttatgttatgtatttcttaccagaattaaaaataaaatagttgaaaacaaagcaaaacaaaaccaccccagaatcccatctggttcagctcagacacctaggtcacattcacagagacacgcatccaaaaattattgaagagaatttgaatctatactgttgggtctcaaagaatgtcaaagcagtccaattcacaacccgtaggaacacttcttaaaaccctcattccctttctttctcaatatttctgccttacaggtgcctgaagtagctctctcagctcctaaactggttactgtaaagtctgtccatcccaggcctggaccatccttgtctccctttccctcttccatgtttcattttattttgttttcatgtgacttattctacctccctcatccaaatgtaaataaaccagtcttgctcgctgcagttccttcacaactacctgtttttctgattctatctaacacaagtttgggaactgagctagtagcctcaatgctgtctgggaaacccaccaaaaacctactttcttgttccttgcccagtcctaacctacttcagtgtgaaatactgtactgttgggcttgtgaagccttccagggtagagaaaggtgccttcacagcactgtggggggctggggttacattagtattgggctcaacttataggttaatggcttgggtcacctttaaaatggacaaacctagaactaggtccatttctgaatctgctttctggcccatacatgtgaagacctattacaggatggagctgaaactgactcagacttcatgttaactgttacgctggcttataccaggtgaatggaaatgccttttactagagctgggtgtttacaaaaatatctacttttttagaatataaaatgcttatttaaaaagaagtgaggaaatataccagtgtggtctctgagtaagaaggtcatgggtgaattttattatgtgatgtatatattttctaaatattctaagttttccacagttagcgtgcataaaaaacgcttagtagtcataaaaaaccaaccaaccaaccaaccttatttccttcccacttgggcttttggagttggctttggtttaacctttggattgctatagctgctggtcagaattaaaccatgtgtctacttttctctcaccagacagtggtgcactccatagagctccaagcaactgatgggcatgaccgtccactcaccaactgctcgatcatcaacagtggcaagatagacgtgaaaacgccttttgtggttgagatcgctgattggtgacacaactggcagaaaacaaggatatgctttggcaggggtgtgtgtgtgtgtgtgtgtgtgtgtgtgttgtgttgtctttcaattatttgcttttttttttttactttctttttgtattctatcccagatcacaggaaagttataaaaatcaaaccgtcaccctttagtttgcttgaactttagtaaaccacctgcttagggactttgaacttaaatatatccccttcctcaagtggtgctattttaaaactaaaaaaaactttgaattggctatttttttaatgcaatattttttttctgaattcattatgatccccatattgggtaatgctgaacatttatctgaaacagatgaggatattattattttgtatccaaacagaaattcagataaagggaaatttgactagtgtaatctgagatatgtcatagggatttctttctgacaaaagggtgctttgctgttctttatattaaatacttttagatcaa

SEQ ID NO: 36622 - DNA, 13348 bp, Homo sapiens; identical to SEQ ID NO: 36621

SEQ ID NO: 36623 - DNA, 66488 bp, Homo sapiens
cgagggaagaggccggagggagatcgcggaggggagggggcgggaggggggtggggtatcctgagtcgtccgtggtccggagtctggaaggccctagagcggcgccagtcgacccgcctcgccacaacttgcccagaccagacacgtttcatcctgcgccctgcaagaaggagccggcctgcctctctccgctttgctgctcctcggcctccgcgggcccggcccgcgtcagcagcgaccctggggtctgggtcccctgtgtcgcccccgcccgcctgcagcgcccggcacccgcccaggagcgcgcagctggggtgagccgagaccggggatgcgccaggcgcccacaggaggtggctgacggggcatcccgatacccgcgaagccggccctcctgcctctccaggctgcgagccgagcctctgcagatccagctggagtagccgccgctgcccccactgcctgtttgccttccaaggaagggcgccgaggttcccctggaacccgcgtctctcggcttttgtctgctggttcggctgcccggcggtgccatgcgcctgggacttgaggcgccgcgcaaggctgggggccctgcccgggatgggggagggagggaacgggaaagcatgcccccttctttcctgttccggccatcttgtgaccgagatccacgcaaggggaaaggggtggtcagcggcacgacgccccacgatggagtgtggcggccaacggagatgggtacctcgggcccgcaggcctctgcgcccagatctcagcgggggcgcgcgggccacccccacgttcagctctgaagcccttggcccagatcatgggttaatcgttctaacaggccagaggcagcaaaaataggagggataaagggccaggagctgatgtttccttaactaagcgcctaagtcattcgatcgttcttcattcacgtgtccattcagcaaattctgaacgccttctccgtgcctgtcctctgctaggttctagggacgtatacttgagcaagagagaccacagctcttgttcccgctgatcctgcagcccagtggatggagtccagaatctacagacctgccaggtcggtgtcttgatgctcttaaacagatggaggaagctaagtcttagagctgacaatttgttctagatcagggagcaagtaagtgacagaatcaaactttgaaactatttatgtctttagcactttttatgcctggttgcagggaataaaggccaattaacttggacatatggtttatttgaaaccatatgaagtgcgtgttttatttcctggatgtttttgcatgggtttatttctagttaacaatatcttgaaagtgctaaatatatttgatattacaactttgcttccagttactctgaattgtattttcctttcttctgttcacatatttggatgttaggaaagaaaaaaaaattcctgatgtctggtccaagcaggaattccccggtggattggggaatgtctggcttttcctcagcttattgatctctgtggtaaccactggaggcccccagaagacccatagaaatgagaggcctgaggtctacaagtcgctgctagaaatattttagcctctccaaagcccagaatgcagccccgacccaagtttgtaaggtaaataccatggccctgtaaaacttgttggtaaagctgatggctaaaatccccctccatctgtttctaccttcagcattttgagtatgtatccttttggaaagacaggtgaagtattacatattttggggagttctttggttcgtacttttatcaaaatgttatatttaggctgctaacctacaaaggaagaaagactccatttaaaaagcaacttgggtgtcagaaatctagaaagcctgccatcaaatatgattaactgcaaatttcatttaaaaaacaactttattgagatataataaaaatgtacccttaactttaaggacacaattcggtgaatttggccaagtgtatattgctgggtaatcaacaccacaatcaaaatgaaaaacatttctgttatgccaaaagcttcctcatgcccttttgcagcgagtccccctctatcacatttaattatatatattttattgcttaatgttttctaaatcgtgtgtaaaagatgaggatgaatagatactactttttttttctttttctattaatgatggaatgaatagatatttctaatttcaaagcctaaggccagggctacagtgaataaataaccaggggatggcagttaagaccaaaggttcccagggatgtggctccccacgcctgccttagggacatggagtgtccagccccaaacgccagggagggtggcgccctggggagccggtacccaggaggtaccctcttcgggtgaacggctgtgtccactcgggctcgtccaagaggtcttctctggtcccgcagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatggtaagaggcgggaggccggggcgcccccgacggggatgccgggctggggagaaccggggcttccccggacccccagctccccagcctgcccgccccccatccccgcctcccgccgcgctctctttgtgccccccgcagcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccaggtgggcagctgtgtgtgagcacgattcataatccagtaaacaactcagttcccatttgataggcctgtcccgtatcaccactctttcttcttaaagatttatattgtatatcagaagacacagtatatttaagcaaaaacagtcatttaaccaacaaatgtcatggttcattaccttctgcagacaatcaggggattaataattaaacaacaaatgtcgtctgtggtgctttatggaagttatctaaatgctggttgttgaaacactttcctcctccgaatcaacctcaacatgaaaaaaccatatacaaattgctgttgaagccagtccccaaacgatgcagaatgtttaaatttgtagggtctttttctcatttttataaattttgaaatactttcaaactgacagaaaagttgccaggagactgtaaggaattttcatgcgcccttcacccagattcccccattattaacattttccacagtccctctatttctgtatacatattattattacttttgaaccatttcacagtgagttgcagatcctaaatatttcgatgtgtatattttctaagaacaagaacattcacttacataacagtatttaaagaataaaatatttttatcttctggtcttaatcttctactgttttgggttagacattgagtccaagataaatattgcaatttttgagtataacataaaccaatgtattttttttttattgactagttggaggaagtgcagaaggtataaacaatgattgagaaagatattgaagtaagcaacagattaacaagattgatgtcatgcccttactttctagtcctttcggctgactatggcttaaaaggcctcactggatttaggaatagtggagctgatgcatgaatgctggagagaactgggtgcagggcagagaaaatggtgcagttaatattgctcaggactgacccagcaggagtgttgagtgttcttaagataggggaacagtggccgggtgcagtggctcacacctgtaatcccagcactttgggaggccgaggcgggcggatcacgaggtcaggagattgagacccgagaccatcctggctaacatggtgaaaccccgtgtctactaaaaataccaaaattcgctgggcttggtggcatgtgcctgtagtcccagctacttgggaggctgaggcaggagaatcgcttaaacccaggaggcggaggttgcagtgagccaagatagcgccactgcactccagcctggcaacagagtgagaatctatctcaaaaaaaaaaaaataaataaaaataaaaaagataagggaacaattaggaatattattagaaggacttagtgtttggtcttgggtagacaaccctgaggtataatcttcaaatgacactgggcattgctaattgcttatttgttttataaatgctgcttaaaaattaaatatttacaaatagtgctaagatggtttttttcttgtgcaacgaatataatggattctatttaaacatttttaaagatttattatagtccagctttagcagccatctagtgaaatgttaaaacctctaacatacagaaattgtatgtttataaacttttttttccttttttggggttactatagaaatggctgttataagagaagattttctttctttctctttctctctctctctctttttttttttttttttgagatggagtctcactctgtcgcccaggctggcgtgcaggggtgcggtcttggctcactgcagcctccttctcccgcgttcaagcgattttcccacctcagcttcttgagtagctgggactacaggtgtgcaccaccatgcccagctaatttttgtatttttagtagagacgaggtttcaccgtgttggccaggctggtctcaaactcctgacctcaagtgatccacccacctcagcctcccaaaatgctgggattacagacgtgagccaccacacctggcctaagagaagattttcaaatgtgaatgataagtaatgattaaaaggtaatgactcaatttatcaaatgagtgacacctactactttttcagctaccagaccttggcaagttgctcaacctccctgtgcctcagtttctactctgtgaaatgggaatattaattgtacctaccatatagcagttgttaatggggattgaatgacttagtgcatagactgtgcttagagcagtgcttggcatgtagttagttattgttttagctaatacctgggaatgagggaaaaacgttttgtggcatgacaaatactaaagctgacttactacaaaatgtgaacaatcatatgactgctatcatgtgagtttttctttcttcccctatacagaaaatccaaagcctagactccttgttctgacacaatgattgggtccaccgcattatcagttttacctttgagaaattgtggtctcattctcattctcataccacttctctttgtctctactccctttgctttaagaaatcataagaactgagtagctgagacaaaaaaaaattaaagatgcctgttcttgaaggcttgaagacacagacagacagacacacacacgcacgcatcctaatgggttttttcccccatggggtgtgcgtgtgtgtgtgtgtgtgtgtgtgtgttgtgtataaggggggtagtgatggcaatgtgtaaggtctttttcctcaatattttatttaaaaaatttaaaatgcagaaaaattaaaacaacaatatagtgaatacccatatatgggggattttaaaagaaaaatctcatcgattttcaaataaaaattagtactgaaatattataaacatacaaaaaagtgcatagactaatgtaagacataccatatacccacctcttagatttaactcaggttaggctgggcgcagtggctcacacctgtaatcccagcactttgggaggccaaggcaggcagatcatctgagatcaggagttcaagagaagcctggccaacatggtataaccccatctctactaaaaatacaaaaattagccaggtgtggtggcgcatacctgtaatcccagctacttgggaggctgaagcaggagaatcacttaaacccaggaggtggaggttgcaatgagctgggatcacgccattgctctccatcctgggtgacaagagcaaaactccatctcaaaaaaaaaaaaaaaaaaaaagattgaactcaggttagcattttgctatatttccaagatagcaaaatgtttaaagagttttaaacatcttagaaataaataattttcccttcctcgattctcagagaaaatctgtttgactatatccttcctatttatgtttatgaacatataaaatatttttatgaacatatgtattcataagacagtgtttttaagtttgaaaattttctataaatgatattatacttatagatctgtactaatctgccaaggctgccataaaaataacacaggttagatggtttaaacaacagaaatgtattttctcacagttctggaggctggaagttgaagatcaaggtgtcaacagggatggttcctggtgaggcctctcttcctggcttgtaaacagccaccttcttgctatgtcctcatcacatggccttttctgtgtttggagagagagagagagagagagagagagagagagagagagagatcgctaatgtctctctctttttctttttttaaagtgaaggggtcttgctatgtgcccaggctggccttaaactcctaggctcaaatattctttccgcctcagccttgcaagtagctgggactacaggtgtgagccactgtgccacacttaccctatcagattaggccccccgccttatgatcttatttaaccttaattatctcattaaaggcctcatctccaaacacagtcacagttggagtcagggcttctctcccagtttggagagttacactatccaggttggtaacattcacattctcttactcagccataatgtcttacttgtttttttcattggttttatatttatgtgctcattcaaaatcctttcacctcaacatctccattcttgagtttctcattttgaattatctcttaattcataggattgtcaaaatgatttgtcttacccagaaggcccaagagtgctgcatttcttcaactctatcaagtttgaaagacatattggatgaagaatattcttagtcacactttccctctgaactttttgatgtggttcctttgtcttctggcagtaaatgttgctgtgagaagtttgagggtggcctaaagtttttttcttgtgagtgacttgctttttctgcctgcatgactgaagagtcccttctttctgcttgaagcctagtagctttctagggtatgtcttggtgttgagtgttctgtatcagttttccctggaacctggtgaattcttaatctgcagattcagctttcactgcacttcagagaaacactcttgtattcagtctttaaattttgtttcatttttggcttctctacttctgggaaaccagttacctttatgcagtattgattttgtccattagttctccgtactctttggtttctttctcattgctttaattctttccttctaatctacattcactgtgataaattatgtcagcctttcctttagtgagcaattcagttttcaacagtgtctcttttattccttgctttctcttttctttttttctatttttttttttttttttgagtcaaggtcttgttttgtcaccctggccccgagtgcagtggcgcaatcttgtctcactgcaacctccacctcccaggttcaagcgattctccggcctcagcctcccgagtagctgggatcacaggcatgtgctaccacatctggctaatttttgtatttttagtagagacagggtttcgccaagttggccaggctggtctcaaactcctgacctcaggtgatccacccaccttggcctcccaaagtgctgggattacaggcgtgagccactgcacccggccctattccttgctttttcttatttatttgttctgcaatgatgtttcagatcttttttttttttttgtattttatctttctttttaaactcattctggttttttaaaaaatcatatcatttttatagaatgtatgctactcttatgttctgtgatgtgaatagattgtgaagaacatctttagattcctttcttaatttatagatcccctgcagtaagctttatttttgcatgccatgtttttcctcccttttcctccctccctccctcccttccttccttcttcctaccttccctctttccttccctctttccctccctacctccttacctccctacctttttttcccctcctccctttgacagggtggtgtgtttgcatcctctccatcatcactgtgcatttctctcatcttacacttacatgggcagccctgctgaagcattctacttgccctgatagagtggccgtattgcagtttgaaggctggatggtctctgtctctgttaggaacagtatcgttagaacaccttctggcaacatgtgaactctggggtggggtggggagagagggaggcatagcttcctcttcctttcctttctccagtgctgtacacagcccgagagcctatatgacttacatcagagctggtgtgaggggtccctaaagttctataggtgaaccaaagctgtcatgagcccgggaggttgaagagatgctttagggattctctgagatgcaataccaagaaatataccagaatatgactgggcaccgtgggttacacctgtaattccagcactttgggaggccaaggtgggtggatcatttgaggttgagagttcgtgcccagcctggccaacatggtgaaactccatctctactaaaaatacaaaaattagctgggagtggtggcgggcacctgtaatctcagctactcaggaggctgtggcaggagaatcgcttgaacctgggaggttaaagctgcagtgagccatgattacgccactgtactccagcctgggtgacagagggagacacttaaaaaaaaaaaaaaaaaaaaggaaatatgcagaatgttagttttagaaaccaaagcctgaagtctggatgcagttacactgattaagagtaaggcagcatggtgaacaaaagaacatgttcagtgacacaatgggcatgaaaagagcaaaatccaaatggagggaaactctgcaggacaagcttcagccccttcagcaaaaggatagcaaggaaaaaaaagaggtggaggggaaacctatagactaaaagagtgttaagagacataaccatcagttacaggatagggatagggtcttatttggatccagttattaataattattccaaaacaaaccgaatgttttttctaagacaatatgtgaaatattagggaaaaataatcaaattaataaaaattaaaaattatccaaatagttgaatatttgttttttaaaaaggatttaatttttatattttataaggtggaataatggtattatgatttgtgttaaagtcctgtcttccttttagagatacattctgaaatatttacaaatgaaatatataatatccaggatttacttcagagtaatccaggggtgagtatatagatggaacaaatgggatttttgcttaaaatttcaatcagtgtaaaagtagaaaaacagaggtatacgtggaattgacttcttttttctcagaaaatttattttaataggttatacttccaagcttttgttcattcatatattaagcctgtgttctggggagaaagctagaggccctgccctcagaaatctatattctaaaacctggagggactgggctagagacaataaacaagtgaagtacacaaacgtgaaaatattagccagtgagatgtatgaggatgaaaagaagactacgtgatgtgacagagactgtgacaggcaggaggatcttgaggattttgttgaggacatgctgtcatcctcagcgtggaagatgcttgatgaatgacatcttgaatgtcaggagaaggtgccagccatgggaggagggtctggataagatcaggcaggggcaacaatgaatgcaaagcctctgagattggcatggctgcaggacagaaagaaggctggtgtggctggagtggcaggggcaggttgttgttgatagagtggaagctgtcagtctaacaagagcagcatcaggggctccagaaagcagcagaagggctcctttaactgtcaagaggtagttttcactgccttgtcttcagtttgggaggaatgccctggttttatttttatttatttacttatatttttactttttgtagagatgggctctcgccatgttgcccaggctggtctcgaactcctggctcaagtgaccccccaactgccttcggcctcgtgctgggattacaggcatgagccactgcacccagcctggtttcatgtctcgtctattagtcatgctttcagtatctcttgctaggatggtatcgttcagcgagaaagcgcccaagaggtagtgcttcaggtacctgaattttttttttttttttttttttttgagatggagtctcgctctgttgtccaggctggagtgcagtggtgcaatctcagctcactgcagcatctgcttcctgggttcaagtgattctcttccctcagtctccctagtagctgggactacaggcacatgccactatacctaattttgtatttttttgtggagatggggtttcatcatgttggccaggctggtctcaaacttctaaccttgggtgatctgcctaccttgacctcctaaagtgctgggattacaggcgtgagccacagtgcctggccaggtacctgaattttaattgcaattaagtgggacgacagtcgttacagacacttggatttgttgctctctccttttcagtgccatttttgtgacaaggcctttatgaaccaagcttttctacaaagtcacattcaacgccgccacactgaagaaaattctcattttggtgagtaatgagttctgtttgaaagctcttttcttcctgctccctttttcttttggcaatgagacttggtccagtgcatttcccagtcctcttaaaagaagcatcacggtccctgtcaattcagtaagtaaatatggagccctcaggaggtgcatacagtgcaccaggtgctggagatacagccacaagctgaacggagaagccccactctctctcgagttttacattctaaagggggttgaggagacacatttaaacagataaatgagtaattaaacagacaaatgagtaattcttctcaaatggtggcaaatgcgatgaagatcatagcgcaggacaatggggtagagagtgactccaggtggggtgaaagtctcagaaaagtgtgtcacaggccaaggaacactgactgtaagggacgtgaggtgtgctgggatgatgtgtttgaggaacagaagggctggtggaatggaatagaataggtgaggtgatggtgtgtggtgaggctgaagtgctgggggcctgatcacaggaagccgtgaaggcgtgggctggaatgtggagtttttatatgcgtaaggtggagccactggaggattttaggtaggggaagggcatgatctaattaatgtgtaccttagcatgacccttctagctgtggatagagactactgttggggcgacagtggaagcagtggatgagtgaggggaggaggctgcaatcgcagccgaggtgagagagacgggggcctggaccagctttgtccccaggcaggtgggcaggtgaagttgtaacagataagttgtggacccagaagctacagaggaccctgggtttctgtcctccatgtttgggtgaatggtgatgctttctgtgatggagggccagggtcgggaggcaatttcaaggaggaagagggctgagagtttgtacttgccatgggtgcgtttacatcacatgtgcaacagacatgcaggtgggggtactgaagggctgcagcttaaggtggagacccaggctggagatttaaatctgggaatcactggagtagagctggtctggctgaggtcacctagatagagaatagaaagtgatgaggtcagccccaaggtcttcccaatgctaggagctcagaaagagcagcagcagagagtgaggaatagtctctagcaaagctggagggaaacctggggagtgtgttgtcatggaaaccaagggaaaagtatttcacagaggaggcagtggtcagtcatatcaaatgccgctgaggtacagagtaagatgaagactgacaatggacggctgttgtcaagacggttgttggtgaccttggcacagcagcttcagtagacagatggggacaaaagtctgattcccctgagctgagctgagtatcatgagggagtggtcctactgtatccagacattggtttcaataacacttattgggaaggaaagcagagacatgaggcttcatctggacagaaatgtgagacccagggacaactttgtttcatttgatgtgggagatactaagatgtgtttgggtgtgcaccaccgacaatatagatggtatgcaaaatgaagacgcaagagaggggaggggactctgaggcttaccaaggagccaggttttctgccattgaagtattctcaaaagcaaagaatgtaagggctctttctccatgggcagatcaaagcttcctgcagattgccacagtaacccacagaaattcttatttttatcgttttttgtttttttttttgagatggaatctccccctgtggcccaagctggagtgcagtggtgccatcttggctcactgcaacctccttctcctgggttcaagtgattccgttgcttcagcctcccaagtagctgggactacgggcactcactaccacacctggctagtttttgtatttcttttttttcttagtagggattggggttttgctgtgttgcccaggctggtctcgaactcctggcctcaagtaattcatcccccttggactaccaaagggctaggaatacaggcgtgagccactgtgcccgacctcattctgatcttaaatgttctcagtatctagacgtgggtacttggcttatatactcagtacctgcatttccctccagtttgggccaggttgtttccattcttgcccatttcagttaaatagattacttaggaaatagctaagcttcgtagaaacaaaaataacagcataataatctcattaataagtcttgaatcactgataaaatttagcaatattttggaaagatgaaatattttaattaatctaccattcttcagcgtgaaactgaccttctttctcttctgtttcagtatcttattctaactcatactcgtttcagagagggtttcagactctgaaacgagtattatttcttcaggtcatctttgagattctgactttctactttggtttccatacctttcatgtctacactcacagacacatgtacatccattcagtcatgtgtacatctgcatgtaagtacatgtacataagtattcttcctttcacttgttgcttccttttacaacttttcagtacctcacttctaccccagttgatagactatggcccaagtttgcattttgaatgccccccaagtcctctgcttgtattagcactgatggggtcctcagaagagttcagcgggcacctaaaggatggtgaccacagagatttcagtatggtggtgcctgcagaggaagctgttgcttgccttctgtgattgagacaggcacctctaagaaaagcccagagtgccactgggtcaaagcaccctgtattattccttgttaccattattgctccctgaagagggctctcatgtatctatgtaggataatccaacctcaacacagcggctgaaagaatctgctaaaaaataattcagtgccccaaaatacactgggctccaaataaactaaagagcaaaaattggctcatgtggcatgaaacaagtaatcgtatcccaagtaagaggacagtttccttcgtgttatcaacaggactgtaccccataagtttccaggtacatttggtaagagatggtgttttaacacgattttctgttgcaacagagtatcagaaaaatgcacagattgagaagctccggagtgagatcgtcgtattgaaggaagagctgcagctcaccaggtctgagctagaggctgcacaccatgccagtgcagtcagattctccaaggtaccaggcagaattctgtggtattttaattacaattaactgtatgtaattcaattatgccatggactctaataaacagaggacacttaagagtttgtgaatttgacaagatgattgcattttttattgccaatctactctttagtatcttactacaaagcacatcactggaaatatatttctctattttttgaaagccttttagaaaattggggtggaattcatataacacacaattaactttctaaaattttgcttagaacagaagtctgacacttctcattctcactgggctaaagtcaaggtgtcaggaggaccatgtgccttggtagaggctatagaacagaatatttcttgcttatttggttgctggcagagttcagttcctggcaggtgtagaccagaggtctacactttcttccaggctgtccattgagggagggctgctcctaatttccttgtgaggctccccatactcctgggctcctgaccctcttcctccatactcaaagccaccaacagagggttgagtctccctcatgcttccgatctgtttccttttttcttttttctcatctatgtgacccttgtgtcagcccattgggtgcttggaatgacttgttcagagatactcggggtgatgaagggcccaagaggaaagaggcccatgattcattgagttctgacttctgtgggtcactgtgggtacaccgtgggtaccacgtatgccattgtttatccaacagagggttgaccttggtgtacctaatggagagagtaaggccatcaaagagcatttatttccttgtgactgttggagtgacagtgtgcttggctcttccttgtttcccccatggggacagcaagtgtgactttctagggataacagcagtcatttcacagaatcattgacagaggcttctgtcttccacatgggctcactctttctctttctttttaaattgtaatatacctataatgtaaaatttatgattttaactatttttaagtgtacagttcggtagtgttgagtatattcacattgttatacagccaatctccagaactgttttgtattgaaaaactgaaactctacccattaaacagtgctccactcccccctccttccagctactttccctctctgtgattttgcctgctctagatacctcatatgaatggaagcatagagtatttgtctttttgtcatcattggcttattttactcagcataatgtcctcaaagtttatctatgttgtagtgtgtgccagaatttccttcctttttcaggctgaatgatagttcatggtatatgtatgtataccacattttgcttattcatctgttattggacacttgggttgcttccacttcttaactattatgactgatgctgctatgaacaagggtataccaacatctcttttagacagtcattttacagtgtacaatccagtagcgtttagtgtattcacaatattgtgcaactaccatctctctagtttcaaaactttcaacaccccagaaaaataacccatacccattaaataatcactcctactaccctcatctcctggtaaccacgaatctttttatgtctatgaattttcctattcagtatatatcttttaaaaaaaaatatgtacaccacgtgtggtggctcacaactgtaatcccagtattttgggaggccaagatgggaggattgctcgagcccaggagttcaagaccagtctgcgcaacatggtgagaccctgtctctacaaaaaattaaaaaattagctaagtgtggtggcatgcgcttgtggtcccagctactcaggaggctgaggagggaggaagatggcttgagtccaggaggtcaaggctgcagtgagctgtgttcacaccgctgcaccccatttggctacagaatgagaccccatctgaaaaaaaaaaagtaatgtgtgaccttttgtgtctggcttttttcacttagcatgatgttcttgaggttcatctaagttgtaacatgtatcagtactttgtcggtcttgctaatattccattgtatgtaggtatgcatagacaatttgtttatccagtcatccattgaatgacatttgattcattttcaccttttggctctaatgaataatgctactataaacattcatgtggcagtttctatgtggacatatgttttcatttttcttgattatatacttaggaatggaattgctgagtcatatggtaattttatgtttaactttctcaggaaccaccaaactgtcttccacagtagctgtaccattttacattttcaccagtaatgttcttatttctccacatcctcaccaatacttgttatacttttctgttttcttaattaaagccatcctattgggtgggtgggaagtggtatctcatcggagtttgatttgtatttccttaacaaccaatgatattgaacatctcttcatgtttattttccatttgtatatatcttagttggagaaatgtctattcaaatcctttgcccattttttaattgggttgtttgcctttttcttgttgagctgtatgagttatttatatacactaatagtttcatcactttagctctattaggtcattggtctattttgagttaatttttgcatgtagattgagagaggggcccaactttatacttttgcatgtggtttatccagttgtcccagtgccaatttttcaagagactattcttttttcattgaatgttcctaacatccttgttgaagatcagttgaccatagatgtttgggtttatctctggattctcaattccattcccctagtctgtatgtctgtctttatgccaatatcacacaactttgattactgtagctttgtagtaggctttgaaatagataagtgtgcatcttccaactttgtttttctttttcaatattgttttggttatttgtggcctcttacagttgcatatgaaattgaggattggcttttccatttctgcaaagaaggttattggaatgggattacattgaatctcttgattgcttaggagagtattgccattttaaccatattaaatctaccaatccatgaacatgggatgtctttccatttatttaagtgttcttcaatttttacaacaaaaattttcagtgtacaagtctttttcaccttttaggttacatttatttctaggtattttattctttgggatgctattataaatggaattgttttcttaatttctttcttggattgttcattgctggtatatagaaatatagctgctttttgcatgttgaccttgtactgtgcaactttgctgaatttgtttattactttagtcgtttcttatggattctatgttatttttttaaaatagttggtagaattcaccagtaaagccatctggtctgggacttttcctttttaggaggttgttgattactaactctatccctttatttattgaaagtctattgaaatttcctttgtattgggtcagtctggtcatttgtgtaggaatttgtctatttcacctagattatccaatttgttgctgtacaattgttcattatattctcttacaatccttttaatttctccaagattggtagtcatgtcctcactttcatttcttatttggggtggctgaaggtttgtcagttttgttgatctttgtaaagaaccaaattttggcttcatctattctctctgttgctttcctgttctttgctttatctttgctctaattttcataatttttttctttctgctgcctttgagtttggtttgttcatctttttctagctaggttatttatttaagatttttcttcttcttctatatttgttttttggagatagactctctctctgttgcccaggctggagtgcagtggcacaatcacagctcactgcagccttgacctcccaggtccaagtggtcctcccacctcagcctcctaagtagctgggattacaggcacgtaccaccatacctggctaatttttttttttttttaatttttggtagagatgaggtctcacaatgtttcccaggatggtctcaaactcctgagatcaagtgatcgttccaccgtggcctcccaaactgttgggactacaggcatagccatcacacctggacctttcttctttttaaatgtaggctcttacagctgtaaatttatttctgagcactgatttggctgcatctcatgaatcttggtatgttgtgttttcattttcattaacctcacagtatcttccaatttccctagtgagtttttccttaacccattggttgtttaagagcacgttgtttactttccacgtatttgctacttttccagttcccttctgttactgatttctggcttaattctattgtgatcagagaagaatctttgcatgattttgatctttttaaatctgagaaacactttatggacttaaaaaaaggtcttcctggtaaatattccatgtgcacttgagaagaatgtatattctgctattgttgggtacagagttctgtatatgtgtgttagggctagttggcatatagtgtcgttcaagttctcaatttagattttaaaaaccctgaaggtcattgagaaatcaagtgctgaccttgaatttagctcctgtaaatctgaatttgtattttctgggggtgggatgaagttacactatccaaattgttatggtgccaacaaatgttcttttattgctcaatatatgttttctttaaagtatatttacattttatatattatggcatgacttttatacaagttcatagaacacaaaaagctggaggctttgggcgtctgtgttggtattttaagggatgtaaggacaagaggattctgtgtgctgcctttagtttagaaaaatcattgtgcacagacctgccatgataggaaatgttgttacaagcctcactgaaataagcaatactagctaacatttttgaagtgatgctatgaacttttattttaaatattgcttattttcttcagaccagaacttttaaagatgtgtattaaaataatttcaggaatatgaaatgcagaaaacaaaagaggaagactttttgaagttatttgacaggtggaaagaagaagaaaaggagaaactagttgatgaaatggaaaaagtcaaggagatgtttatgaaggaatttaaagaattaacttcgaagaattcagcattagaatatgtaagtattaaacctagaagttcttatggtattgattgccttgagaggtggtgttaggatggcattaaggccaggggatccagcagttactttatgttaccctcgtgcagacattcttctccctgagagtcttgagggaggcatagaggagacagagtgagtcagagatgttttgctgagaatgggagctttggccttaaacttcagtgcagaacactcgtggtgagatatagaagaccctcttctatgatggtccctcttttcttatctggttaggttagccttgaactgtaaactcctccctgagttttggaactttccattgtccagtgggaagggaaagaagcagacccagaaaggctaagaacctttgccaggctccctcctcaacccaggcccaggtggggtctctaaagcaagcaagttatggctaagtgagcccctctcccttgtgggaacagccctggtccatacagccccagcctcatgcatagatgatacctgagctgcttctttagaaagcagccaatcaatcagtgtccttctaagaattctaagctccctggttagacttgacctgagtcttctttggggaaaacggagaaaggaagggagctgagcgaaggtccttgagctccctctaggggccaacaagttttataaacgaaaatagagatttttggaattcacctgagggctttcctaaaactctttaaactctagcgtgagatttggcgaatggcccatgaaccaagtccagcataccacctgtttttgaatggcctctgacataagaatagtttttacatttttactttttatttttttcaagacagagtctctctctgttgcccagtctggagtgtagtggcacaatctcagctcactgcaacctctgcctcctgggttcaagtgattctcgtgcttcagcctcctgagtagctggcgttacaggcacatgccaccacacccagctaatttttgtatttttagtagagacggtttcaccatgttggccaggatggtgtcgaactcctggcctcaagtgatcctcccacttgggcctcccaaagtgctgggattacatttgtgggccactgtgcccagccagtttttaaatttttaaaacattggaaaaaaagaagactattttgtgacacaggaaaatttcattaaagttcacatttcagtgtcatgagtgaagttttattgaaacacagccatgtttggtaatttacgctctgtctgtggcatttttgtgtgggagcagtagagttgaatgttttgtctgagactttgtgttacgaatctgcatgacttataactgttgctattgaccttggctacctggctgtggtagtgtttgtcaggtttctccactgaagattttctcttttttcctcctttccctgctgtcctttctgaaatgaagtcactatgagcagcctacactgaggagaggagacgtgcgctcccccatacttttgtttttgaagttaatgtgttaccttctgtggttttctgagggtttttgccatgagtaacattgggaataatatgaaaagaaaagggtaaaattaaaaacgttatgtccccagtggatttactgatgtggtccctggacagtgttggcctctcactaaactagcttaagaaccaggtgcattcagttcttctgtttctggtacctattaagtgcccataaaaaattttaagccccagctgggcctggtggctcacacctgtaatcccagcactttgggaggctgaggtaggcagattgttgtgtgagcccaggagtttgagaccagcctgggcaacatggcaaaaccctgtctctacaaaaaaaatacaaaaattatctgggtgtggtggtgcacgcctgtagtcccagctacctaggaggctgaggtggaaggattgcttgaacccagggggttgaggctgcagtgagccatgatcatatcactgcactctagcctgggcaacagaatgagaccctgtctccaaaaaaaaaaaaaaaattagactcgtttaagattagaaagttagattttccttccccttttttcaccctgtacatattctgataggaagaccagcaagcagtagaaacaaaccagtaaaaccacagggaagcagaagcaggagaagcgtccaagagcgtccaggagcgtccaagagggcagtcagatttaaaacacagctatgtgctccctgattttattctctgtttccatcttatgaaagtctaactgtagtactgagcttgaattttatcttatagcaactgtcagaaatccagaagtccaatatgcagatcaagtccaacataggcacattaaaagatgcacacgagtttaaagaagaccgttctccatatccccaggatttccataatgtcatgcagcttcttgatagtcaggtacgtgcaagtgggtgacagctgcagtggatgccttcctttttcttagtgaagtaatttacagtgagtgtcatctgcagaaaaagtgtttgtcttttttagtaaccctgaaggtgactagctgttatttttctcctacagcatgcctaaatcataagaggtgtttgttacatgcttgctgttggcaaatagcatacacaacagttggcagaactgttttgtttcttctctccataaagtcaatttgaattggttagtataacctagctattcatttttcatctttcagatgtagctctcaatttcaaaaggtgtagaagggcatattgaagcaccagatttaattttagagtttaaatatactgctaactgtatttttagtagaaacggggtttcaccatattggccaggctgatcttgaactcctgacctcaggtgatccgcccacctcggctcaattaactgggcgtggtagcagatgcctgtaatcccagcttctcggagggctgaggcaggagaattgcttgaacccaagaggcagaggttgcagtgagctgagatcacgccattgcactccagtctgggcaacaagagtgatactcagtctcaaaaaataaataaataaatacacacacacacacacacacacacacacacacacacacacacacacacactgctaactggtcagctgatgatctgttacatttatcaaacataatcactttcatttggaagtgacagcggtttaggggaacaatttttttaaactaggaagcaaatagagatgagagcttatgaattcaggattcttttttaaaagcctgggtcattctaaaaaaggtaagtagactttggaaacagggaccactgcttcttgcttcagtgctcacatgtttcctccctgacccaaatctacctgctccactgcagtcaggctgaccatgtccctgtcctgtctgaagtccttcagtgacccttattccggacttcctaccagcacgcagggtccttcggattctgggccctgggccatctttctctgttctttgctttcctggcactccagcggcccagcagcccatgcctctcagaacatgcccttctgtctttttcctcggttctggctgctttcctgcctgtcctgcagctcccagttttcgggacctgtcttttactcattctttagtattcagccaggggggcaggtaccgctttcagaaagttctcctgagcctctaggctatagcatttctgtagtccctaagtgggatctgatgacatacacattatatgtggattctccatggctgtgtctactcgcctcccgtgcagagcagggcctgtctttttatcttcttttagcctgccagtggccatccagtgaggtgcctggtatatggtaggaaaccaggagctgtgtcctgaactgaactgttgacagttgcttccagcaggctgtagactacagctggtcgctcatgaactgaaggatgtggctctaaaatcctaaggtcccacctaaatttcttctgtttctgtcctgtgagttgtgttgtcagttcagaacccatggcctcagaaaccttggtgtttccttttggcctcttaggttggcaaactagcacctccttttgcaaataaagtgttactggctatgtcccagtaacattttatgagtgctagttcatttacatcttatccatggctgttgtcccaatacagttgtggaatgacacagctgtattgtgttgtgttgtgaccaagttgtctggcccccagagcctatgatatttactgttagctccttactaaaaaatttttcctgacccctgccttatggtaaaagattaaaaccagatgcaaatgtatttaagcatttttgactgtgtatattctaaaaaataccagctgtattagtctgttctaatactactgtaaagaattacctaagactgggtaatttataaagaaaagaggtttaattgactcacagttccataggctgtacaggaggcatggctggagaggcctcaggaaacttataatcattggcagaaggacaaaggggaaccaagcacgtcttaagatgatggagcaggaaagagtgaagagggaagtgctacacacttctaaacaaccagatcttgtgagaactcactatcatgagaacagcaagggggaagtccacccccatgattcaatcatctcccaccaggcccttccttcaacacatgagatttgagtggggaccgagagccaaactgtttcactagctaaaattttaccagatagatagttgggtttcataggtattcactaaaaaggaagctcccatattgcatagatctcattgttacagttgtacataaattattcttttattcttttgtaggaaagcaaatggacagctcgagttcaagctattcatcaagaacacaagaaagagaagggtcgggtaaggttaagaaaccagtggcctaaagtgggccattttttaaagaaatatttgctttcctttttaataaacataatatttgtccacttaataacatttggggagaaatgtgtagcaaaattaaaattacctataattctaacaccaaaataaccactgctactactttcttataatttgttttcttttttttttttctcatgaaacttttttaatgggtctcaaaattctgtgacaaatttttggtcaagttgttcccattaaaaagtactgattttaaaaactaataacttaaaactgccacacacaaaaaagaaaaccaaagtggtccacaaaacattctcctttccttctgaaggttttacgatgcattggtatcattaaccagtcttttactactaaacttaaatggccaattgaaacaagcagttctgagaccattcttccaccactgattaagagtaggttggcaggtattagggataatattcatttagccttcagagctttctgggcagacttggtgaccttgccagctccagcagccttcttgtccactgcttcagttttcttgtatgcatttctgtaagtgtagaacctcatatatacatagttttacaacattcgaattatgttttgtaggtttgtacacttttcactttatatatcatagacctttcctaagttttaaagtattcttcaaaatcatgacttttaatgactttcatgatgatcttattggatgtatcataagtgacttaatcatttcttcattgtcaaatacatgtttctgatttttttgtatcacagaactgcaatgtaagtaattttttaaaaaggcaagaactgtttacattaaaatcgctttaatgaaaacaaactttaattatgacactgattctctttcacctgagtacatcagaaatttaagtgttaaaatgtgtttacactagtgcaaaacatctaaagtagatgtatttgagaaggtcttaaaataggaaaacttctgtttattttttcacttgaaattgtgttttgtaccttagtatttcttgtaaatcttttctgaatggaaaaaatgtttcctcttttgcacattttctaatattacctttcttagtagaatattaaacgacaaaagatcatataatatgtatgtgtataattgcaaggatgaagtgtgttcagatgatcaaaaaatttatcagcttatatttctccaaagtggaacaaatactgaggaagacggggagagaaaaagaaactgggaacaatactagagccaaactaaagcaaacaaaaaataaaaatatttcacaaaacacctgcagttcttgaggaacttcgatgggaaagttagatattaatctacctttaagattgtatcattgctagaaaaggaagtaggaagcactatttttcctctattccatttaaaatatcatttcatcatgcaaatactttatagtgataatacacagacatacacccaatacacatatctatagatatacacatatacagtagtttatattgaaaattgtatcactgatgtggcagttcaatttaggagatatttactgagcatctgctatgtactacactttataaggctaaaaagagatgtggaacaatgcctgccctcagaccgcttacagtacagaagggagtaggagtgaggctacagctatgggaatcaggatgggataaatgcagagtgccctagggactgaacagagagagtttcttgaagtgggattagggctgtgtgtggatcatgcccatgtttacatcttcagcctaaacaactcttctgagttccagatcaggtagccagctcagtactcgacatctccatgggcttctcaagtgcgacatgcctaagatgaagttcttgggtttgttccccagacttggcaaatggcaccctcgttcctccagatgctcatcttgattccacctttctctctcaatccccgagtccaggctgtctgcagggcccactctatggaaccagttcttctgtactttcctgttgccctgcattaactaagcctccatttctgaatgggccccagggtgggtctcctcaattccagccttccccttccttagtctgctctccacagagccagcaaaataacctggctgctggccgccattctagcctcagcctgacccccccgccccaccccctgcctttcggaacctcctctttccagctatgatgactttctgctaatttctagaacattctggccttttcctcttttatacctggttttcattgttggcaagcccttcgacttgctcttcacatggctacctccttcccctcagtatgagttttctattctgtgtagcaaatgaccacaaattgagtgggtgaagatggcatgtatttctcttctcaatgtccgtgggataggagtccaggcagggcttggctgggctcagggactcacaggctgcattgagagtgtcatctgggctgtgttcctgtctgaggttccttgtggttatttgaagggctgagactatcaggttccagaggctactccttctccatagcagtgcacagcatggctgttgacttcaaggccagctagagtgtgtctctcttgctttcattctcccgcttcaggaagggcctgggacttcttatttcttttttttttggggtgagacagagtctcactctgttgcacgggctggagtgcagtgatgccatcttggctcactgcaacctccgcttcctgggttcaagcgattctcctgccttagcctcccgagtagctgggattacgtgccaccatgctgagctaatttttgtattcttagtagagatggggtttcactgtgttggcctggctggtcttgaactcctgacctcaggtgatctacccgcctcggcctcccaaagtgcaaggattacaggcgtgagccaccatgcctggcctggaacttctttcagggggctcacctgaataagacaggcccacacaggataatcttccttttcataacctcaaagtccacagatttgggactgctattgcgtctccagagtcccttcacctttgccgtattctgtggttgagaagcacaatggaggttctcctcagaccaagggacagcatcacacagggggtgtacaccaggggtacaaccttgagggccccctgagaaccctgcctaccccattgcctctggcctctgggtcctggtcacctgatgtcactctatccaagtaggtagtcccttttctttattattcccataatatctcaaacagagttctgagcactattttaaatagtttacttgcttatttgtttccttgtttattgtctatctctccaatcacgtcattggccctctgagtgaagggctctgtctatttagctctccattgtctgcccagcatccactcatgtgtctgaaatgtggttggcactcactacacacttgcagaatgaatgtggaaggtagctagctagggcatcattcagccttgttttcatagatggagaaaggctgattgtagggttcagaagagcagggttaccagagttgtctggaggtctaagcaccatctgctgtagggaggacactagtccacgtttccaccctgcacccagggagcttcccccgtggcaatgactatgtagttaggacgatggcgttcacctcccagcatattttatctatggcagctaagatgcaggatcccaggagcagtggatggtagtttctctgcaccacaggtggctccactgtgcaaggagtgttctcctttgtccccctacattacactgaagcaaaagtggcctgttcttacagttcatgtcctggtgtcctggagctgactcatatcggctctcagctgtgcacatttctcctcatcagggtgttttttttgaaagctgatttaaccagcacaactttggtttcatgggaacatttagaaataaatggatatttgtagttgccatatacttaagccttctaagagttctgtgaagtagatgctgtcactcattttacaggtgaggacacaggggcttagacagatgctgtgttgcccacggtcactggtatttgaatgcaggccctgtgtactccagggcatactacactgctggcctgtctagctccaggcactcacctgtgaagctcccagccgggaaggaaaacaggcagtgacagcttcaagtggttgcttttctgtaaggacgcaggatcttttctttggatgctctgacatggtaatccctaaccagggatgcacctcagaattacctgagactcttttccaaagtacaggtggccagctccactccctgagatcttgatttagtagataagtctggaacacatggattttggagataaacaaaccaaaagccacccaggctatcctgttttggatctatggtttgaaccactgctcttagatcattaaaatccctactcttattcttcaagccatctttctagcattggtatttagggacagaattcaggtttctttattaatcgggggtgggaaggcatttttaaaatcctggctcctttaaagctgtctgtgtttcagacagttgtgggaatttcagtggcctctggctggaatagaaagcgagttacagtttttatactttgtcattgcgagttgtgatagagagaaagacggacagttgtcatggaggaagaaggtgaggcctttcctggttctgagtggggcgcatgcctcacatactaggtatgtgggggcggatttgtgccaccactaggctgcactccttcctcgtctgttggtttgacttgtttagaagctgcttacctctcccttctttgctcttaaaccctaacagaggggtgaattcaatcaggtttagtaatctctgcctgagacctaactattaattattccacatgattggtgcctgctgttcccacaatgcacatattgtatttctctgtttagggaaagttgcatttgccaactttctattgatttacttagattcttggcaattttttttgttttaaataacattggtaggagttcacaggcagtcacagataagcgatggcatgccctttttacccaacagaagactcttgagagcttgggaggttgtcagatggtcacataatgaaggaagggaggatggggtgatgtgggccagtagggaaaaatgcatagtgcttgaaatgggatcacagaaaatgggctcatgagctgcaaacttcaaaataatttctggctatgtttgcctagaccctctccattcctttctccatgtactcttttccgtgcctttctgattcattcttaactcttctattaagaatgatgttatcccttagatattcccacatctcctttcttcctggggcctggagcaactccccatgtagttgatcaaggccgagatcctaaacctccatccagcagcctggacatttatactggcttttccttctattttccagctcagcatttcccagactgctttggaggccacttttccaggggcctgtaaagatgtagtgaaagctcttgacaatgccctccttgggggaggttcttagtatccactaggaaaggaaagattctttttaggtttcactcggaaaatctttctagattggttccacccagtgtttgtccagcctcataggagcacagagcatttcagaggcaaggctgtgcaggatgctaagacactgcttttttttttttttttttttttgagacagggtcttactctgtcaccggggctacagtgcagtggcttgagcatagctcactgcagctccaacctcctggggtcaagcaaccctcccacctcagcctcccgaggaactaggactacaggctaaccccaccacacctagcttaatttttaaaactttttgtagagacagggtcttactgcattgcccacgctgaactccaactcctggactccagtgatcctccctcctcggcctcccgaaagagcactgactttgaaacttgcatgtgaaagtttaagtctgggctctgcccaccttcggctgtctcaattagagccagtgactttacctttctagacttgagttttcctatctgtacgatggggccaaaacatgtgtccataacattgtggtgtggattcaacaaaatgaagtgcatctagtacacaatgagtgttaattttctaaaagcaagcaaatgaggaaatgctggtctaggtgcccttatatactcatctcaggcacggacacttcctgctcctttatttgatcaggataccctgtcaccacttccaggacatagacttggaatgttcttcaccccaattatgaagccttttttttttttgagacggaatctcgctctgtcacccaggctggagtgcaaagacatgatcttggctcactgcagcctctgcctccggggttcaaaaattctcctgcctcagcctcctgagtagatgggattacaggcgcccgccaccacacctagctgatttttgtatttttattagagatggggttttgccatgttggccaggctggtctgaaactcctgacctcaagtgatctgcctgcctcagcctcccaaagtgctgggattacatgcacgagccaccacacctggcctcaagccgccccccctttgtttctttttagccttctgtgtttaaacaactactgaaattgctttaagcgcctttccttcaattattgaaaacaaattcttcttgaattctttttgtccagtctatgatcttccatgacattatctctaaagatgaatatgtctgtgtgtctctgtatctctgtcctctgcatctctccctttctttccctccctccctctttccctctaatccccaccattccccctctttttctcggtaaacatctatcagtaaacatttctcagagaacctgctgagggccagggattgtgctagtttctgggaatataaaataattaagatggggctgggcacggtggctcatacctgtaatcccaacactttgagaggccaaggcgggtggatcgactgagttcaggacttcgagaccagcctggttaacatggtgaaaccccgcctctactaaaaatacaaaatttagccaggtatggttgtgtgggcctgtaatcccagctactcaggagactgaggcaggagaattgcttgaagccaggaggcagaggctgcagtgagccgagattgctccactgcactccagcctgggtgacagagcgagactccatgtcaaaaaaaaacaacaacaaaaacattaagatgtgctctctggcctaggatggcccatgtgggcatcggaaggacaggactgcaggagaaatttagtactaagggtcagagccactctgcaggagaagcctgaatcctttatcgttgctcatcatgtgttatttcgtgttatgtgctgtagttggctaagctgctcccattatcagtgttgtctatttggggacgtgagctcccttgggaacacagatgaagcacctagagcagccagggccaggatataccatgatcaaagatttattcaacgacttgatgcgcacggatagcatcaggctagcaaaacaggcagagcatgtatacctgaaatctggagaatgaagacatttgacatgcagcttacagatggatgcctttcttaactttttttcagctcctgtcacatatagagaaacttcgaacctcaatgatagatgatctaaatgcaagcaatgttttctataagaaaaggatagaagagctagggcagagactccaggagcagaatgagctgattataactcagagacagcaggtatgtctggcggcagtgtggcaccgtgcttctttaagcaacgcagtctatctaagaacatgtgtttttactttagagcatttgtaagtggtataaggtgaggaagatggaatatttttccccttgtgattgcttgtaaaagttagtgcaataaaatacatttttaaaaggtatttaaaagtaatatgttgaagatttatacagttaaagttcaaaattaatttgatttgaaggtaagtaagaatttctttcagtaattactctgagaagcagccaaatacaaatgcaactttaaaaagattttttgttattttattttagattcaaggtgtacatggacaggttttttacatgaatatattgtgtgatggtgaggtttgggtaataacttctgcctctatgcttttaaagaccacatgccctatgtccctggataatttagtgaaaaggttaatttactaacaacattatctgtccattatcccatgtgtgtgtccctatctaatttcaaatgtatcactagaagactgtatttctttgcagattaaagactttacctgtaatccattaaacagtatcagtgaacccaaaggtaagtggatgggatcccggtactggcggcaaggggaacctccccaattgcactgggcttcagaagaatgtgggccccacttgtttatgtgtgctaagatggcattcttcttgttgtattgatttcgtagatctgtcctctattattttaatttgagagatttgttaccacaacccagaaaggtgaagaatttaaaaaatctaaactatcatgtagttgtttcatttttttaatcagagtactattaggcacataatacctgcttaggagccatttacctcttgacttatacactgtaaaacagagttatgcatgtaaaagcacaaggtctgtcgacagactgggttcaactcccatctctggcacttcatagctttgtgaatctctgcctcagtttcctcagctttatagcaggaatacgaatagtgtttcagtctattttctctgctataatagcataccacagactggtatttataaagaaacaaggtttctggaggctgggaaatccgagagcatggtgctgacatctggtgagggtcaacctatggtgcaaggcatcacctggccagctaatgcatgagacagagaaaggaaattgggtcaaacgcatctttttaaatcagaaactcactctcaataactaacccactcctgccactgttgccgtgtaattgttacaatggcagttaaatttcaacttgcatttctgaggggacattcaagtcatagcaaatagtaactatatcataggcttgttatgaggattaaatgggataatatacctattaagccctcattaagtttgccattattattgatattaagctcttagtaggccaggcacagttgctcacatttgtaatgcccgcattttgggaggccaaggcaggaagatcacctgaggccaggagttcgagactagcctgggcaacatagcgagtcccccttctctaaaaataaaaaatgagctgtgcatggcagcaggcacctgtagtcacagctactcaggaggctgggatggaagaatcactcgagcccagaaattcaaggctgcagtgagctatgattgcaccactgcactcaagcctgggtgacagagtgagacccacatctcttaaaaaaaaaaaaccaaaaaactcttaattattctaaagtgctataaaggcttgctgcgttattctcaactgtggctgtttgggggttacaggtttgttctaagtttaatgggaatatgcacaacctactgactgcggcagtgatagcctgcctgtctccatatcattcaagaactctctgtctgtctctgtctctctctctctgtctctctctcacacacacacacacacacacacacacacacacacacacacacacacacacacacactaaaccagtcaagaccagggcaagagctgactttgcaaaagaaataaaaaaagagaccagaagggagactgggagccataggttcagggtcttacttctgcctagttttcttcccagtgattccagtcctggttcctgcacgtctcaggttgttgaggaatctttgtctatttgagagatgccaactaggggtggtactggggtgtatgagctgggtttcctccctcttgttttgagataaagagttcgggaaagagggttgttgttccctttaactcctcttcaaataacaagagctcaggttagggaggaatatttgcaaaattaactagatatcataaatatttgactgaaaagtaattctggggaaaatttagcttcaaaaagatgtatgttacacatatttattctcctggtgatgtgctatatattggtacatttcatttatgttttttatgggggctcaaattagtataagggctacaaaaatttaatccatagcttgtgatgttttttgttcatttatttttctgtcatttcaggaaatcctttagcctggcaggcttttgaatctcagccagctgctccagctgtgcctagtaagttcctataatagatgcagggctccaaaggtatctttaaaatgctaaaccaaaacataacttttacttactatttttagaggcttttctttgaaaaccaatgtatttagagatcacataatgatttattttgattcttagttttgacctagttctaaaacccaagactacaaatatccacatgatgttgtggtgattttgattagctatagctattatttcacaatttgtctaaaaagggatgactaaaaattccttggcatcaccttagtttatacttgtagacttctcaaagtgatacactatgcgactgtgtgactgtgtgtggtgtcaccacactttgaaactgctgacacttttactgctgcaggctttgacaggtggcctgtctgtccccacttgtggtcagcctggccatctgctctatctcccggagctgtcaagattctgcagtaaaacaaaaggacataatctttacagttgagaaactgagagatggttgtttaaaaatactagctaaatagctgagatagttttgcttccattcaggaaggagtaagggcaggtacctgtgccatgtgcacagggatctgactgtgagaggagtatgggctgaggctgagcacagagagacagcaccacgctcatgggcccagggattgcgagagcactgtgtagtgaccaaaggacgttcttgagcgtgttttggaatttggcactattggctggaaaatgctgatggttttaacctctcagtcttcttggaggcttcttgaagctgaagaagttaagcagtagttaaggagaggagaggagtttaagtgcccagagtagggttgagagaggaagagatgctgaacttacatcttatgaaatgaaggaaaaaaacacatttcagagaaggacagaaaggtcaagtactaaattattcaaacaaacaaacaatcttcagcagctgaccaaactcaaatatctatgcaggaaaaaaaaccaaaaaaaaaaaaaacccaagtctatatttagttagggtggttttctccaaatggagtatgcaaaattatctattggaatgtgggaaaaaattattagaggttctttttatatattaataaatctcatccttttaattttttcattttttgttttaaaatgtacacatttgtattatagtatatataaaattcatttaaataaatatgtgtatttctgggggaacttttactgattggggaatgtggtcaaaaaaatatggatgccactggctctagaaaattccaaaaataatttaaaaaaataggcccatagccccataggtagcggtcccttccgagtgaggccctggcttgtcccattcctcttcccagcatacaaaaggatctaaaagccaaggttctaatgatggcagggaagttttcatcacttaaaagaaaacatacattctaaagtttaagatcagaaagtaaatcacaaggtgaaagtcagcttaggagatatgcaataaataaatcagacctatagccagtaaaatgaagatttgtaatgtctaatataaagcagatatggtcaaacctgttgattccacctgtctatacccttggtgatttagacactagtcagtcatttactgatttactaccctttcataataagggaatgaattctgtagtttagagaaaagaccaaattgtgatcaattttaatagcatcagatcttttgattctgtaagctggaaaaatatctagatcaggaatagttagtattctgtatttttttttttcttgtaaaaagtcagacagtgatttacattaggcttcacaggctagatgatctattttgcaactactcacctctgccattgtagtgcaaaatcagccatagacaacacgtaagtgaaggagcttggctgtattccaataaaaacaggcagtggactgggtatgtctcatgggctatagtttgccaaaacttgatctagattatacaagttgcaaatgggtacaaaggcagtatttccagagtttgttagcaatttacaaataggaattgaacactttcactagaagccattgtgaagataaaaaatgcatacctatagaagtagctgatggccgggtatggtggctcatgcctgtaatcctagcactttgggagaccaaggcaggtggatcacttgaggtcaccagtttgagaccagcctagccaacatggtgaaaccctgtctctactaaaaatacaaaaattagctgagcatggtgccgcatgcctgtagtcccagttactcaggaggctgaggcaggagagttgcttgagcccaggaggcaaaggttgtagtgagctgagatcatgccactgcactccaccctgggcgacgggagtaaaactgtgttttttaaaaaaaaataaaataaaaaagtagctgaggtttgtggccagtattttttagggtaagattagaattaaaagtctgtcttgataaaagaaagaagcggtaaactaatagaccatactgtttagtgaaaacaaactggataaataaatagtccagagaggactttcagataagaattgtcaaatattggaagaaggccgtggaatctaattttctgtagaaatttaaattagagaggattgagtcttacttaagttaggtaaacctctttccacaggctgtgcctaaattaataccttcacataatgtcttccagcccagtgattagagtactttttaaaactggtttattttgcatgaatgttcattgcagcattattcataacagctaaacagtggaaacaacttatatgtccatcacctaatgaaaaggtaaataaaatgtggtcagtttataacacagaatgttatttgcccataaaaatacatactgatatttatatacatgctacagcatggatgaaccttgataacactgtgctaagtgagcaaaaccagacgcaagggaccacatactgtatgattgcatttactatatgaaatgtcaagaataggcaaattcatagagatggatagtagattaattgttgtctggggatagggaaggggcagaaatgaggtgtgatgggtatggggcatgggtattttgagggaggtgatgaagcaaatgttcgagaattagacagtggttgtgtttgcacagccctgtgaatatgctaaaaacccactgaattgtatatttttaaaaggggaacatatctccataaagctgttatgaatataagtttatgttagttgtgtaatatctttgtcacttgaaatatttgttccttatggtctgtatgtatcttgactagtttgcggcatatttggctaccatcatgttcggatgcttatgctttaattatggaacctctgagtttttcctttttatgctgtttcagtgaatgccccagccctgcacactttggaaactaaatcaagtctgccaatggtgcatggtaagtttcagtaatagtctcagcgttttatgtgcagttgccaccctgagttggataacttattaaccaaaagtgattatgtggaggtaattaataataaaacaggaaacattttagtgattgcaaaacagttattaaaactgcagtcttcatgtgtaatattgttgtaaactggacatacctcccaaagtcttaaagtataaaaggtgtatataggtataaaaggttgccagactcacaagtagagattttaactttgggtagtgtcttgattatttatgatttttgtggaaagtagtaggtgttgggtaagaatgagggtgacctgctaccagaccagccaaccagcacatgccacagggcgtatgtggttgtttttataactttcaatgtggcagcaagtcaccttttctaaacaaacagtttgaatgactggttgggaaaatctagaaaagacatgtgatggaaactaaaggaaataggtaggaaccactgggtgaaatcattaccagggttcagttcttggaccagatcaaaagggtgataattgttattaacatgatccaatagatgggctgaatatttgtagccgtatttcactttttatacagttaaagtgcttacagtttttatagtatgttctttaatgtgatgttttcctgtgctctgttggatattacaaatgaattaagacgggagaagggccatctttttccagtctcacatacagttgctctggaatccaaggattatttcactctttcatttttggtcttttaaaaagattacacttaaatccatgatctaactggtcagtatggtggcactttttgtcttcatagatattgtgatctgtataccatgaactttagtaataatcctttttactcatcactgactcttgaagtgtttattgcaccttatttttttcccgaagatcatttcaggtgggtcagttgtcttgagtatgtgatcacaatacgtaatgtgtaaattctccacatattgatcttcttatttacaagtgttcagagcatgcagttttttcctttagaccagtaacagataaaagcacactggacataaataaatttgctttaatattgaatatataagaaaagtatctagcaatcattctgtattcatattattttatgtcaggtctaaaatctctctgttgcgtccctttgtaaagcattgctggccatttctcttttgtacttcaacagtgtattttagtttcttttacttccccacccctccactttgttattgttagctttctgtatgacatcacacaaggttcctagtttctttgtcatatatttttgttgctaactaaaggacaccctggtaggtacattaaagctgtctggggttgattcaagggtccggacaaatcgatcatttctaaagcatgtgttcatggggaccctaccctcactagcccagagctgcatgaatcagtcatgcccccttcctggcatctgctgggattgaaatgctagttttaaatgccagccagacctggcacagggcctacagcccttggatggggatcaaagcttatttgtgagcatctcagtgggcaggagctaggaagagacttggccagggcccgccaacgtcccccaccccgtcaggccagcttccccagggcggcaggggcagggcaggttagtcatggattgcgtaatgtttattcgcctgttcactctctgtcctttgttccatctcgaagcttgatgaggttctttaccatgaaaaatctcacaatttcttaccattgtaggtcgggtcccctgggaaacagactgatgcggaagtttacaggtgggaggtgggggtgcccttggacagcacctgtgagagaagcagggttgggcgaagggaacgttgaacctagacgcagccacagtggaggcctcagccagccctgcttcagagctgcagagctgggatgagtgctctggcttgtcctccactgaggcaggggtgggccattgccccttgcactgatttgtcatctgatgggggctgccccaaagagagggtgagctaaagcagcctggaagggactccactgtgagctgctaggagccaacattgccagcacgtttgtcctgggaggatctaggtaaaatgggaaccctgatggctccctgctttcaactctgctacacaagctaaacggtacaggcagtaggttctgatcctaaggcagttgataggatgaaacacgggttctggagaagataaacaatcatgcttgattcccatccccagtatgcattttttttctggacaaacctcaaataaatttttgtagtattttcaccactggagaccactttgctctttgctcatggagtagtgactaaatggtggtattaggatgcccagaaaataaagtatactttgttgctgttaaactgacccatacaccaattgcttaggttgcctgggctgataatgtggcccacttttagagcgacgagtgcagtgaggatgcaaaataaccgcttttcccaaagtctgtgggcacctgctaggttctatctacatgtaaagccctcctttaatttggtctataaattgtgaggggcttatgtatgcatgactttaattgtatatagctacagtgaggaccacaaaaactggaaactctttttttttttttttttttttttttttttgagactgggcatttctctgtcgcccaggctggaatgtggtgatatgatcatagctcactgcagcctcaactttctgggctcaagtgatcctcccacgtagttgagactgcaggggtgcaccaccatacctgactaattttttgatttattatatagacggcatttcattatgttgcccaggctggtttcaaacacctggactcaaatgatcctcccacctcagccttccaaagtgctaggaccacaggtgtgagcccaccgctcccacttagaaacatttttattagactttacaattattattatgttttgttctcaaagcaagtattctacatcttgaaatactgaaaattaacacaagcaatagtttattgtccaatacatgacaggtggtatgctctagacttctggtgtattgtgtctcttgatggaaagaaagatggcttccccctctggacaccactggcccaaatagtgttgcagaagtgggatggggactgttgaaaggaagtctcagttcagtgggattccaccctctaaaggagagtgggcctgatccctgtcaggtgaccatgcttatgtgcagtcacaaggggaaatgtttggatgtgccaacaggatctcctggacatacatcctggaaaagctcaggagagtcttcagtgaacatgtctttgacaggagttaacatgccacatgtagttatctgtttctccagcggtgttccgccactcttgccttccttccttcactgaccactgggtaatgacaactgtggaccactcctgcatgacagagatatagaaatgaatcagaaacgaagcctgtccccacggaacttacagcttataaaggagaccacatgcttataattatggtgcaaggtgagagccactgagaaatgaaatgggtatccaggcaggggagagatttcctccatttgggagactctgggaagacttcctggcgtagctgacatttggccatttgagccgagtaggaggtgaatatgtcgggatggcatcctaggcaaagcaaacagtaagaaggaaaaggtggcaggaaagcactagatgtgaattagcagtttagagtaattacttggccatgcatagagaagaggagatgtgagggaagtgaggttggttgagggcgttcatggcagctgttgagtgccaggctgcagctgtccagggtcgttcttggggcagtttgtagccgctgagtgttcctgaggctgggtgtgcagaattggagagctgggctatgggaggcttggcctgaccagagcgtctccaaagctccccatctgagatggggagaccagttgtgggtgtgggtgatcctacacttgagattcctccccgggagtctgctttgtggtgatgagactggagaaagagtggacagaccagcggtttggtggagttggcagaaaggctgagcaggtgactggggaccagggccaggaccaaggaaagtcagagcacagtgaactctgataatgggtggacagcggtggcatttggagaagtcagaaagacaagcccagtgagtgccagtaggcaggcatcatcactttgtggacaagtccccagactttggaagcaggcagtccggattcacagcccacccctaagctgtgggcttaggggctttgcctgccaagtgcagagaacagctgtggctactgcagtggcctttgtgatggtccagaaaggtacaagccactgagtaagctctggccagtgttggcttctaaggtaggcacgatgaagtccagccaaagtcagctaggggcaaaagggcagggctagttagaggaccaagatcctttcttctggagacaatggcaggaaactgacaaggatttttttgaaagcctcccacaagttcatgggagactcagacctctgagtgttttgactgtcaccctgcatctcagctcaggacaggatctgggacgtttgaagtctagactggtggcttacaaagcacaagcagggcaggtccttccctcctgatgtgggacatcagcctgcttgttttgggagctggggtttggccagcctcacttccccagcccttgttatgggagccacgttcaggagtctccccttctaccagaactcttcctctgtacacagagggaaacacatcagaacctggcagtttatcctgactctagagaaataagtcataggagtatccctgttataaaataataaatatgtgtgagattatttcatgaaagttttattaaaagtttccttgtgaccttattttgatcacaagtaaataaaatacagtgtgactttttaaaatctgaaattagttatcctccttaaatctgttttcagcagttcaaactagtaatatagcctatttgtataatttttaaaaatcttgatgctctataacaaatttgaaaagcatatttttggtggtcagcagttgtggtacctgctggacttaaatgcttcttcatggctatgtccacacttcagcagttaggtgattttactcagtcataggctgtattccagaagttaacttgaaagtagtttaagatgcgtttctcccatacagccaatgttacatacattgactaggttgctggctaagctgtaagaacctatttatatatacctaagcctgtctgtctgtctgtctgtctatctatctatctatctatctatctatctatctatctatcatctatctatctatctctatcatctctctctctctctatcatttgtctatctgaaatagagtactagaaatactttaatgaataaaaaaccagaccctttaaagtaagaagcattaaatctgagataccacacatgtggatccctgcccagcctcctggtgagcactcggtaactgttggccatttttaccctggctcatcacccactcccaggtctggtggtagaatgaaatgacctcccccttggaggtaaaagtggagagctggtggggggaagtgcactgtatcagtctccaagatgaaggtgagtgaaccatgcaccaactttgctggttgcatttcatcccatatctaatgcctgaccaccatcattaaaccttcacctaaaacctgaccttcaccatgaaggaaatttccttcagttggtaggatagggcttggttttatacctgctgctggcaggcttccttgtgtatgcatataacatttctctgggaatagtcacccaaagacctcatctcccctgagtgcggttgccattctggggtgagattgggaagagtccttcctcatctgcccagctgtggggctagggcattctccagccccagaactaggtcgtgaaatgcatccatgcaggtgtcgaagaatggctctcattcttgctgctgacctctcgcctgtcgttccccttttatattctgggtcttaccacttgaaaaccgtggggttagcacccagaacaagtgggaatcccaggaccttgggaatttttaatgtttttgtagttgaaatattttcattaattttctgtttagccacttgattgaaatactttataagtaatgaagatcttttgcagttgtgcccttgtgtcttaaaaggctaccgtgtactaggttgatgaatgagaaactttaacttaattatttaaaactataatttctgtagagtgtagttaatggaaagtacatagaaatcgaagatatgatgaaaaggtgaccatctatgactgattgcctcaacgttttttcctcagtaaattcttgctattcaggcatgactaaaataccatggaatgatatctttcaaaatcatttgaaaggaaactaatgtaactttgctgttgtcctgtttgtactgttcttatttttccttgttaatagaacaggcattctcgtcgcacatactggaaccaatagaagaactttcagaggaagaaaaaggtaacaaagggcttgatcaggtttacctgcacagattatatttatatgccaaaatctaggcctggaaaatatgagccagtggtttttattccactacatcaaaattaggaaagacatttagatttggattttactttcaacccacatagagtatcctgttatcctattcccctaatattctgttctgttttcccctgctttgtggtattcttatgcaagcagataaaataagaaattttttgtgtcagagaacttgaaaaaaaatttgtctttattttaatgcagatttttctgatgagatgatatatagacacacacgtgttgtgtaccagaagatctgaaaatatttgtatcatagtggtgatttatcatacccttaatctgaaatgaattggtgaagtgcttatttccaaattatttttaatagcaagaaaagcatcatgtctaagttctggatgtggaatatttatgtgcaaaacagtatttttatggtggaatttgggagctgttacaggtgttgggagataattattactgcttactcatttcatttgatagtcctaaaaattattttctgtcaattagtttttaaagtctatgaagaaaggtttaattatgaggaacattttctaatgctagatttgtagattttgaaaacaattatatttgaatcaatctatcataattttttcctattaataataataataattcaccatatatcacttctttaggagaaagcaaattgtcaatacttatatgggttctggttttgtcatttttgtcaggaaaagaagtcaaatgatatatatcctaatatataaattcagtatttattataactcttcccttgttctctagacatttaccattttatttttatttttataaggctacaaattgagaattgactacatcaggcatattcataatacctatatgatatacactttcaagtcttattttgctatgctaatgatcagtaactttttgatatttttatagggtttgtttattttgcttccatgtatctttgtaatttgtcttgatgttgtatattttagacagaccatttagtttaggattgcatatcttcctgtcccaatagttgttcatgtttggcactgattttgaagagtttggttttagttgcttcatttcctccttatttctttgtaattgctgttccaatgtttagaaacctgcttctttcagaaacaagagtgactataggtacattaaattacataaagccataaaaacttgttgagggaaattttggggtactctgatgagcataactttaaaagatattgttaccttcttatggggtcctcagccttgttccattgctaaacaaataaattgctggaggggtcattcccagacacttccagcaccttaaagaccaccacagcccaggcatcaaacgagatcctgcaggctgaatcgattccacagacgctgacttgttcaagctgcactattagcaactattgtacagtaggttgccaatatttaattgtagtgcaatctctacacaatttaattatctatcactaggtgataaagtcccttccaactcagaaattctggttgttgtttttttaaaattatttgctttgtgccacaatacaataccctggaaaccctgggcgcatggtctacttagcaacatttagcagggctgagccgccatcactggctatggaagcaacctccggtttgccataatccccctcaactcttttgccccacattgccttctttgctttatgtaggcgtttaagcttctgagccctataggttgaagagaaatagtgcttaaaaaatattgtctttaagtgattttcaaccatccctattggttttccagaaacggaagaacaaatcttaccctatttgagttctgaataatgacacatcattttgcttgcaagtaacatgcttccgctctcctacatacatatcatttactgatgtccaagatataaaatcccatattccttgaagaatctgtgagacatgtcaggaggttcatagaaaacgtcgcgtactttcaaaatagaacttcaggtcatgtagttcacactcatttgaaaaacgactcagtgagggttcctataggaatcatgattgtccaccatcacccagagtggtcttgtaacttccagttccagatttcactcactgcatccctctgcctgtgcttttagagttcttccagtcaatgtaagatggtagtttggaatcactgacagcaaacaccaccattgggtgctgccacatttagggggctggactggaaaagaaaataactcttgtcatgctccatgtgttcagctctgatggtagacaggagagtgctgaggaccatagaaaacaccccagggtccacgtgcaccactgcagaaaccagtgactgcctccttccagcacctctgtggagttaacatactggcagcagattaattgccatcaataaattcctcagcttgtgctaacattttgcagataagtgcctgagaagctcaattttggcagtggtttgcaaaaacactgtggcttttactaagaagtaattcatgcatatttctgtgtacctgctttttgagcaaaggcatagttgatcttgcagttttatagatgctagaatgtgagggccagaagggatcttagagggcattttattttccagaaagaaaacatagggggattaagagcctgcttcaggttgttgagtttaattagtgacaacatccaggttttctactgtccatagtttagtgcagagagcaaatggagaaagggaagctgatgtggcctctacaggaccatctggatggcctttggggaagttactgctgtttctagtatactcatgtcaaaaatctatcattactaggtggtagataaattcccttccaactcagaaattcaaggatttttaaaaatcatttgcttcctgctacaattatttgtttaccataaatgggatgttgtatgtctgataaaactgatcccatgtatggactgttgtgcattagcctgggcgtctgcttgtttgtgtttgaaaatttgtatttgaaggaaatgctagtctttagaaagttttgtcttggtcttggtgagcaatatgtgctttaactaaaatcctcagctgtgattgattttcaagtgattaattccacttctacataaaaactttatttttccctgcttactctacattctttctcttgcttccattggccagccccacccttgtaagaatctttaccaagggtgctctaattattcataaatggtttcccaaagcaagcaccagtatataaggtgaatttgaggacagggggaaatgcgtaatctgcagtagtttggggaactcagtcatcaaaatgaacctgtcatcagagctgaggatgatcacagacacatcagcaaatgaattcaacaactaacggcaaaggctttacagctcttctaactgcaaccaagtcattccaggcatcgcttgcccctgtatgtggccccaagtcccagagaaaacagggcccagagcctctttttaggcaacgcttctgtgtacgtccttcattatctgagatattggccaaaagagtcttcacataattggggtagggggtatgtctatttcaatggtagcaccaagacttccaggctctctcggtgcctctttttatttttggccctagacagttgcacacttgatggccacctagaagccaaagccagtgacatagtggctgcagctatgattttgatggattgttcatagaagtgctttttttggtggtttcagaatatttgtaaacattggtggttaaacagcagcatgattgctgataatataagatttaagattagttctgacttttaatatataattatatgcagttttatcacttcagcttagcaagctgcaatagcaaaacatagaatagtatttttgtgcaggattttgttcttctatttaatgtacacaaaagtaatttgactaattttgctttcaataaaaccatctatttatttaatagaaatattttttaatgtgggaattgaactggtgtttagaaaacatcttaaacaaaaaggcattttgttcaagatctcctgcaaatccaagtagtatgggtattaagaatcctgtctgctgagatgggtgaggcagcagcagaagggagagtctctcgggtggcctggagccctacacctaggaaatggcatttgatgccaccctttggtgggcaaaatgcccctgttaggagattagactccaaaatggtagtatagttgtcacatttctcccagatcaggcttttgacagtcagtaagggtctgaactgccaaacgtcgcatctctttaatgaagtcttctgttcctttgtacataaggactcagatttttaaaggttatgccatcattcttctccaaactgtcttgaacttgactttttttttttaagtggggaataaaaaagggatagggatggaagtgaggagaatatgtcctattgtttttggtttctttgtttttaattataggttgttttaaacaaaatacacttttgctaagacttttgttatcctttttcattttggtaaatattttgaaggggataatgattttcacatcttgaaattttatatgtacttagcttctagtaactaaaaaactttgaaaaaaaatttttatatttaaaataaattgaaatgggatctcgctatgttgttcaggctaatctcaaactcctgggtccaagtgatccactcaccttaacctccgaaagtgctgggattacaggtgtgagccactgagcctggccaaaaagttttaattatttaaagtaaattgggctttttcttcataagatgatacataaattctaactgagtgagcttggagatgaatttttcaggaaatagtgatataattctagtgataaaacattaaactcctaaataaattttttttccatcatgcttctatagatacatatatatctatagttgtcatctgattaagtgatccagtctttgaaaatactgaagttttgaagccgacataaaatagttttaaaagctgcataacttaagcattctgtattgtgctgagtgactaaaatatccaaaaactttaaaacatcacaaatacttacttgctgcttaaaagctgtggtttgccattttctgcttagagatttttgatgtatttgcttaattctttttttaacacatttttaaaaccttatttcaggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagtatgttcattcatttttggaatatttgttagttttgctgtgttttgttttctaaattagaaatgatcatggaagagaagaaagcacatcaattctgtccatgtttggagaacagaggctaatgtgacctactttatttatcaaacacttgaatagcattcactgtgtgcctggcacatttctacgaccttaacaaatattaactcatttaaacatagaaacaaatctctgaaataaatgacattagtatcttgacagtttacagaaaaggtaagtaacttgattaatgtctcacagctagtaatgaaggagccagggtttgtatctaggcagtcacagtgctgcttacattctgatattaacctcaaatcattgcctattacaaaaccagcacttcattaatacatgttgaatgaatggatgaatggattggatttcatattgttgccagattgaataattttggtatatcatatatagattctttttgctttttatagttttattgacatacataaaagacacaaatcttaattgaacttcattagtttatatgtttataaaaaagtgcatctacatatgcatatatacacatatatgcaaagcttgtgagcacatatgcatgcatgggcacacacgtggatgtgtatagtgtgtatgtgtgcatgtagctatgtatatatacatgtatgtatccatgtgtgtatgcagatatctgtgtatgtgtatacacatttgtgtatatgatatgtgtatacacatttatgtatatgtatgtatatagatgattgtgtatgttttcagaagtatgtgtgtatgtggctatatttgtgggtatacatgtttgcataattttatctatatagatggatttgtatgtacatggatgtgtgtgtatgatctataaccagcacccaaatgatgagattgaacatttccaacactctggaagactctcttttactttctgctagtcagtatcaccccctacttcccaatcggagggaaagggtattctgacttagttttgcttgttcttgaacctcataaaagtggagtcatacactgtgtaatattttatatcttcttttgcttaatgattttatctatatgattcatacctgttgtttcatgtagcagtagtttgttcttatttattaccttatagcattctattgtgtgaatatactacagtttatctcttccctgctgatggacatttgtgtgtctattttggggctcttcttggctattaattcttgtacatgtcttttggtgaacatgggcatttctttttcttgaatatatatctagggatgaaattgctgagtcaaagggtaggcatatgtttagtacagtagctgttgccaaatagttttccaaagtccttgtaccaactcacactgtccctaacggtgtttgagagttcagttgctccacatctttcatcaactcagtcagtctttttaaatttccacatagaccctttttaggtgggttttgaccaccctttgggcagtggaaatcaaagacattcatggaatgtgtgtggttcctgtgcagattgtttcttaaaattgtagttttccatattggttgtttgcaagtggttttttgagttttaattttaattgggacattttcatttatcctaagattattaaaacattcttttttttctctaatgcttggagaggttttcctagttttttgtttgttgttttgcttattttgtttttgtctatctgggctttaagagttaggttttgaaacagtgatttggagagctaacttaatttccagttggatcaggtgtcccaatatcatttgttgaataatccatagtttctccatttatttaaaaggacatttttgtcatataagaaatccctatatacatttggatttgtttttggactttcaactgttttaccttgtttttttgtgtgttccttttcccataccatactaatttaattgtagtagctttgtcctgtgttttaatatcttttataggccatgccttcttcattagtcttatttcaaaaatttattggtaattcttccatgttttgttttccaatgaactttaggaataacttttcaacttccagaataacccttgttgggattctgattgaaattgttttaaattttgtatattaagtaggaaggattgacatttgtacagtattaggtcttatcctccagctacatggtataggaagacaggcatgaaacaaatgatttcccagacaaatgggagctctctaatttagattatatgaggtgaaataaaggaaaagtagaggagggggttgattgaataactgaggtcagagaaaacttcttcttggaggtggtacttaatttgatgatggagatttctgtcctgggcaactgggtgggtggtatggccactccctgggactgggaaggctgagggaagcaagggggatgggaacaaagatgggaggtagctgtgtgtgtgagacactgttattcaacaaatatccctttaactagttttcttctgtctagattctcatcaaatctagatgacttttctcaaattgtctctttaattatgctattttcatagttaaatgtcacctctagctgggcacggtggctcatgcctgtaatcccagcactttgggaggccaaggcaggtggatcacgaggtcaggagttcgagactagcctggccaacacggtgaaaccccatctctactaaaaatacaaaaattagctgggcgtggtggcgggtgcctgtaatcccagctactcggaaggctgaggcaagagaatcatttgaacctgggaggtggaggttgcagtgaactgagattgcgccattgcactccagcctgggcaacagggcgagactctgtctcaggaaaaaaaaaaaaaaaaaaaaagaagtcacctctgatgctctgatgacctattgttccttgtagaataacctttcagccttttgggttggcatttagtctcttctgctggtttcatcacccaggtctttttaagcattagcctgtgggacgtgccttacctgtttctgcctcgacagcttcctttctcacaggtgtccctatctcatgcctacccatctggaaatttctccttgtttttacttgtttgactccacctgtccttcaggccacagctcagcctcccctttcagccttctctggccactggggccttcgatggcctccctccctggaattcttctagcctttgtagactcattgggtccttatgacacacagcctcgtcggtcagccagtcataaacatatgcatgccttatgtgcccaactgaacacatggcccctttggggacagtgtgttacttgttggggcacccttaccctctacacacaactggagccctgtaaggatggattgaaatgttggcacagttaatgctgatatatgcccatgaaatgaaacctcccaggataactggccaacttaacatcttattctttcaggatatacgtggcatttcaagtgatcagttgcatagagtactaaaaagtgtggaatcagaaagacataagcaagaaagagaaatacctaactttcatcaaattcgagaattccttgaacatcaagtcagctgtaaaattgaggagaaagcactactctcttcaggtaagcttgttacccactgcaaatgggagcttaatttaacaactttttctttttttcttcttttttcaccacaagatatcattaaacaaattattataattttaaatggttaacaaacttcgccacttcactggcaactcttttactgtttgtactattaaatgctgggtcttggattttgtttttacagtaaaaacaaaacaacaaccctagagtctggctttaaaccctagagatgggattgttcattgccacagcagcatagggggtattataccgtttacctttgcttttcacttactgatcataaaggtaatggagactcatgaatgacactatattccagatcagtgcagtgtttctcaaatggataccctttcaactggagaagtacccaaaatgatacaacttccttccaaaaacagacaactgattagacaaaaagctgtttctactgataggacatctgttccaaagtgagtatttcagccctcagatttattttatcagtgtttgtcttagctcaggctgctttaacaaaataccatagactgggtggcttcacagaaatttattttctccccattttggaggctgaaagtccaagatcaggatgccagtatagtcaggttccggtgaaggctgtctgccttgcagacgactgccttcttgccatgcctccagatggtggagatacctctgaaggagatacatcgcttcctcttcttataaggcaccaatcccatcatgggggcccccatccacatgacctcatctaaacttaatcacctcccaaaggccccccagatgccatcatactgtgggtcaggtctttagcatatgtatttggggcagaggggacacagacattgagtccataacagtgtttggtccaactgagaatcacacttgtaattcctaccagtctctaactgacgctgggtgacttttgttgctgctcttcctcgttagtgtatgtcaaaagcaaaaatcaccagttccatagaaatgtatgtgaaattatattattaacttatgcaatttaaaaatatttttctgttgtttttttagaattaagaaaaatgtcatggaagatccttttcccagaaagtcttcaactattacgtgagtattgacagggatgggagggtcatttaaaaaattattttcactgaacattcctttcattttaaagtagcgtgctcattatggttgaatgaagccgtaattatttaatatcataatttgtcattcctttgtgatatgttatttgtgacatgtctttgtttctttatcagttattacataagtcaatagcccttaaccacatgtggactccattaagaagcaagacacctgagtcattcttatgtccatccccctacaatgttgagtaatttctcaataagtacatttaacttaaatggctgatgttgagtttttatggctaggctcatgacagtgtaagtttgttttaaatgtaataatttagtgtttccagttttttgtggaagttaatactgaccctagtagatattcctgtcttaggttctcttaggatactaaaaaccctagcccagttgttcatcacctgtgtgctactgatttagttgattactgttttaagcctgttttcttatctgtagtatgggatgttttaagtctcaatttccttatctgtaatatggaataatgctgcctttttcacgagatagttctacaaattaaatgggaatgtatgaagagggcttggctcagtgcttggcacttgtgggtactcaataaattgtaggtatattgttactaattatgagtaagactaattttatcatgaataatttaatcatcattgccttattctggagatattgatgacataaatatcttttcattgaggcactgtgtattagagacaataaacaatgattcacccttcaaaagcacttttcttatacgtaatctcataggaagagcattatttcttgggatgtggtgtgaatgaatcaacatgtacaagactgacacgttgtctggaatttaggtgcccaataaatattatttaaatgaacgaacactgctttgaacttctatttcaccttaaaatgggggtaataattcatgtgataatacaaatgagattgtgtatgtaaaagctctttgcaagaaggtgcagtataaagaagctgtaagtaatgacacaattttaaaacatggagtggttttactgaggaaatgtttttcttaggtgtgtgaaaaccaaaattattaagaatatatacacatttgggtttagaggagacaggccccggcttcagcccattttgataaacatgccccgtggctggcagagatctgggcgtgggaggatgctacagccgtgggtataacctctggcctcgccgccatcttggccatagccccaaaggcacttgtgcccactgagaattacctgagaaaggtgccaccactttaagaggcacatctcttaatattataaatcctaaagcgttacgaaaacagcgcccctatctcggtgttgatttgtgtaggacccctccttttagttcagaggaggagcaggaggacgacgacctcatccgggcatacgcatccccaggcccacttcctgtgccgccaccacaaaacaagggcagcttcgggaagaacacagtgaaaagtgacgcggacgggaccgagggaagcgaaatcgaggacactgatgattctcccaagcccgcaggtgagctgttaccttggaaaactctctggaaactgtatttaggacagttgtcctcacccgtgtgtaccgagcactgggagtctgagctgggagggtgtgcaaggaacagatgcagcggatcccaaaggcacccacggaaaatgggcagggtttagcacattccagttgaaggagaggaaggagttgggaatgatacctggtgtattagtttgctagggctgctataacagtaccataaactgggtggcttaaggaacacaaccttcttgcctcacagttctggaggctggaagtacaagatcaaggtgttggcgctgttggttcctgtgagggctgccagggagggtctgttccgcgcctctgtccttgacttgtcttcttgtgcatcctcacatcatcttccctctgtgtgcatctctgtccagatgtctcgtttgtataaggacattggattagggcccaccctaatgacctcactttaccttgatttcctttgcaaagactgtgcctccaaataaggtcacattctaagcaatggggtttagaaattcaacatgtgaatttagagggacacaagtcaacccaggacactgggtgactatgagaatggctgttctaatacactgtgctgcctcttggagctggagtaatactaaaggaagacaagatcttagcctgtcactgcaaatatttgctgacgagaagtagagctgatgggtcattatttttttaaaaaattcagcttaatgcaattttaaaattatatattttaaacatatcaggtgtaatttattatatttaatatattgtgtgtaatttattatatttaatatattgttggatgtaatttatattgtatataatgggtatatactatgtatttatataattagataaaatataattcatttaaaaattcatattgtttttgtaaatacccatatgaatattccactcatgcaggttatctcactgaaattaatttctgaccacacacttgaatgagatcctctttctttgatttaaaatgtaaactttaggccaggcacagtcgctctcacctgtaatcccagcactttgggaggatgaggcaggaggattgcttgagcccgggagttcaagaccagcctaggcagcatagcaagacctcgtctctattttttttaattaactaaataaaatgaaaatgttatatagctcatagtctgaaggattatgatttttttaaggattgtgtgttaaattttctaaccccaaagtacatcaactgattttattttaataatacataattacttccaaagcttagactctttcaaagtttcctgtaaggttattttggaactaaagatagattaaatttttaaatacttaacttgcctaatttttattgatcttataggagtcgccgttaaaacacctactgaaaaagttgaaaagatgtttccacatcgcaaaaatgtgaacaaaccagtcggtggaactaatgtccctgagatgtttatcaaaaaagaagaattacaagaactaaaggtgaaatcacttttacttgctagatatacataaatttgtctttggacagcaccttaatggtcacactttttgtagtgaaatataaaacagatagttagctggtagagtagaggttgagattttcacctttcttgttctcagtattgcatttctttccattccatagacaaagatattggagtgataactgtaacaatacataataagcatgacactttacaggttttcaagatcctgtcacatgtattatctgatacttgcagatatcaaatggtttgtacaaagaaatttgtgactggccagaattggggcccttcagatcttcttcactaccctggcatgagaccttaggtacttttgagggtttagctccacttgggagccgaagtgagggtggaggccaagctcctctgtctgcattagagaagaagcccaaacattttcccagtggttctaacagccaggacgccagaggtgtttctgtggatggagctctatcattgtatttctgggcacagctcatctgtgttgactggtcctccagtccagggcattttgtcaaattacttttattagttaatactatttgtgttacacaagccaaaaatgacagaaagtcctatgacattcaagagagagcaaaagcatctttctttaggaagggcatggtagaactgtgtgcacctttcagttgggggctattcggttggtctgatgtacccacagttagatgtcattattatcacagaggtaagaagcaagagcaagcctcactcctactctggagcaccctgacttttagagtttcataccgctacagtgtagtatttctggaattttctacattcatgattggtagagtaggaaacatatatttccatggcagaaacgaaaaagagatgattcagatttcaaaataccaacttccaaatctatttcattgccctgcagaaatgactagatttggaagtattaatagttccccacttctttccttatggttcagtgttagatgctcagtctaaccaataaaatgattgagggacaccatttttttctaagcaacattaattattctccatgcctttcttttagtgtgcggatgtggaggatgaagactgggacatatcatccctagaggaagagatatctttgggaaaaaaatctgggaaagaacagaaggaacctccacctgcgaaaaatgaaccacattttgctcatgtgctaaatgcctggggcgcatttaatcctaaggggccaaagggagaaggtttgctgctttcccctctaatacaagctcgatccattttcttattagttgtgtttcatctttataaatatctaattaacttatgctggtatatcatcagacaaaaaagctgtcagtgctttctttatgttatttaaataaggattggatatgcataactcactgattcatatatatttacttgttatttttatttaattataggactaatctttagtctttaaatttttaatttatttttatttttattttttgtttttgaaacggtgttattgtcacccaggccatcatggctcactgcaaccttaaccttctaggctcaaacagccctcccacctcagcctccccagtaactgaggcagtcctcccacttcggcctcccagagtgctgggattacaggcatgggccaccgctcgtggcccccaaattgtttgtattcttttattttttttttttttttggccaggcgcagtggctcacgcctgtaatcccagcactttgggaggccaaggcgggcagatcacgaggtcaagagattgagaccatcctggccaacatggtgaaacgctgtctctgctaaaaatacaaaaattagttgggcatggtggtgcgcgcctgtagtcctagctacttgggaggctaaggcaggagaattgcttgaacctgggaagtggaggttgcagtgagctgagatcacgccactgcactccagcctggcaaaagagtgagactctgtctcaaaaaaaatttattattattatttttttattttttttaggatatggggtctcactatgttgcctaggctggattcaaactcctgggctcaagcaatccttctgcctcagtctcctgagtagctgtgactacagatgtgcaccaccatgcccagcttttatattatttttaaaaatgtctatacacgtattctcttcatgaagatgccttttaggaattaaaatttctgatcatatacctgaatgagaccactcttctggcagtctctctgtattagtctgtttccctattaaatatttttcttcattttctcccaagggaggtttctcttgtagccgtgtagtcagtgggatgaaatactatgagataattacttgaaatgattttcatatcccccaatctagagcctagataagcccaataacttagtaatttttttttaaattagaaaattgtaatttttttgtcaaagtaattcttgcacatgttgaaagctgagttgttcagaaggcttctctatgccatcgcaccaccttcattagtggtagctctgtgcctctcagtaatggccttaaaccactctttgttgattcattgactttagatattaactgttgatgtcctgcaaagacagatggggacttggctcattttcaccacccaccgcacctctcacgccttcttcactgtttttgtactcctacttataattttattactttttttttttttttaagagatggggtctcaccagcttgcccaggctggtgtcaaactcctgggctcaaatgatcctcccaccccagcctcccaaactgttgggattacaggtgtcagccactgcacccagactgtaattttaagttaatacctgcatgtctccacccttgctctttccattttcagcagcctctcgcccctttgtaagataagatgttgctgcctgtctccttcacgctaccttttctctcacattgtccagttataacatagctgttgcataactggcatcagttatctgtgctaagcatcaactctaattattgaaaaccaggagacctgttggcattagagtgactctttacagggccaagaggatgccctaaggacatctcctgtctctttcctccaacatcataaacctgtgcccctggaggaacacatttctagagtcaaacttgagtggaattctctgcactctatttcactggctcaaaatcatggcattttaaaattgacttcgttgttaatcctatctacctagaaaatatgtttttaacactttacttggcttgctaatttcatccttctttctttaccatctattcactcagagtcagtaactacaacacaaatgtactgagcaccttcaacatccaggccctgagctgaatgctggggaaggagtgggaagcaggatgtggtccctgctgtttgtaggctgcagggcagaagcttgcatccaagggtcctgagtgtatcctagagatgcgaccagttcacagttggattttaaagtggcgtcctatacatagctcatgagggttgggagatgaggattcatgaacagatttagacactgagtgattaatgacaatatgaaattatggatttttatagacttgacaatgtgcttgtttaaccattgaggccttctcttctgcctctacccaccacttacaggacttcaagaaaatgaatcaagcacattaaaaagcagcttagtaactgtgactgattggagcgacacttcagatgtctaattccacatgtcagaagattattccagaagccagcagtatttcagtatcacagtgtttcagtaatttgcctccatgattctagtgcttctgccttaccgtgtttcccacagcaacacagagactgattcaaagaacaatggtctctttaatggcacccaatacagtattgaaaatcagatcatcaacagtatttcgaagcatgtaaaggtgtttaagacttccgctgctgcttaaaaataacatgtcattgaagtcataaaaagttttttcttcagaaaggtactctagtgttaagtgtatttttttcaactaattttttagtgaattttttttaaacttacagcatgttttggtttgaattactaaaactttaaaaaatatttttcttatgtatgctgtcgtatcgtaggcgtttatattataaaattctgttagtagtcttaaaattgaattggtggaaccactaatccttaaaagttagtctggttatttttcatatagaagtaagtttaatccgagtgtggtggtgttcacctttaatcccagctacttgggaggctgaggtgggaggataacttgagcacaggagttcaagaccagcgtgggcaatatagcaagactccacccctccacaccccaaaaaagtaagtttaggattagaatatagctaggtccaatgttaaatacattttcctggagtacatttgtcacattcagctttgagccactgtaagcatgttactattaaatggttggttattttatatagcatattctttatcttggatattttatgaataaagtatagttattttaagtgccaattaatttatcagactaaatagaaaatatttgagccattactgaattcacatatgtatgtttttttttactatttaaaatacccaacatgtattatgaaatacctcaaaagtaatttagttacattcttaaacaatgacattgtcgaaagaaagttcttataagctgttttttgcatttttataacttggttatactatattctgtttccaagtaaccttttaactaaaagatttgttgggttttagatctcttttcatttgtcaaccttttcagtaaagccctctgttacatcactgtgactgtggctgtgttattagagatgaattctgagttaaatttgtacttattaggggtcttacagagggagaatctggccttgattgctatgccatatgacattctgtcctaatggttagaacaaatctttatctgtttccacccaccctgggatcctttttacttgtagcccattcctgccctctaaaagaatccttccaacttcctataggggccatttcatgcagatatactcactttatatgtatgtttctaaaagctttagtgaaggctgaatccaagtttcatgtagtaggacagagaacagaaggccgaatccaagtttcatgtggtaggacagagaacggcaatctacaaaactacaccaagcctaagatggcccatgtgccactttgttcattcatttatttattcagcagatatttattgaaccacttggtctggtttggttttgaacacgcactaattcatttaattacaacaactttgcgatgtagttattgttataatcctcatcctaaaggtgtgagaaacagagttattaagtaagttgccagaagccatacaagtacaaagtgtcaaggggagactttaagccaggtctctattccatgttttgtgtctgccatgttttcattcctgagcagaagagcttggggaaatgaacttttgctaagtaaacccagtatttaaattaagtcactatatctgtgtcttttaagagcccctcctttagcttacatggttagttgtatctttttttttttttttttttgagacagagtctcactatgttgcccaggcttgagcgcagtggcaccatctcggctcactacaacctccgcctcccagattcaagcgattttcctgcctcagcctcccaagtagctgggattacaggtgcccaccaccatgcctggcttaattttttgtatttttagtagagatgaggtttcaccatgttggccagactggtctcgaactcctgacctcaaatgatccgctgtcttgtcctcccaaagtgctgggattataggcgtgagccatcgcgccctgctgcatttcatttttttgtataaaatttggtttgttcgtttttgaggggaaccattcctttatgttgccccttactgatgcccaactaatgtgtttctggttactaacagaccttcatcccccaccctccctaaattcttcggtgtaatctaagcgttatctgcaccacttctgaataataaatgtgtttgaaatgcacacctacacaaccctgtcccacactggcctgtaggacctaatctaccttcatgtctttcagttgatttgtatttctgcaaaagatatttcaaggattatcaaggtatggaattttttttattttttatcttttaacaaacttgttcatttccttttctttccattgagcacctctgaacaatgtgattcttttttttaagtctttcacacttcaggaaaatactacattcacccacgttgtgattcatatcggacagtttcttactcaaagataacacaaataccaattcttattcatactttgaaactatattttaccctagactgccttggttcaaaggcctagtttcgacattactgtggcaaattatttaagctctctgttttcatttctttttctgtaaatgcaggatgaaaacaatatgtatctcctaggatggctgtgaggagtgagtgagacaggacatgaaaggtgtgtatgaactgtgataactgttgcccttgtgggcatgttatatagggctggctctaggaagaagcctgtgtcttttttcagaaatccctggagcaacttaaatgtctttagaaatgacaagtctctcagttatccagttagccgtaaacaggttctggaagacacacctagatagaactcggcccgtcagttctgagtgaggcacgtaccacttgggcttgggatgtccttaacccatttatgcctgaggttgcaattttttgaatttttccaatcacaccttggcgatgaccttgagcagtaggatataaataactcccacatgcttagtgttccaataatggaacactaggcataaacaggttttaattggctcctcagtcaaccatgaccaatatctctatctcagcttctgctgatgccctagctcagggctctgcattccgtgccagggacgcctcagccccttaacatggatgtgccacatgacaggcaataatatattggccccattagcccttcctggagcagtcataatgaattacagtcatgacaggcacatgtaagaaaccaaaatttgctaaatatgtacatgagtcttcatcacagcatcgtttatgaaaacaactaaatattcactaatggtgccagtggaataaatcagagaacatcccctgctacgtaactctctgcatacatcaaagagaatggtgtggctttgctttttcaacaatctactgagtggccatgggcatgtggatatggccatgaatgagcaagatcctctctgatcctgtagaagttaagttctaccagataacttgctgcttcaacaaaaagatttacctttttaaataaatgttgtagaatacttaaaaaaaacaaactagaatttgcctgtgtgcagccagtaacatgtctatttaacctggacaccttttgaggaatattctcagattgcccccatgctgtttataagacattgttccttatacacctgtttatgaatgaaaagaaacataaggagtgggtacaaagacttctatctatgaatgattaaaaaggctagagtacgaatacttcttgaacctttggtactaaatgcttttcatgttctatataaatgtagaaaacattttacaaatcctgtaaataaactgtttattttttatagaaagcc

SEQ ID NO: 36624 - DNA, 19434 bp, Homo sapiens
cgctcgatcttgggacccaccgctgccctcagctccgagtccagggcgaggtaagggctggagtcgggcaggaggaggggtgtgaggctgataccagagaggacccggagcgcgaaccagaggttcgacctccagggcagcgcagggtaccccggcttcggagcgggaagggagcgcgccccgtcctggagctccgactcccaccccatctgcgctgagccggaggcgctggtttgggctccaaggcccgcctccttggctctgcccgagcctccccgcctgccctccgcgctcctgcgacggggtcgccacaagctggacgggatgagctaaccggactgtcggggccccaggagtggctgaggcggggccgtccaaggcacccacacaagacggcacaactgcctgcgagaaacaggcccggccctgtggaccccaatccgaggctccttcccctgctcttcgttcctaaggggcccaagctcacggcggcctccggcgcggtgctcacccgctggcgcaggaggaggaggagctccacatttgggtcgctccgagccttgcgtgcggtggcctagccggcctggcgcggtccctgcctcccaggctccgcagctgtcgtcgccctctcccgcgccctccccgcctccgctctcccgggcctgctccggggtccggcggacgctctgcgcgcggaatcccccgtactggggctgcagcccccgcgtctgcgccacttgtcgtttgcagagcccacttagtgcgcgctagctgggcagggataggggtcctattcggggcgaagggtctggatgcgagcagagaaagcggagggtggaggaacccggggctgcgcccctggaacgcccggccgcaggcgaggtcctccgcgcgtggaggccgccaggggagtggaaactgacagagtcgcggggaaggggcgagaagcgggttgggagtgagcgaaggcaagcgagagctgcgagtgagtgcggaaggagggccaggaggggtggcggctgggtggggagagagggtgcaagacgagcggcgcgtgtcgggagcctttgggctgcgggtgcgttacaggagagcaggcgggtaggagccttcgcgggggccgagctcggaaggcggacggctgtgcccgcccaggggatgcgcccgggccggccgcgaaggtgccttcttccgggggcccggacgaccctgacacggcacgcgcgcgcttcgcagcctcaaagactccggggcctcgtggtcactggcgcaggggatcggggcggggtgcccggagtgcggtgcctcgtggctgaagggcagctcttctccccgcagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggagaacgaggagaagagcatcttccgcatcccctggaagcacgcgggcaagcaggactacaaccgcgaggaggacgccgcgctcttcaaggtctccggcctcgggagccggcgggggcgcgccggggagggcccagagacagagcccggggtccccggcgccgcctccgaggcgagcccaggggaccgcgcggggcggacgggcgggcggcggaggcatcaggtggcgtcgccggagccgcaggaggaggaaaggaggcctcggctctcagcgggaccgcgggggccgggagccgggtcctgggcgcgtggaggctgcagggaaaccgctgaaggcccggccgggcccggggaagggcggccaaaggcttgaggggttttgcgcgttcgtccgtgcgttctcgtttccacgcaagcctcccgcccttcctccgggctcccgtctgccgcctccgtccgtgggtccccctcgccctctccgtgcgtccgcgcctgtgccggcggctgttttcgtctctcaccgcgtctctgtttctcttttcgctgcttttctctctgagtctctctctctccatgtttttcctgaggtcagcctctcttctcgctcctgctagctctctgcgggtactcccacctctgtctttctctttgtgtgtctctgtctctctctttcccccatcgcagtggaactcagggcctctgtctagagctgtctcccttgccctttgcgcgagtgcacacacgtgtgtcgttgttacgattgttctcccctaaggcagtttacccagagaactacgtgtctgggcccagcccccacctgtgggcagagcaggggaaggggacttcctccgggaatttggtctcaatttgctctcagagtgcctcagctgtgctgccatccagatgtctcctgtgggtgacagctcacaccacagctgtccttagtcctaggcaagctcactcagacactgggtgggtagagccccctcaaggaacctccgcatctcactctaccggttataaatacccagaaaatgtgtcttcaacttggcagtgatagggtccaagatggaaaatcattttcctagagcatagctggggtctttcagtttacgttctgagcaacggtgtaaatctgaaggacctatgcgccattctttcttttagaaatacaatttcaagattccttataaaatatctgtattttgggtttagcatggtggctcacacctgtaatcccagcactttgggaagatgaggtggaaggatgcctatgcaacatagtgagaccctgcctctgcaaaaaataataattaaaaaaattagccaggcatggtggtgaacacctgtaggccgagggcccagctactctagaggctgagataggaggaccctagaactcaggagttcgatgctgcggtgagctatcatcgtgccactgtactctagcctgggcagcagagcaggactctgattccaaaaagaaagctaataaaccagacatgtattttgacttttcgttctcttcattctttcccaccaggcttgggcactgtttaaaggaaagttccgagaaggcatcgacaagccggaccctcccacctggaagacgcgcctgcggtgcgctttgaacaagagcaatgactttgaggaactggttgagcggagccagctggacatctcagacccgtacaaagtgtacaggattgttcctgagggagccaaaaaaggtaggggctctcctgaatttgggtcacctaacagaggcagccagatccttgaggcaccttaacttcattctgagcatcactttctagctttccttttgtattgcctgcctgcctgccttctgcctcacagtgaagcccagcctccttgcctgagttatgtgggtcacaagttgaaattcctgtggggttcagcataggagaattaatcacactgtatgcctcaatgtatatgggggggggtgcattgaatatgtgttttccagttagtctttcaaaaaaaaaaagaaaaaagaaaactggataacttgttaaaatttacttatctaatagtctttagtgagtgactattttgcagaaaaggagtaatgagaggaatatctcatcactatgcatggtaataaaactgtcaacttttaaagtgtaacatggtcagctgaggtgtttattaaaagtcagattcctggacccctcttttcaagattctgaccagtgtgtctggaagagagctcaggaatctgcatctggaacaaatccttcaggtgacctcacttgggaaacatctggctggcggggtcctttatgtcacaaggcacattcgcatgccatctgtcatgtatttctttacctgtcctgtacaactcagaccttgtagaaaaaaatcagtttaatagcatgaaaaaataacttcccaagggagttgctgaaaaataccttatttgtcaacaccgtgttatgcattctaagaattaaatgctcaggtatttttacaagatttgacatttagttaggtcagttcctgtttttacgttgtgccatttcccttttccccaaacatgtaggagccaagcagctcaccctggaggacccgcagatgtccatgagccacccctacaccatgacaacgccttacccttcgctcccagcccaggtatggtggagggcactgggctccctgagggcgaggctgtgtgggccagctgcccacatggccagagaaccacagcagcccagacagcagaacttgccatttgctatggctgctccaacagcccagaaaaaccccaggtcactgaacgaatgtctcactttccacacggtgctgccattggtgtggattttaagttggggagggtcgggcgtgtccgcctgttggaatatgcttctcaggtcttctgggaaacagatgttttgtggaagtggaagattttggaagtagtgccttatcatgtgaaaccacagggcagctgatctcttcaggctttcttgatgtgaatgacagctttgtttcatccactttggtgggtaaaagaaggcaaattcccctgtggtacttttggtgccaggtttagccatatgacgaagctttacataaaacagtacaagtatctccattgtcctttatgatcctccatgagtgttttcacttagtctgatgaagggttcactccagtcttttcggatgataaaatgcttcggctgtcagtctaataagggattccctgaggagtttggaggctgtaagagcaccccccgtctcaatgccagtgcttcttatctcagcctctcctgcactcctttacccccgtctcgatgccagtgcttcctatctcagcctctcctgcactcctttacccccgtctcgatgccagtgcttcctatctcagcctctcctgcactcctttacccccgtctcgatgccagtgcttcttatctcagcctctcctgcactcctttacccccgtctcaatgccagtgcttcctatctcagcctctcctgcactcctttaaccccgtctcgatgccagtgcttcttatctcagcctctcctgcactcctttacccccgtctcaatgccagtgcttcctatctcagcctctcctgcactcctttacccccgtctcaatgccagtgcttcctatctcagcctctcctgcactcctttacccccgtctcgatgccagtgcttcttatctcagcctctcctgcactcctttacccccgtctcgatgccagtgcttcctatctcagcctctcctgcactcctttacccccgtctcaatgccagtgcttcttatctcagcctctcctgcactcctttagcaggttcacaactacatgatgccacccctcgaccgaagctggagggactacgtcccggatcagccacacccggaaatcccgtaccaatgtcccatgacgtttggaccccgcggccaccactggcaaggcccagcttgtgaaaatggtaaggaggataccagtgcaggaaatagaagagctaattgctaatgtggccatgggccatggcgaatcctggtctgtcctgggcagcaccaaagctctttccccttcttagaggctgcgtgtgcagctcggggagaggggggttttctcactcctgtgggatggtggcatcccacagccaagtttactctcaggatccatgctaggcactgcccttcgtgggatcttatttaaacaccacagagatcactccaggcagtggaaaacagccccccactttttatatagagaggagattgtggaagctcataaataataagtagggatgctgggagattattgagctggtatatttctctcgaatagtggtgtgttcattgttgctattgttggaattagaggtgatactaaaaaaggaacggaaaaataccatggcaaacacataaaacgtctctacaggtgcctacctaccactgggtcccagaaagacttgctgattgtggattagatgtggtcccctgccctcgggagttccccagacatcaaaatgagctccctcagcagaagctctcattagctgggtgcagggagaatctagcaatgcggtaactcaggccttcaggacttttgagttagttacttaaatggaagtcctgagacaggtcaacacactgaaccctttggatgttttaggaatatttgttcctttgcaatttggcctttttttccccagtcatgttcaggttatccttggctgcaggtagtgaagaggtgtaccactctttaatgtttgtactgagtggcatgttcacaaaaaagctcagaattcagttgcattggcttttcaagagggatttgcagcaagggctggtttccaatatggtagtggaggaattggctaacataaaactagctcctgaaattcagacttgcgtttactgctctggctctatggaattagtaaccatgggaaagaggcaatgcttagaactgtgtaaagtgatggagtaggtagagacctgtcttgaagcatcggtaacagtaaatgaagcagcagcaagatcaggtgttctgtgccacattctttttccattcatgtttcatacaacattgtcttcaggaacatggttcagtgttctcccaacccacaagagacaagcaaaataaaaatggactaaataatttgctagtttttaattgggctctttggcacagactcaagtagacctgaactctcagctctgttgtgaacccgctttgtgaacaaggacaaagcatgtcatctgtctctgagcctcagtctccctgttagtcagttacagagagagcgctccaagtttccttccaaagctgtgcactggctcgtttctccatcagctttggttttccagttggtctccagctcatctttgcctcacaagagcgtgccctgctagttgctggtgctgggagtgggtgggaaggtgattgggcgccagccccttccttcccaggcttcacacacacaccccaggaagccccgcggtgcgtcggactctctgtctagacatcatctgatttttatttgcaaatgcaggttgccaggtgacaggaaccttttatgcttgtgccccacctgagtcccaggctcccggagtccccacagagccaagcataaggtctgccgaagccttggcgttctcaggtgagtgcagggtttgctcctggaggcaccgcaggaggccagcctctgctgccagctctgtcatctttgggcagattcgatgggactttagacacttgctttgctccctctggggtctggagtagatgtagacacatcctgtgtgtgaggtgaccagggtgatttaggagcaccattagaaaacctgacatcactgcttgtggttctgctgaccgtttcagccactggcttgaatggagtcattttggcttcttcactggcacctctctgaatttctaggaatgtgcctttacctttaccgagggcccctcttcagccaacattctcacgatgtggaataattgcttggaagtgtagaagggcttctcattttgagaagctgatcatccttccaggttgagccacaaataagtcctcctcctctactccctggggacattagttctggtccctcatctctaaaacattgatgtgcctaagagtaatacacattttggtcttcctctgaactttaatatagcttgcaaacaaatatggattcaatctgatttttaaagttttatttctaaaaaaaaaaaaaaaatccctgcaccatggagatcttacctactataaagaaggcacctctaggcttggcaagcacacgtgctatatgtatatttatttttcagataatattttggattgtttttaaatgggatttgtttttatattaaaaccaaatagcttaaggtttggaattctcatcttgccctctggcatctttaaaaatcagtgatgaaaaatactaactaaattctgaaggtttcagggaggcgagagttgtggcacttttgctgctcagaggggagctggagtttgacctaccagctctttctagttgtgaatgaggcttgcacctttttttctgaggtgctcgtgagtaactgaggatgccctttgggaggaggtgcttctgagcaggaaggcttgtgtttgtttttagaaactttcaaacccttgtcttgaacacctaagacttgtgtgggtgcctgaagagtaggaaataaacagctatttatatctcggcaacctcgtgatttctgatgacattaaatgaaatgaaacctgccccgagaatcacctcgaatggccaacacccactctctttggggcgcactgtctgactcgctttcagacagtgtgttgaagcagagaattgagacagtgatgtgggttaagtctcaaaacctgctgttgaggaataagatagttttgtgggtttctttttttggtatgcatgatacagattaattatcagccatgagcacatttattagataactgtgattcccattgattttggggttccatacagttaccagtggcagctgcctcctgtctgtgccactcccctgcggtctggctgaggagcttgtgcaaacccagcttggttctttcaactcatgggcgatattttaaagaggcttctgaaatcagcaaaacgtttgtaaatggattcatcttgtttaaagtttcagagagcgcagttttagagttcttttcaaacttaaacacaaagcccagtgggaatttcagcagactttacatgaacttttagagtatttttctcattaatttctttcttttcacaagaattaattttgtgataaaaacaccacatatccagtgtggaaaactaatttaaaaatcagaaaaacaaaaatggaaaataaaaatatcacattctaccacccagaaatcaccattaaggcctcagtgcttaccctttaatgtgtgtatgtgagtgtgtttatatataaattatatagacataaataattaagcacctaattctatatataatttatatatgtacacacacacacacacacacacacatttgctttttacctaaatgatgtcatgttattattttggggacgtttcaggtatgtggaccgacttgcttctttctgaaacaccgttatattttttgctagtataaattaaacttagggttcatttcctccaaagtaaaaattgatttgcttaaagatgaattttcattcagtgacacatgacttaaatgacatcaccactatcatcatcataattcacaaataagacttagcaagttcttaatagtgatgctctataataggaattcaacttacatttccagaaaattaatgaaagatacacttgttccttaaaaaaagagtcggtggccacatacgtttgtaatatgctggtttagacagattaaatgggtttctttccacgggacttctccaagtgttgaccgagctcatgctgtctgtggatctctgggggagacaagggcacgctgtgtttcccaggcctccttgacgcgggaaccttttgttcccccacgggacatgtgggacactagagttccaccacaggtgcttggctctgtggagtcgttggcctcgaggtggtgtccttggcccccagcactgactccggagctctgtgtttgcagactgccggctgcacatctgcctgtactaccgggaaatcctcgtgaaggagctgaccacgtccagccccgagggctgccggatctcccatggacatacgtatgacgccagcaacctggaccaggtcctgttcccctacccagaggacaatggccagaggaaaaacattgagaagctgctgagccacctggagaggggcgtggtcctctggatggcccccgacgggctctatgcgaaaagactgtgccagagcaggatctactgggacgggcccctggcgctgtgcaacgaccggcccaacaaactggagagagaccagacctgcaagctctttgacacacagcagttcttgtcaggtaaggcacctcgttatctgttagaatggaggtggtgatggcctgcctgccacaggggtcagaaaccacagggtccctcccaccccaggctgaggtcttcctcctgttgacttcggcgcccactgggcttggggcttgactccagtagagatcttctgtctggctctgttgtgggcagagagtccggatcagatggtccaggtggaccatggctcaggctgttctcttgcaattctggttttcagcagtcgcctcttaaaacagttccatttcattgcactatgatctcgacaaatacgtctgctgatgtggcggctcttttcaggttcccagaaaaatcataaaggttggaagcatattgttaacattcttggttgtcaggtgtgtcaccctcatgcagatgctggcccacgagtgagacggagggtggagtggactgtactggttttgcacaggagaagttataggagagtgctataagttggctctgtgatatgaacatttctaagcatatttttcagaaccagtgagttttgtttttctaccttggatttcatgacaattcagcgaacctctggctggcttctgtgaagcccctcgccctgtcatgctgggcttcctcactggctttgtggggctgtccaggtggagggagcctcccgcgtgggagggagctgctctacccgccactcgccaccccaccgccaactcttcctctgccttttcccagtcctgtcccttcctgagccccttcagaaactcctgtgtctttgatttctcatgtgcctccccttttcttgaatgtgcttcttcattcaacttatttaaaataaaaatatgacacgtctgtgtgctctggcactgttgacatgtgctcgtacttctgggtgtaagtgacccaagtttttgtaagctcatccagattttcttttggtgcccaaagcaaatatgtccccagataactaagcttcaggccaggtgtggtggcccatgcctgtaatcccagcactttaggaggctgaggtgggcagatcacttgaggccaggagttcaagaccagcctggccaacatggcaaaaccccgtctctactaaagatacaaaaattagctgggcgtgatggtgggcgcctgtaatcccagctactcaggaggatgaggcacaagaatcgcttgaacctgtgggaggcggaggttgcagtgagctgagatcgcaccacggtgctgcagtttgcaggacagagcgagactccattgccccccgcaccacaaaaaaataactaagctcacacagaggctgaccataggaagagggagaactgtgctggttccccgaggcggcggcaagtgaggaagtcacctggggctggacacctctcattctaagggcagaaccatccccaagccctggccagggcggtcccatccttcttggggttgggcatggtgttcatgggggaccaaggaaattgaagggcaactggggggaccccccctcccctgtcagcatctcctgtgtctgccttgggatctggaagagctcacatgggccaggaaggctaaggcccactgggcctggatttctgaagactctggaccttggtgccagtggattcagaagataccacaaggtgagggctttctaatgaaagtgtcacaaggaactggcactggcttttctgagtgcctcttgctgggcgtttttagggaggtagagcccccgtggtgactaagctggaaggtgcacattgagtcacaggtgcactgcgtgagagacagcacaggcagggggtggacgcctgtgagtgtcctggggctgtagacttgcgcgactagaacttactattaatctgtgagcaagagctggtcttggctttcattccttcctctgtaaccaagggctgtgctctttgcccactgcagcctctcacctcaaagtgttcactgaggttcaaggaggatgctgtgaacgtaaaaactgcagctgtgccaaccagcttctgcataattaaggattcccaccaaacactctcatgttatctagggttggagccatgctttctcagagaattgtgccaactcgccattctgattagcctgtgtaggtgtagtctcagatcacggcagtgtgaatgtattttacagattctgactaagtcatttgggtttgatttgaattctggaaaaaaaaaaaagcaggaagtcaaatagtcctgtaagttagctagaaacttctgttcagttgaagagaacagtggagatctttgatatcttcctattcaggtctgcacagcactagggacagcccccagggcccggcccgagggtgtgtatctgataaggacgcgtctgttctgcagaagctgtagcggctcctgtgtcaactcgtttcttttgcgggcgtgacattttattgtagctacaggcagaagatttgtcttgtgtacaggggagggagcatgggctaaagtcaggggatgggcacttgtctttccaacaatgttccagtccgttttgtatcttttgggtaggtgtggtggcttcaggatgtacatgtgtatatccacaagcgggaggccaggggggctgccccactcctgttctcaagtcaagttactgttccatccctggagacaggcaagaagtctactcagagttacacagttcaggcatagtgacagtgggactcagctgccgatggctggtgctcagtcaccacgttgacgttacatattttctgtggtgcctgagttacgtggatgtccgcagtagcacagatactggattatgtgggctctgtagtgaggggatgaggttttaaaatgatcctgggatgtcgaaacattctgattttttaaatgaaaacttgtccatggcataaattggtcttttgccattgcgtgactacgtttcttgttctttatctcccgacttcactgtggtctactaccttttgaatcttcgtgggtccaatgctgcaaagcagtgttctttagctgtcgactagttcctcttgaagaatcgagggagaccgagggccctggggggaaagcacccaaaggaatgcatacatgctattttgtatctgagatgttcacatcaagagccccactcagcggagtaagagtgctcattcctcttgcagtgttcagaatcacagtaagctcttgcttcctgtttaacctggtgtgttcggtgatgagggtttctgaacatggtctctttcttgtgggcttctacagagctgcaagcgtttgctcaccacggccgctccctgccaagattccaggtgactctatgctttggagaggagtttccagaccctcagaggcaaagaaagctcatcacagctcacgtgagtcctcagttacactcctaccatagtggcttcctgttctttgtaaaggccagagtttcatttagaaaagtcccaaatgaaaagtaaatgtcaaatgacctggaaaaataagcgtaacccttaaactagtgagggaggaagcatggtccaacgagcagcacagtctgaggactcacgtgctcctcccagacttgagatctgctcatcaaagaaccagggaggacagcctcaaaggagggtgcctctttccccatcttttttatttttcaggaaagttgtcgtatttccattttatagggattgaaaaagattgatggttaaagttgccctttaaaattctccaggttaagattgctgtaagaatgctatctagctagtggatcttcattcaatggaaaagcttttcccaaatgagaaactatccattccctggaggcattttgtaggtctctgcagctgtgtcctagcacctcttttatttctggaattttagaaattatttaattattgggcatatgatatttgaaagaggctgaatctttcaaggaattcaagcaaatcagaccctctcgtaatgttctctagcatagctcaagatgggttcaactgtggcaagtaacactaaaagggtagggttaggattagggttagagttttcttttttatgagaaaaggtttccatagataacatgaagcattaatttgccatgggaaacagaatcttgaacccttaagacttttgaatttgaaaacttcacattgctacatacttgcaagcattattaacgggcttgcatgctgagcaataccaggtaaaagttacaccccctaacatcaaagttctcatcatgttctagctctgatgctatttctcattgagaactgaaatgaaacatggtttaatcttgaacatacaaccccccttcttgattttaaaaacaaagaccagccaaccaaccagtatataatcccatagactcaggagttttctcatgagttctctccagtgattgacttaataattgatatgattgttgaaataataactgatacattgttaacaacaggaattgctaaatgactaaataaacttggcattgataagcagcatttaagaagttgatgatcggccgggcacagtggctcacgcctgtaatcccggcactttgggaggctgaggcgggcagatcatgtggtcaggagttcgagaccagcctgaccaacatggtgaaaccccctctctactaaaaatacaaaaattagccgggcgtggtggtgcgcacctgtaatcccagctactcgggaggctgaagcaagggagtcacttgaacccaggagtcagagcttgcagtgagccgagattgcaccactgcactccagcctgggtgacagagtgagactctgtctcaaaaaaaaaacaaaaaaagaagttgatgatcagctcagctatcacatcaatccagttttaaagttgacatggatgcaagtcactgtcctctaagtcagggaaagatggatccccagatgaccccctcatgctgaagacgaggctgcgtggtccataaaatgaataaacacacgtgtacacctatgagttccacttttaaaaattattaatttaattcatttcaggtacttaggagtttagcttaagtcgtcatatataaaatacagtctctaatatcatgattgatggagagcattcagcttgccttagatgctgtaaattcaggaaaagctgaacattaaggcgtttttgttttttggtgagtgtgatccacgctaataaccagacagtataaatttgaggccagttagcttctctttttccacaatagtagttttgttgttgtttaactttactttttatttcttttacctctggttgagaactatacagattacctagaaatcaaatcattcaggatgagctccttgtttctttcaaactgcagttgtggaaaaacaaaatcattggcctaaattaccctgcagattccctcagacttccttttaatttgatcactttacttgatttgatgcagttttagttaaatgtacattttaagtggcagtcgatttgaaagtaacatctttaacccagaattaagtcactttggctgtttttttacatgttgatctatggaaggactaaccaaaaaattgcttctttagatggctccaaatatgaaatgttttgatgtgttctaggatgtaactttgggctttacgttactgtctccttagaatctgagtgctgtttaatagtgagccagttgcaggatatctcagtaatgtctttttaaaatctcttattaaaggtagaacctctgctagccagacaactatattattttgctcaacaaaacagtggacatttcctgaggggctacgatttaccagaacacatcagcaatccagaagattaccacagatctatccgccattcctctattcaagaatgaaaaatgtcaagatgagtggttttctttttcctttttttttttttttttttgatacggggatacggggtcttgctctgtctcccaggctggagtgcagtgacacaatctcagctcactgtgacctccgcctcctgggttcaagagactctcctgcctcagcctccctggtagctgggattacaggtgtgagccactgcacccacccaagacaagtgattttcattgtaaatatttgactttagtgaaagcgtccaattgactgccctcttactgttttgaggaattcagaagtggagatttcagttcagcggttgaggagaattgcggcgagacaagcatggaaaatcagtgacatctgattggcagatgagcttatttcaaaaggaagggtggctttgcatttcttgtgttctgtagactgccatcattgatgatcactgtgaaaattgaccaagtgatgtgtttacatttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccgccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtgaaatgagcagcccttacagtattgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctcccgaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagtttttttttgtattgattttcacagctttgaggaacatgcataagaaatgtagctgaagtagaggggacgtgagagaagggccaggccggcaggccaaccctcctccaatggaaattcccgtgttgcttcaaactgagacagatgggacttaacaggcaatggggtccacttccccctcttcagcatcccccgtacc

SEQ ID NO: 36625 - DNA, 894593 bp, Homo sapiens
  misc_feature (112862)..(113361): n is a, c, g, or t
  misc_feature (135376)..(136707): n is a, c, g, or t
atccattcatccatttatccatccacccatccatccacccatccatccatccacccatccatccatccacctatccatccatccatccacccatccatccatccattcattcatccaaatatccatccatccatccacctatccatccatccatccacccatccatccatccattcactcatccaactatccatccatccatccacctatccatccatccatccatccacctatccatccatccatccacacatccatccatccattcatccatccatccatccatccacttatccgtccatccatccacctatccatccatccatccacctatccatccatccatccacgcatccatccatccattcatccatccatccatccatccacccatccatccatttatgcatccactcatccatccatccacctacccatccatttatccatccactcatacatccatttgtccatccacctatccatccattcatccattcatccatccatccatccatccatccatccatccatccatttgtccgtccacctagccatccattcatccatgcatccatccatccatccatccatccactcatccatccatttgtccgtccacctagccatccattcatccatgcatccatccatccatccatccatccactcatccatgcaataataatttagccccgaatcatgctggatgcttggagtatgaagtccgatatgccacagtccctactctagttttgaggtgtccctactctagtttaggggagatagactcataaagagttattgttgttataatatattaaaatctacagtgactactttcatgaaatacctggccattcacctatatcccggaacagaatgttgtcagtgcatggtgacaagcatgttcaccaaggtggtgagatggcagagatctgtgtcttcccatttatcatgtttgatgttttccaaattgtctgttttccgaatgtattatttttataatgggagtggggattctttaaaacttcaatatttctatattgtctaaaagtcgattggttcttgggcccatttgacaccttacctaatcaactctccatccttgctgctcagaggctgccctcccccaagactcccccagcccaccccagaacaccagagctttgcaaacctccagttcttgctcaccttgaattctgtctgcagcgttcttaccatcacctttgcctggaaaattccttttccctcaaaatctagtttaaaggtctgctttcctgtgtcacgtggcctgcctgcctctatgattttcccccactttcagtgttcttcaaaatgtgctatttaatagatgcatgatctcccctatcagtgcaccatagtttatttcatcaacccttggtatgggatcatttaggctctttctgacatttgctattataaataatgccttaattagccttctccttcacaatctttgatcatatctctgtttccttagaatagatttctagaaatggaatctccagggcaaagagtaagaacacttttaaggctcttcatacataattcaaaattgctttccaaacaggttgaacaatctgtgctccagcaccacagtgtaggcctgcctgcaggaagtcattatttcaagtgtttgttactttgacagctgaagatgccactgtttcattgttttaatttgcatttctttgactgtcagttattttgagctttgaaaaatgagcttactttaaaaagtgtatttatacagtgtagtggtcaagggtgcaggcttcagagtccaagagatgttcagaccctggctctgctgatgaggacctagtgacctggggagccctcgtgaagatgaaatgaggtcatgcacacaggtctctccgctggtgtctgtgacctgagtgtgcaatcaacattagcttcattgttctcagagttctgagagcttcctttgttttgtgcaatttctgtgcatgctttctgaccaatttgctagtggagtgtttttcttattaatttaaaggagctcttctatatatttaggagttcaaccctttgcttgccatatttatgctaatattttttcaaattttttctctttgcatcatttttactccaggagatttttattttatgtattcataccttcattgatggttccttccattaattttatgccgacaatttcttcccagaactgagatccattaaatattgtcctctaatatatattgttttacatttatcttaaattcacaggcaaactaccttggtataaattagggaaaatctaacctgattcttttccagtgtcattcagaaaataattcccttttacggactcaaaagcagaaatgtgacataatcagatgtgtttttaaatagcttgctggctccagtgtggtaggaaaaaaaacagcaatcataaaaaacaaccaacatttatttagtacttactgtgtacaggctgtgttctgagtcctttgcagatattcactcactcaaccctcataatcaccccataggaaacaaaggcttacgctggggtttaagtaacttgcccaaggtcagagctagaagcggctgaaccagggatgggatggaaccaggaaggggccatcagagttaagcagataagtcaacgcaccagtccagatgaggtagagggactggcctagaccacggcagggaaaggagaggagatggcatactggtcacgtattgaagatatgagtctgggatttggcagtcaaccacccattgcggaccacgaggacaagggagagctctagagccccatctcagcatgcagctgttaagtccctcaaagaagacttgcactttccgtaaaaccatcgccttcctctccctcactgttcccagcatccccggactgcacagggtagaaaagcagcaagtttggaccacaatcccaaataccgaaatcccaaaagatcaaaatcgctaaaaccgccaacatctaacatcccaaaagtggcaattacaggacaagttttttgtttgtgttccttttctttttaaagtttttttttcactattttaaattgtcagcattttcattcacagttctgcatgctgtgtatttcatctttgcatcatttccaatactggaggtataaattgtatagggactttttatttttatttatttatttatttttgagacagggtctctctctgtcattcaggctggagggcagtggcatggccactgctcactgtagcctccactgcccgggctcaatggagcctcccaaggagccgagactacaggcacacatcaccacgcccggctaatttttgtattttttgtagagacagggtttcgccatgtcatccaggcttgtagagatttttagagttctaattctttatgcattttttgcagatctgacttcataaaagtgaactatcacaatgctgctttgcaagctgtgtgtgagtgtaaaagcgttgaaacttcctcaataaatgaaaagatatcttttttgtacatctgcatttgtgaaagacaacatttctccagatctctctcagctctttgggtgactgcatatgtatgtggcggggacccatcgaggttgctgcgcgatcttgtcagtagacttaggttgtccgtcacggcacttcaggtgaccgcagttatacgccaggtgcacacaatcaccaaccatagcgatctgcattaccacatctccctttctgacccatttccttatgaatacggttcatctgctcatagttgatatacctgtgtgactctcattagcacacctgtctatgcttacaaaaacatgtgtgttcttactgcctgttttattaaagtggcctatgaagtgttccattgtgctttttatgtttaatttttatgttttatgtttaattttaaaacatacgtttatgttttgtttttatgtttctcaaataaattcccttttaaaaatgtaaatattttctaacattttaaaattattttttacagaatcagggttttaggattctgatttttcaggatttcgacactcgggattgtgtctattgggattatgatgcactcccaacagcaggccggtcctcatctgtcccaaacagctcagatgcggtgggcactgatgtggccgggtgggctcttcgttcccgcccactgaaatcccacccacctgtttcttttcctcttcttcccccagccactcccttccaagaagcctggctctggcctgaggttcctggggagggaaggtccacgcagtggtccaagtggcctgcctgagtcacacctgagccatctagtcacttctccattagctcacactctctgagctacagaggcttcaggtggtgttagggggcccagtgatcctctagtcgaccagctcttgcagaaccagccatgactaggccagtcattcggggtgtaagaagccacggtcagtcctcactctggaccctccgatcagacgacgggcctgctgttctgagaccgaggcagcatctctgcgagggctgcaacagctgctgggctgagcgcagaccttcctgatacgcctcatctgtgacctctgggtggatttgagctcctggctttacctctattgcctatatgatcacaacaagtttcttctctgtcctctgcttcctcttctctaagctgaagccattgaagcatccagctcagttttcaaaaattaatagagattcatggaaataaggtacccacaggattgagtcagtgccagacccatagcaaactctcaaaatatactagcataaaaaaaaaagtgtattagtctgttctcacatagctataaagaaatacctgaaactgggtcatttataaagaaaagagatttaattggctcacggttcagcaggctgtacaggaagcatggggacatctgcttctggggaggcctcaagaaacttacaatcatggtgaagacaaaggggaagcaggcgcgtctcacatggccagaccatgagagagaggtgggggaggcgccacacacttttaatcaaccagatctcatgagaactctatcacaagacagcaccaggtgatggtgctaagccattcatgaaggatccaccccagtgatccaaccacctccaaccgggccccacccccagcactggggataacaactgaacatgagatttggtggggacacaggtccccacctcaccacatcacacaatttctctcctttctttccaggtaaccagtttgcaagggcttgccgtatcctccatagatggtgtaattggaaacgcatttgtgggcgtggcggtgtggtctgggggaggagccctagcccccctctctcctccaaaactctcactggtcacagattcacgtgtgtttataattcctcattttaagaaaatatcatgattcccattttacctgccattttcccctcagatggctgagggaagagtctgggatgatgattggctcctgtgctctgagtgtgcaaatgctccaagggtgcagccatgctctgggcactcaagtcagtcttagtcagtgctccttcctcttctgccagctcctcccgttccagtgaccattcctcttgctgaaccggctggagaaggcgcgcgcggtcccaggccgctgtctgaagggctttccatttgtctctgcagacaatctcatattccttttccagcctctgatggaaggggcgagggggactcctccaaccagctagctgtgcctttctgacccaggcccaggggctgctgcctgccgtggcaggtcactggctgtcctggaacttcctggacattgctggtcttgcatttcctatcgtggaacacttgctccatgacacaggtctacttatctgtcaacaaaaccacctcatttacctgcttctccacccacctccttccagccatctccgcccctgccctcactggtgaatggatgaattacccaacatggctttgtgctgggagcatggcctgccttggagagaaccacaaacaatgacctgggctgcatgaagagtcaggtcagcacactggtgaggttaagtcaactcccagaggccacgatgacaggccacgaagagtcaatgagagccttttgggtttgatgcccgaagcactctgtcccccatcacagtctttaggggcaagtgcaggagcctccagccagtcagaagacgtttcctccaagtgtgcagccataggtcatcaaagcgaagggtatttagatttctcaaacagaatcagtaggagttagagagagagggaagaaaggagggagggaaagttattgggaagacctggctcccatggctatggaggctgagaagccccacgctctgccatctgcaagctggaggaccaagggtgctggtgatggtgctgagattgagtctgaatccaaaggcctgaaaaccaggagagcgatggtggaactctcagtcccagggtcagagaaggtgagaggagatgtcccagctcagcagacaggaggcatgagaggactaatatggtttggctgtgtccccaccctaatctcaacttgaatgttatctcccaggattcccacttgttttgggagggacccagggggaggtaattgagtcatgggggccagtctttcccatgctattctcgtgatactaaataagtctcacaaaatctgatgggttatcaggggtttccacttttgcttcttccttgtttttctcttgctgccgccatggaagaagtgtcttttacctcctgccatgattctgaggcctccccagccatgtggaactttaagtccaatccaacctctttttctttgcagtctcgggtatgtctttatcagcagcgtgaaaacagactaatacagggtcaatttccccttcctccacctttcgttctatccaagccctcaggcgattggatgatgcccacctacactggggagggccatctgctttactgggtctaccacttcaaatgctaatctcttctggaaacatccacacagacacccccagaaattatgcctaatatgggtaccccatggtctagtcaaattgacacctaaaattagtcatcactcagagtctgtgtctctttgcaacattaagtcaacctccactcccctcatcctctcctcccagccacaggtcttgccccaagaaggacctcccaccccatccttggtccttccaggagatgcagtgtcttccctaccccttccccagaacaccggtgattccgacgcctccttcttacatgcaccttccattcactcattctctgaacagcagatccagtggttaccaccctgggatcaagtccaagtaatggatatttagtaacagtgagagcttgggtgagtcattttgcctctgagagcctccgtacctccatctataaaatggggatgatttcttccctgtagggtcatcattaagaggttattacctccactgaaatgagtgagtagagcagaggcatttgtcaactgttgcaaatttggcagagctgggcttctgcaaagggcagcttcagattctgtgacccatggtggtaacaggactaatgctttggtctttggcagcctcctgggtgatgctcaaaaaggtgtcggggacccgttgggcaggtcccaggagagctgactgttggccttgggtcatctggccagcagcaccccttttgacaccatgcctctctgcgtgccccaggaggtctactggccttctccactgtgccacctagcattggatctgccaagttgtgttggctgaagcagaacccagagcagacaccccaggaaccttccctggagtaaggcttcccccagcgtgcctgggggtcttgggcactgctctcaatgtctcccaagtattaacccatcttgttctcatataaccctgtggggtctgcattcactctgcaaatactgagtgcctgctctctgcagagtgctgtcgtacgccccagagacacatcagcacacaaagcctgtgaagacccctgtcactgagagcctcatgtcctaactgcatgactcagcaaacacaagacacgcattgtagaatgtgctggaaggagctgagtgtgtcacaactgaaatgaggtagttggggttgccttgctaagcagtgacttgatgcaagttcgatgacgaaccccgtgggattcttatgcccattttgcagatgacgaaacggaggcacagagcaatacaatttactgtattagtccgttctcatgctgctaataacaacgtacccaagactgagtaatttataaaggaaagaggtttaattgactcacagttcagaatgggtaaggaggcctcagggaacttacaatcatggtgaaaggggaaataaatgcattcttcacacggcaacaccaaggagaggtgccgagcagaagggggaaaattcccttacaaaaccgtcagatcccatgagcactcactatccctgataactgccctcatggtcaaattacctcccgctgggtccctcccatgacacatggggattatgggaattacaatttgagatgagatttgagtgggaacacagccaaactatatcacagagtacttggtcaaggtcaggaggcttatatgaggcagagggcacccaggaacacaagcgtctgatttcaaagcccatctctaaactaaaacacaaacttttccctacaaagggcctgggaggaaaaagtggctttgcaggtcacatgtggtctctgtcacctattctttcattttttacaacacttgaaatgtgagaaaaccattcctggctctccagcagtgcaaaaacaagagcggtggcatggtttccaaccccggctctgaaccaccaggctcagcactttccaaactaagttacctcttctcaaaaccccgcacagcacaaggaagaaggcacttctattttacagatgaggaaacagaagctcagaaaggtgaaatcacttgtctgtggtcatggagagccagacagacatgatccgggcacccttttcattctgtgcaacatgtcttcattcccacttttgacacattcttaaatccctgctttaaatgcagcattcatggccagacacagtggttcatgcctgtaatcccaacactttaggaggccaaggcaggaggacggcttgagcccaggagtttccgaccagcccacacaacacagcgagacctcaacaaatctctacaaaaaattaaacaattagctgggtatggtggcttgtctgtagtctcagctactcaggaggctgaggtgtgaggattacttgagcccaggaggttgaggctgcagtgagccaagattgattgtgccatggcactccagactgggcaacagagtgagatgctgtctcagaaaagaaaaatgcagcatccacaattcctcaaagaattaaacacagaattaccgtatgatgtagcaactccacttctgggtttatactcaaaagaattgaaagcagagattcaaagagacaatcacacatccatttcatagcagcactattcacagcagtccaaaggtggaagcagccaggtgtccactgacaaataagcagatacacaaaatatggtctgtccatacaacagaatattcgtcagccttaaggaagaaaatcttgacccatgctccgacatggatgaaccctgaggacattatgctgagtgaaaaagccagacagaaaagaacaataatgtctgattccagttatataaagtccccggagtagtcaaatccatagagacaggaagtagaagggtgggtgccagggcttggggagggggaatggggagtgagtgcttcgtggagtgacagtttcagtttaggaaaatgaaaaggttctggaggtggatgatggtgatggttgcaaaacaatgcaaatgtccttaataccgatgaactgtacacttaataatggttaagatggtaaatctcatgttagatattttatcacaatagttttttaaaagcaacatttatgggaggaataattccccaacccctgaacacctgagcgaatgtccatccgtgtgtcatcaacttgtccagggtgacaagggccaggcagcagccaggcctacgagggagggagtggggggagccaaggtccgggagacggaggctcactcccgccccagatgacagacccctcgcatcacacaccaggctgactcctccacacccaggcgtgagaggtggggaggggaaacaccctgccagcgagagacccgcctgcccaactccccccaccccaccatgcccccgcccagcctggctctgcagctgtagtcctaagctgggccactctgcccgtggccccttcagtgccttggcctcgaggaagccccacgtgttgggaagttgtggcaggcagggcctgcaacctgcaaaactcccagcttctcgcaggacatggctgcggtggggactttcccaaagacccaggtgaattcagctgacagggccaacctgtttgtctttatgatcccagtgttgtcacaggcccaggactgcctgtccaggcccagggaggagtcgcttggccccagaatagcccctgcaggaggtgagcaattacctgggcaaacaaagagagtgcaggtgtgccaggcgactcacacacctgacctcaaacagacaccacagagttcagggggccacccacttattggaaaactacattatattcatagtgatcactactatttattgaggtcttattatgcgccatccactgtgcctaagtattttgcttgtaataattcattaattctcacagccacccatgaagaaagcactttcacccccaccttccaggtcaggaagctgttccgaaaggtcaagtcactggcctggtgtcactcagtaaattgagatgtccactccgtggccccctctctgtccctagcacattgattaacctctgcttttcaagggtggattggattttggagattgacaagtgctggcagagccaagggaatgaagtgatccagccagaggctacgctctgagttccgcagcaggtgcagctctccagcaatgagcccaaagcccggccatgtgggtcctaagctcaccctggaggcaaaaatccaatggagagtctccagccattccagtcgggttctctggggtctgtccgtctctgctgttgggctgagcggtgcagaggactcaggggtgccctcaggacaatgcaatcccaagaaggctgtccccctcacacacacacaaacacaaacacaaacacacaaacacacagcatgtgcagcatgccgggtacacacaggtcaaagccaagccgagggtggtggggggagggtgggcttgtatagccttcaacacccacctcaaaagccacagagcatgcaaaggaccagacacaaggaaaaccccctcccgccaggcaccttccagaaggcacaggtcaggcagatggtgatggcagaggaatgtatcaggggaagctgaggtataaaggaccttcaacaagtttggtgacaagggaagaggacaaagtgggactgtgctagcgaagcatgttgatgagaggagtttttaagggtggaaagttctgagcagccatgagggtggaggaggaggtcagtgacgaaaatgctgtatgtgaattgtatccacaaatgatatgtcccagtcctaaacccggtgcctgtgaatgagaccttatatggaaagagggtcttagaaacgaatcaagttaagatgcggtcatgatgggttagggtgggccctaagtcccataacactggtgtccctgtaggagggaagtttggacacagacctgagtagagggaggatgaagtgaggaggcacacagaagcgggcgggccaaggccaacgtggggatgtagtgatgcagccaccagccacggaagcccaggaccacgggccactgacagacatgggagagacgcaaggaactgtccttccccagagccttcagacggaacacagccccacacacaccttgatttcagatgtctggtctccagaaccatgagaaaaaaaaatctgttgttgaattcacccagtttgtaaaatttgtggcaccagccatgggacactcatgcagagggtgacctgcttggctccaatttctcagagttgggcacaaaatcagccacaaccctgtggttgtgtctgttctgagcacagggatgcagcccaccccttcctttccgcactcttccctgggacagcagggatctgaggaattcctctaggggcctggctgcaggaggtccccgctccaaagcccaaaggaggcaggtgggagtaagtgaacaggacgggaaacgccgagcaggaacctgcatagtacgggggagcccccaggcctgcctaccgtctcaacaccagcatttggattccactaggaaggaaaacaagaagactgaaaaagacagagaggagcaggagagtgtgcaagggacagtctctgtcttccacattggctgtttgccagagcatggcctgttggcacccctcgcttgttcataggtggctgacaacatagccataaatccacctgtgccagtccatgaatggacaaagggcgagagatgaccctgcttcagccacagaggccagtgctcagactccagccagctggaggcccccaggcaggcgaatgggcttgggtttctaagaccaacacagaaatgcccaggtacactgtgctgcttttctctggagaagagagaacgtccctttcaccaagttattatttcttccttttaaaatttgattgttataacattgttttaatagtcaagtagtgctgcaaggcttgtgataataaacagttgttatcactgcacctcttcccacctccagctccctcccctgtgagtcatcggccttcaagtctctcagctgtttctcttgaccttgaccttcacacttccaacatgattacagtactattcctttcggttttatctcacttacaccaccacctcccacacactcccacctattccacctacccagcatcttcacaacttacacagttacacaattcgcaacctttggccaagtcaatatttagttctgatattactatgaccaccataaatgttgtcacaactaaaccacttagggaactaggatggtcttttctttttagtacaactttttgattttcctggggttaacaattgcctcattttttcataaacttaatttttttgtctactacttaccaattatcccccccccaattttctgatagacctataaaagtcctctcaacaaagtcaaacatactaagtaatcattcttttgttgttgctttgttgttgtttgtccttccccttggagacatcccctccagagctctctgtcctatttgtatctgggctggctgacctcttggcttgtggcacagctcccccttgaaagttcccttcaacttcagtgagaattccttcgtatttttctggtgctaaatctaatgtgtcctgtgcctcacatctttctcttttggggtttacttccttgtgcaagtgacacccataccacaggaacttgctgagaaagaatgcatgtgaggttcaatgatttcatcttgcataccttcaaacatctttgttctacccttacatttgatttttcatttattatttgaaaatgtggcttgccttttcagtaaggaaattcatgtcctgcaggtcggtattgttttgttttgtcttttggcatctttctcctctttctgctcgctctgagtgccaactccagagctggtctggctcaatttctctatagtgtgcacttcctgagttctcttcagtgaggtggatgagtcatctagccaggtggataacgaggaagtctcagggactaagtgtctctgacaatacattcagccactactacagtatgaagccagcccctcatccccaccttcagagacccctggtgcctcagattcctcggccattctggagctgctgtgcccgaggcttgtgtagttggagatcattttggcagtcagtgctgcttcagctttcactgttctgctgtgccagcacatcaccagggatcacctttggctgcatgaaccagaaccccattccagggctcaaccaaacagcactttaattttcttacccaagcaagcagtcctggcttgtacagcctccccaggatgtcaccaggaccccaagctccttctatcttgctgctctgccatcctgtgtcactttcttcctcatggaggcttcctggtcacaggacacccactccacctccagtctcttgttcacaatccaaggagatggaaggaaagaaatgatgaggaaccagggtggctgcaatgtcagcaacagtatttcccaggatctctagcagattttttttggggggtggtttgtttgtttgtttgttggggttttttgttttgttttgttttgtgacagaggcagggtctcactctgtcacccaggctggctggagtgcaatggtgcaatcctggctcactgcagcctcgacctcccaggctcaagcaatcctcccatctcagcctcctgagtagctgggactgcagacacgcaccaccaaacctggctaaatttgtttatttttttatagagacaggtttcactatgttgcccaggctggtcttgaactccttggctcaagcaatccaagctggtgagaacgtggagccagtgaagctcacacaagtcaccaacgagaatgcaagatgcaatagccactttggaaaataggtgggcagtttcttataaagttaaacagatacttaatgaatgacccagcaatcctaatcctggatatttacccaaaaagtaaaaactagtgatcagggcaggcacagtggctcacgcctgtaatcccagcactttgggaagctgaggtgggcggatctcttgaggtcaggagttcaagaccagcctggccaatgtggcaaaaccccgactctactaaaaatacaaaaattagccgggtgtggtggtgtacacctgtagtcacagctactcgggaggctgagagaggaaaattgcttgaacctaggaggcggaggttgcagtgagccaagatcatgccatagcaccccagcctgggcaacagagcaagactctgtctcaaaaacataaacaaaacaaaaacaaacacaaacaaacaaagcctagagatcacagaaaaacctggagacaaatgtttctggctgctcattcataatcgttccaaactggagacaacccaaatatccatcagctgggacgtggataagcaaactgtggggaaccctaacagcagatattattgttcagcaacaaaaaggaaccatctactgacacttacagcgacatggatgaatctcagacgtgttacgctgagtgaaagatgccagacaccaaaagccacacgctgagatcccatggagaggacattctggaaaaggcaaaactgtagagacagggaacaaattggtggttgcaggggctgagagtgggagctgggaactggctgccaaggagtgtgggggtggtttgggggtgatatagatgtggtctatgtttggctatggtggtggttacacaactgtgaccacttcgtcaaactcatagaactttgtcaaaactcgtagaactgtacactaaaacaatgagttttaccgtatgttgattatataactctatcttttttttttaatagggtctcattctattgcttgtcacccagctcaagcaatcctcccaccccagacttcctggtagctaggacctacaggcgtgtgccactatgcccagctagttttaatttttttgtagagatgaggtcttgctatgttgtccagactggtctcaaactcctggcctcaaatgatcctctcacctcagcctcctaaattgctggaattacaggcatgagccacctcgccagcctatatctcaataagcctgacttttaaaaggtttcaggctggatgcagtggctcacaagaccagcctgcacaacatggggagaccccatatccagaaaatgtttttaaactattagccgggcgtggtggtatgcacctgtagacccagctactggagaggctaaggcaagaggatcacatgagcccagggttttcaggccacagtgagccatgatcatgcaactacactccagcctggatgacagagcaagaccccatctctaaaaaataaagggaaaataaaattgtaaaaggtttcaatcaacaaacttgtggaatactgaataccacaccgctatttattgacaccctgatcatgtgggtttagtcaaggccctgaaaagtcctgcagttcatttaaccaagagtattatccttcaagcttttttccaagtgacaacaaaaaggaaccatcttgatgtactggcaagcatcaagcaagatgatctggaatgtctccctccgcacaaatagtctgtgactgtaaagtggtttgggccaatggcctccctgaaggaggctctgggaagtgggaatcagaccttgtgtttaggtttctttgcggagagccgcctcctctcctcgttcacgtgctgactcaggtcttctccagcccaggaaacatggagggagggagcagaccacatgtatgtccacacccttagaaaacagtggctcccacaaagggagagaggctgagccccagtcctgtggatggttgctgcccagccctgggaggctggtggcagacacgccctgggaggctggtggcagccaagggaccagaccctctcagcccgtggccccgccatcaaggctgtcactggtgtgtcacttcctcatgggctaagcactgctcatccatttctagtttggccttcacaagtgccccttgaggcagtgtggcgtcatgtccatgtgtcatgacatgtggcaaagccgctcaccaccgaccaacaggcctcccaggagtcaggagtccagtaccagatggggcagaaccatccttcccaaggtctgggccatctgtccttcgagtccgagcagcgcagggcccaaaccctcgagtcacttcccatttccacacccttccaggtgtttagggagacagctacaactcagcccccggggaagcactcaccaggaactccagcaggaaaggagggcggccagccagcgtgtgggtgccttctcctccagctccactagcagcaaatcatgctggccttgtccctccctctgcctcacccccagcctcctgctgcccggtccagatgctaaaaatagccccaacctgcattcagaatccagcacatcataccttccacagcaggcatctgcaccgttgacagtggaggccactgtgactccaccacctccccaacacagccttccaccagccatggcagagggagcttgcaaaaccagagggtgggtgcaagaactcacgccctctccaaacgctttccagaggtaggccaggcggccaatggttgcacctgaggcccaggagaggaactgacctcactggctttgtaaacgccatgatattcaagttctcacgtttcctatttctgagcaagccaaatcaatgtcaacatacatgaaatacatctatgaatgtggtctacaaagagattctttattttgcaagacaagtccatagcaagcaaatcttttgagtcctgaaaatatattgtttttcaaaattccgagtgacgtgcaactatttcataaactggagcacatgatcgggtgtactattaccccttcctctaggtggtatttcaaagggtacgtatttcccccacccttcatgaattaactccttgttttactttcctagggcggcagtcacaagataccacagactgggtggctgaaaacacagaaatgcgttctttggcagttctggaagctatcatggaatcctgaaatcaaggtgtgtcccggatgtctccagggagaaccgttccaggcctctccctgctcctggtgtcagctggcactgccaggcttcctggcctctccctgctcctggtgtcagctggcactgccaggcgtccctcggcttgtaagggcgtcactcccgttgcaggccgtcttctccttgcccctttacttcaccttccctcagtgtgtgtctatgtctgtatccaaatttctcctttttgaaaggacaccagtcatgctgcactagggtccctgctaatgacctcattttaatcagttactctgtaaaggtcttatctccaagcacggtcacattctaggggactgggaatcaggaccccaacatacctgttttggggggacacaattcaaccctaacactcccattttctaatagaagaggagaggggagggaaggagggaagggggaaggggccggagacctcggcaggagggagggagaagccagcctgccgccctgcgcgcaccggctgtgtttctgtgcgttgtgcttttgttctgcatgctgggcgggcggaacagggtgctggcatccaggctcacccagaggggagggggacctgcagggggaggggagcactcaggggatcaggggaggagagtgtgggccaggtgacctgccaggcgagagaaaatcggggaatccgcacagcattttcagacagcctgacagcagccgctcgctcccctctgagccccagcccccagcaagcgggcctctggccccaggtctgggagcggcgtggaagtagaccttggctctccctccccggcagcaccccacctccctttgtctctccagccagaggtgggcctgtggggatgctaatctcagagccacctctccatctaaggttgctagaaattcggcaaacaaaagatagatttagagaacaaaaaaatttaaaaaaaataatatggccggttaaatgtgagtttcaatttccaataaataaatgttgcctgggatatgcttatatcaaaaacttacgtgtcacttacctagcatttgcatttcactgggcctcctaaattctgtgtggtaaccgactgccaccggacatgctgtttacttctctatcctcacgcagccagttgccacattcaacataacactgcaaatattgccggtggatcctgacttcctcgtggaccctactgtgtcgggaaaaacaaacaaacgaaccctggaaggaaacaccatgagttgttagtagtgcctgtctctgaatgatgggcttacaggtggttttcaattttttgtctttaatttttttttttttttttagactgagtctcactctgttgcccaggctggaatgcagtggcatgatcttagctcactgcaacctctgccacccgggttcaagcgattcccctgcctcagcctcccaagcaactgggattacagacattcgccatcatgcccagctaatttttgtgtttttggtagagatggtgttttgccatgttggccaggctggtcttgaactcctgacctcaggagatctgcctgctttgggcacccaaagtgctaggattataggcgtgagccacagcacctggcttgtctttaattttttgtttatacttttctataccttctaattgttttcaaccaacacgtatatcccagaaaatgttttaatgattaaaataaaacaattgccctctcctccttggagccccatccacaagagcagcttctgcagatgtgggaaggagaagactttgtacctgggtcccaggccacgtgaataattaaccctgtctagggagccttggaggtctgatgaggccagggcttgaaggagagccgcggagcacgccaggatccaggcttgtgggtagcagcatccctggaaatggtccccagtgggggaggaaccagtagccatcacctccaacccccagccaccgccccgcgccatgtgagtgaggtggcatctggttttccacacacacctccccatgtcgctggacgcaggcaaggccacccaacccccaagccagagtcacccggacagacggatactaggcaccttagcacttccatggccagaggcctcctgaggtgggaaccgggtcctagcccatcccaggccatcccctccaggaccttcctggaggagcggggagaccagacttagaggaaggctccatgtcccaggtccagacaggggtgagggggaagaggggtgagcacctgtgttaggcactttgaactctccaggtcaggtgactgcatccagctgagactcctggcctccctccagcgtggaatgagcagccggtcctgtcccgtccacccctccagtgctgcggaacagaacgggaatggcaagtccccatgtgctgtctccccgcccttctacagcaccggtggcacaaatgctggggacagtgccggccccactcacaggagagctgctgggctggctccaaggctcctccgtccatggctgctgggctggctcggaggctgcctccgtccatggtctctgcagtggacagtctgtgtcacgcctccatctgtggtctttgcagtggacagtctgtgtgacgcctcctccgtccatggtttttgcagtggacagtctgtgtcatgcctccatccatgtcttccagcaacaccacctcactctgctttacacaatcactccacctccgtgtaatgcccaaccttgtttttcctttattcacctagccttgcttctcccttagctgagagagtcacacaaactccatcttggctctttcaccggcagccccttcctcaaggacttaacttgtgcaagctgactcccagcacatccaagaatgcagttaactgataagatactgtggcgagctagatccgcagttcccaggaatttgtccgaatgataacgcccgaagccccgcgtctatcaccttgtaatagtcttaaagcccctgcacctggaactgtttactttcctgtaaccatttgtccttttaactttttgactacttaacttctgtaaaattgttctaactagacccccctccccttcctaaaccaagatgtaaaagttaatcaagccccttcctcggggccaagagaattttgagcgttagctgtctcttggttgccagctaatagaggactcctaattcatctcaaagtgtggcgtttttctaactcgctcaggtacaacatccccacatgccctgcccccgctttgtatgcacacagcacacacctgtgcacatacaaacatctgctttcacacatggacacactcactgaggtgaagaggcacactcaggcacacacacactcacatttggtacatgcagctcctgaggggcaaggctgagctccttctcaggaacggacacaagactgagggctgggtcactcagatactttgcccctcgggccccacggattgatttaggggtgaactgtgaatccctgggagattccttcctgccacgcattcctgctgatgggaaacaaagcggtctttgagggatgctggaggaggcagcagtttgtgataaagagctgtgagaggagaagcccctttgccacctgccctcctttgtgcattggatgttgtcctcaatggacgtgatgcctggagtccctgcagccatcttgcctccatggggcaagccaggaaaacctcaccgacttaatggcttccctccagcctttccaaagccttgctctggtctcagagagttaggaattctgtcacttaaggcccagagcatcctgctgctcccttcactccagaaccagagccacacggctaacaggcaaagggtcaggaacatagcccgtgttttctgctctcggcacttggtcattctgcatagaatttggctccaaggcctggcctgacaccttcgcaccaaggtgccgtaaatgaaacctttactcctgagacttcctcacctctgcgttcccagggatccacaatcttctatttgtaaaatgattcccggttgtcatggagaccagggcaccgcagtggagctggaatgttaggtggggtccaaggttcagtcctgggggtagggagtggggcaggcagcttcactgggccctttatctgcctgattctcatctttcttacacaatagtctactcattattccttccctaagggccaggacacaggcctgcctggggttacagtccctgtctttacaagtcctctccttctggctcttgggcgtgcctgagctcaaaggagcctccaagcaaacttggcagggggtgtcccccagggcagaggtggggccctggctcagcacccccagaaaccacaaggtgggggcggaggatcctgcacctgaccttcaccttcgtgtggatcagatcagagcagaagttctatttctggaactgtcagacctgctgacctccagtcaatggcagaggcaggaaggcaggcagaaatacaagatgcagctcttgttacacctcctgcacagaccaacctagtctcggctccacacagccactcactctttcactcaacacgtgtttccgagcatcttctatgtgccttttctctatcatcagatgggggcccctgcggtgggcagaataacggccactgcaaagatgccaaatcttatccccagagcttccgcagagatcctgcagatgtgattcgagtcttccagcaacaccacctcactctgctttgcacaatcactccacctccccacatgttgcggagattctcctgggtcagtcggggggtccagtgtcatcctagggtccttatgagagggaggaagggaggcggaggaggagatgcaaggatgaagcgaaggttggagtgatgtggtctgctgcggggaccctgaggcgtgcaggcggcctctggaagctgaaaagacaggaaggcagcttctcccctgagcctccagaagaacccggccctgctgacactggcccaggagccccttcccccatcagggcctggagagggaagaaatgactgttcacagattttaccccgcaagacccatttcagcattctgattttgagaaccataagacagtgtgtgttgtttaagcctccaagtctgtggatattcattacagcagccttgggaaactgacaccacctccccctaatcctccctcccgcccccacctacacctgaaccctccccttgctcttctctgccgattcacagggattcacactcttcctacttgcagctgtgacacgggaaacatcctccaccaggtcttctctcacagtgtggcctctgcgcacaggttatccacctgtagacctggacgggaccctcgaggctccctactctgaccatctggttttatagttgaggaaccagaagccgaggcaggtaacttggtgcagcctaaaggcctccatccctccagtgcccacaacttaggtgcccacgacaacaacactggcctaccgcaaagacccagcccagaggaacaaggtgccactgtatgtctgaaaagggggccctcggcctcactggggagcaccttcctccatcagggtctcgacggtgaagaagcaggctgtttccatcttcaggatacaagccatctgcgcataggaagagggtccagaggctcatctggaatccctcctcactcactggacggaggacctgaccccgttcccatcattggttctgaatccatcagcccagcaagacaggtgtctccagcaagttctgtaaaatacaaccatagccgggcctggagtcagcccccaataaagggttcaccatggagtcaaagcttccttcacattgggaagagcctgatgatgccgccttggtgccacccgtgcaggccgtgttccacttctgtcatgggctggagagaaaagagcgacatggacctgttcatgaaaggctcttcccgcaacaccaagcctggggcctgcagggccgccatgaagaaaggtggctcctgcttggcagagagaaaaggggagggagggcaggtgagtcaccagcattgggcccctcagcccaggctgccaaggcagcccagtggaacctgtccccatacagcatgtttttagtttgaatggttttacagtgttggagctgtaactttacaaatttgctttgccttcataactctgtaagagctataagcaaacgtagctttaatcagcatttacagcgtgcaggagcatctttcctttaattctgcaggaggatttgtgccctgtggatgccataacaaagtatcacaaacccacaagtcaggaaggaaggtgtgggcagggtgggttcctcctggaggctctggggacacgtctgttctgtgcccgcctccagcttctgacggtcgtgccaatgcttggcctcccgtgactatggaagcctctctgtagtctccacttccatcctcccagcgctctcctcccctgtgtctgtccctcctgccttctgtctggctaatctcatgaggacaccattcattgggtttagggctcactctgaatccaagatgagctcatctcgagattcttcttctttttttttcttttttttgagaaggagtctggctctgtcacccaggctggagtatagtaacacaatctcagctcactgcaacctccgcctcccgggttcaagagattctcctgcctcagcctcccgagaagctgggattacaggtgtccaccacaacgtcccgctaatttttgtatttttagtagagacaaggtttctccatcttagccagtctggtcttgaactcctgacctcaagtgatctgcccgcctcagcctcctaaagcactaggattacaggtaagagccatcacgcctggctgggattcttaattatctctgcaaagaccctatttccacataggtcaccttcacaggtaccagagggtagggcttggacacatcttttgagggaccactactcaatctactacactaaatttgagtaattatgatcaagaccaacccctcattttgcagaagagaacaaggcctgagaagggagccagctggccccagcctcacagcactgccaccacacgcaggccagcgctcagccacagtggctcccccaaacttggaccatgaggcacctgctggcacccctcacctggcctgttccaaagcactatctgaggctggctgtttgctttgcttttgtaactctagaagagctacaagcaaacatagctttaatcagcatttacagtgtgcaggagcatctttcctttaactctgcagaaggattcgtgccctgtggatgccgtaacaaactatcacaaacccacaagtcaggaatcaaggtgtgggcagggtgggttcctcctggaggctctgaaggcatgtctcttctgtgcccctctccagcttctggtggtcacttccaatccatcaggaagccatgggacagagcggcaagaacctcagcgtcagagcccagggtctctaccctggctctgcccccttgggtgtcattcagcctctttgccgcagggtctccaaagtctctgcctgcaaaatgtgcacagaatatctcctgtgtgtggccataaccacagttcacagagataatgtcctttgccctgcatgagattaaccctcagaaaatagcagttaacattccatccagaaggcaagtgtggtggctcacgcctgtaatcccagcactttgggaggccgaggtgggcggatcacttgaagtcaggagtttgagaccagcctggccaacatggtgaaaccccatctctattaaaaataaaaataaaaataaaaataaattagccaggcacagtggcatgtgcctgtaatcccagctactcaggaggctgaggcaagagaattgcttgaacctgggaggcagaggttgcagcgagccgagatcacaccactgcactccagcctgggcaacagagccaaactctgtctcaaaaaaacaaacaaaacatacaaacaaaaaaaaacccatttcatccaggcccgtaagtcctcagggcgaccctccctgtgaggacaaggtcaagaacatcagatcctggaggttgcaggctgcccacttgcagacctggaagcagaggaggagcacaggctcccagggacactcagagggggtcctggagggagtctttctgcaggatgggggtgagggggctcctcaaagcctccctactttgacggatggcatctgtcgagggagctgctacatccacagccaaacagcagggaacaggacagtgtgggggctacgtttcagcagcaatgattttttttattttttggtaacagctttattgagatataattcatccaccatagtaaccacgtaaagtgtccaattcaatggcttttacaatattcagtagtgcaactatcaacatggtcaattttactacacttttatcacctcaaaagaaagcccatatacttcagctagcaccccacagttcctccatgtcccaccagcctctggcaaccatcagtcttctttcagtctctatggatctgcctatctgggtcattttctatacacggaatcatatcatcggtgatctttgtgtctggcttctgtcactgagcacagtgttttcaaggttcatctacattgtagtgtgtgtcagtgctttgttcctggctgagtaatactccactgtatggatgggccacatttatgtatccctccctcagttggtggacacttaggttatttccaccttttggctattagaaataggaatgctatgaacattcacatgcaagtctttgtgtggacatatgctttcatttctcttgggtataaacccaggaatggaatggctgggtcatgtggcaattctatgcttaacttagttgggagacaggcactgcaatcattttacattttcatggatagcatccaagggctccaatttctccacatcttctccagctcttgctattgtctgactttttgattatagacagcacagtgggtgtgagatggcatctcattgtggttttgatttgcatttccctaacaactaacaacggtgagcatcttttaatgagcttgttggccgagaaagctgcaatgattttgaacacagtcaggtaaacttggaggcaacagggtgttggggtaacggctgaaaccctggaggcaggaggcctggctttccgtgtttgttccagcacttagctggtgggtgatctgagtcaataatgactttctgagcttcctggtgaggaaagccagaaaaataacactaaacccccggagtgtcgaggtgaacttttcctcttactcataatgtaggtctagtacctggtaccaaaaagttgcttcctaagtagctattgctgtttattgtgaagcaaatgaggtttagaagcgctggcagtgacgaggcttatgtcccagttttcagcaactgctcaggttgcttcagaaagatcccaaatcacagacacctgtactcactttctgttgctgcataacaagttaccccaaatattgccgcctgcaacgcccattgattggctcacagttctgcagcccagcagggctggattctccactcagggttctttgagggtagaatttggatgtcggcccagctgcattcttgttgagaggctctgcagagagtccatgacacagtttgggcctgtgtcctcacccaaatctcatctcaaattgtaatccccataatatccatgtgtggagggagggacctggtgagaggtgactggatcgtgggggcggttcccccatgctattcttgagatagtgagttctcacaagatctgagggttgtataaatgtttgacagtttctccttcacacactcctctctctcctgccgccttttgctttcccttcaccttcctccatgattgtaagtttcctaaggcctccccagctatgtggaactgggagtcaattaaacctctttttttttttttgagacagagtctcgctctgttgcccaagctggagtgcaatggtgcaatctcagctcactgcaacttccgcctcctggtttcaagcaattctcctgtctcagcctccctagtagctgggactacaggcgggcaccaccatgcccagctaatttttgtatttttagtagagatggggtttcaccatgttggccaggctggtctcaaactcatgacctcaggatccacccgcctcagcctaccaaagtgctgggattacaggcacgagccaccacacccagcccctgtcctgtcttattgaagtcccttgccagagctactggccctcaccctgccccagtgctggcccttgtccctcacccttcttccctcctccttttcctcctcaacattcccaattctctaccaccatttgttacatcgatctgcccggaacctgctgtgaagaaaaagacctttctcttgttgagaggtgccctctgttggaaatctcttgggcgctagggaagaggtgtccggggacacaccctccctggttgcctatgcagatacacagggaagtacaacctcaaggtaaagtgccttctcctatggggtttaaggcaaggacatcacacctggacggtgaggccaggaggcttcctggagaaaggcagcagccaggcagaggagggcagggcttcaggccaggcaggatgccccaggaggaggggttcagtgtgcaagtcgggccatggaagacgtgggggctgggatgggggtcaaggagggggatgagagatagggctggagacagggttgctgcaggtagaggagctgagagaggccggacggagggaggcctggagacctcgagcctcttagagccctccccagggagaatgaaagcaggggtcagggctcagattcaagggagacttggagcagaacccagtgcttggctggatatggggagggcgtgaagagaaggaaggctgccccagactcagggggacaccagggactcccaaagggacacggagagcagagcccgtggcgtgggttgaaggacagatggtgtgtcctacacatgctgcctgttgctttgacacccccccacttccccccgcacacacacactcccacttccggcatccaaggggcaggcctggcctggaggaaggatggatggacgcgcggctctggaatggcacagtgtggggagttggggggaaaagaagaggcactgaagtagcaggcacacaatcagcagctcgctgagattttaggaaagagaaaaacaaccccaccccaccccagctgctctaatagggtgaattcacattaagaccccaaagtccataagataggatctgccctcagcttaactgcaggcatggaggctctgagcctgggctctgggtctgaccgcccaggtaggaacctggcctccgccttgaagcctctgctctgaggaaggtgcgcggcctccccgaccctcagcctcctcatcggagtgcaggggtgagaattcccacatctgggccttgcttcgtaggagagggtgaagaggcaggttcgaagtctgaggaccaggctcagctgaaagccttgctcaagaggctcggtaggatgagcgtgagaaggctcgcggctccacaccccaagcatactcgctgccctgtgtggacttctcagtgctgcaggcaggttggggtctgtattcgtccgttttcacactgctgataaagacgtacccaagactgggtcatttataaagaaaatgaggtttggctggacgcagcggctcatgcctgtaaaactttcggaggtcaaggcgggaagatcgtgtgaggtcaggagtttgagactagcctggccaacatagggaaaccctgtctctactaaaaataataataataaaaaattagctaagcatggtggtggatgcctgtaatcccagctactctggaggttgaggcaggaaaatcgcttgagcccaggaggtggaggttgcagtgagttgagattgtgccactgcactctagccttggcaacagatcaagagtccatctcaaaaaaaaaaaaaaaaagaaagaaaaagaaaagaaaaagaagtttaatggactcacagttctccatggctgggaaggcctcacaatcgtggcagaacgcgaaaggcacttcttacatggtggcagcaagagagagaatgagagccaagcgaaaggggtttccccttatcaaaccatcagatctcgtgagacttattcactaccacgagaacagtatgggggaaaccgcccccgtgattcaattatctcccaccaggtccctcccacaacacatgggaattatgggagctacaattcaatatgagatttgggtgggaacacagccagaccctatcaggagccttaggggaaagagacggctgatgcctgccctgttaggtaccttctcccccagtgtttcctccaccttcatgaggatccccatccttctcttgccttgtgggacagtcctggctgactaatcacattaataggaaaatgctgagttctctcagggcagtaaacagacatctttgaccaatggctaacaggacttgagctggtcctgccagccagatgtgtgccacactgtctacccgaaaactcgcccaatcctcccagcactcttctgcagccagcactgtcctcgctccatcctgtggaaaagactgaggctgggagaggcttggcactgccaggttcccgagcctggccactgtggagtggttttgaccaggtccaaatccgtgcccttgtccctgacccaactccgtgcccttgtccctggcccctcgctcctggcccagcactcacagtggagcctgcagcccctgcatgcaggtctgggtctcctgggattctgtgaccctcatagcactcccctaagtccctggccagtggtgcaccaacacgcaacaggagacttgccactgtgaggagcatccctcctcgttccctcccgctgtgtgcagctttgcaggtgacagagcacgctgtctctgtcaggcagggaaggaaactctctgctagtggggtacagttcaacctggggaatatacttattgagggaaaatccaaattccagagaatttaaaaataaattttattattttctaataaccaagcattactagggaaatgcgatataagtagagatgccagataaaatacaaggcccccagctaaatgtgaatttcagctaattatatttaaaaaaaatttaaaggctgagcgtgatggctcatgtctataatcccagcactttgggaggccaaggtgggaggatcacttgagtccaggagtttgagaccatcttgggcaacatagtgagaccctgtctctagaaaaaaaaaaaaatatatatatatataatatatataaatatatatatataaaatatatatatatcagtatgtcccatgcaatatttgaaatatacctatgctaaaatataatgaatatatgtagtgaaaatttaaataaaatgttagtaaaattgaacagttaaacattgaattaaatatctaatgaactactttttagtataagtacgtctcatgccataagtaggacacacactaacaatgatttgttgattatgtgaaattcacaggtaactgagtgtcctggagtcattttcgtcctgtacttttatttggtgaatctggcaggcagctttccccgcctgatgaaacttgggagttgctgccgccctctgccacaaggttggccgtgtcttcccctgccgctcgcagctacacacggtgcacgaggcaaagcagcggccagacgccctctgagcgtgatggcgggcaggtgcccccaccagagagccccaagcctgagcactattcctgtcccttctaactctgctgggagccccatcttgcctccggcgtcagccccacccccctcagctcagcctcagcacccctgcagcgggggaatcacagccgactccttgaggtccctcccggcaacggtgcccactgcccactctgcaggggacagagtggaagccccaagagggacgagaggctacaagctctggggtggggggtgaggtcagcctgcgctggtctgacccagtccgactcctcagggcggccggagcctgtggtcgggaggcgtgcggggctgtgcccagagcagcgggtcggtctctttggagcacttcccttctgcgcgcgtccagcaccccggaattgattcacagccagtctgggtctgttttctaaccaagcgccttgctcatgaggcacgctggtgtcctttagaagggacccaaagcttaaagttgcctttgtcagttccctaagaacccacataaaactggccacgtccagggcctctcctgcctccccggcacgaagcggtgcggagcagcaaggccagcctggcctccgcagggaaagctctgcctccagcctggtcgaggccctcccctcagcagaggcaaccctaacagactccctttcccaggagctgacgggcgagtgccttagagccctgttctcagagccaggcaggccgctgcggaggctgtagggaccaaacaaagtcaggtctgtgaaatgctcggcgcgggggcgcggggcccgcagggagtccgggttctctacgtgtcctccctctggctttcctcatcccttcccttccttcctcctccctctctccttctttctcctcctcctcctcttgttcttcttcttcctccttcctgctcctccttcctcctcctcttcctcctcctcctcctctttcttcttccccttcttcttcttcctccctctcctcctcccccccccttcttcttctttctccttcctcgacaccacaacacaaagcagaatgaaattcgtgccatagagaagtcccggcaaaatgctgccagacctgaagaaatggggactgcttccgcctggatggcagggctggggacaattattggaggagagagcaggtggcctgcagggctggtgaagggtaagagggacttgtaagagcagaggtggaccatggcagccagggtgcaccctcccctgccggggcgtcgtggaacctgaaggtcagctggaggatgtgacacttcaggacggtgttgtgggtcccaagaaatgctctggagcagaggccgatggcaggatgaggccggcagcaaggacaaagtgcaggagtagaagaggttagaaggtggcgaggctgggctaagtgggccaggggaggagccatgggagattccagggttcccagcaagggggcagggcaggcgggggcctggcacctccaggagaggcaggagaggaccggcaggtctggggaaatgggcgctggcgtggattgacggagagtcctgtgtgctgagcactgcggaggcatgactcacccctgatccccgaggggcagaccgggactcaggcccagatctcattgacactgaggcttgcacctctggccaccagcctgctgtccctgcactgggagaagtggagccccaggcccctcacttggtacccacgggctattcaggcctggctcccactgctgctgtctcccctggcggggatgcatacaaggctggactctcggcctttcctggggcctgagctagtccatgtcctaggaagagatgaccgtggcctccgttttaacaaacacagactagaccagttgtcccctggctgtcatgtcctaaccctcccagtgggtggtgggacagcacaacccctggccctgagctgtaaggggaggggaggcccgcagggaggtcgcccattggggaggccgccaccaccccagggaggcctgttcaagtaggtcgcagtgatgatttccggtggcaggtcgcaacaggctgcgctggctgtgagaaatgaaggaaaaatgtgcccagataagtagaagcggttcctggtggcttggcaacctcagaggctgcctggctgtctggttaaccccttccctcccgaagtgtggcccagaacacacgtgggacttccaggtcaccctgcacccctgggaagccaggcacacttggtccccctgagttcactccatgcagagtggaaacgatgttgcctgtcccccagtagtggaggccagtaggagctgggatggcgtgcacagccctcagcccagcgcagacaggaagagcacgggcaggctccgtgggggctcacagctccccaggcacagtgagggtggaggggaccttcaggaggggtcagactatggccaaaacatcacccggcagaccccacagagtccactgtggcccctccttcctgagccggccctgctgctccaccccggcggctggagctgctcattaccgccgcctccacagtgccctccaggaaaacccacagggcctcgccccacagagtgcttctgtgcccgggacctccccggcccctttaggagtctttctgatctgccgtcttagaagcgctcccaggaaggtgtggtcttcagggcgccccccctgagccaccccttcccacaaacacgtttcctgggagctgaggtttgggccacgcagggaattctgaccagggagacttggctaagtgttcccacccggcgcctgtctcccagccagacccggccagacgctctcatcagcacctccttcccgtactggggccccagggagaaagctctaagctactgcccagctggctccaaaaggggtccagaaatcactttgagggtgaccctggggctgctccctgcatacccacatacccccccccatttccgacgagcagcacctgccctgggcactccccagcttgccctccttctcctcggcagatggggcttcctgctgattcttcctgcaggacagtcaggtgtgtgagggcgggccctccagcctgggcacctcctcatgcggctcccttggtgagccgccatcacacagaaggcgggtagagggaagaaggcagtggacttggtggtcctgacccttgtaaacctgaggacaggaagtgagcagcgctgtgctgagctggtgcctctgggaaatgctgggctccctggggccttgactgtcctgttggtggccaactcccttggcgtgtggtcctgtgcagtacacgtctatcaaacgactgcagacatgaatgaatgaatgaatgaatgaacgctttagcctgacttcataccacataggtaagtttcaggatgttagcacagctaaaaagcaatagggcaaattacaaaacaaaaaaagaaagccaaaaaaatacaaaactgtcatgagcacgcctggcctcgtagcaacccaccaatgggactggaagagtcacgtgaacacacacccatttgctggctttagctcatgtcctggctgtacaggacttgcctctgtttcgcagccatattgctgtttaatttattcagggagaattcacatagcataaaactgagcactctaaagtgagcaatccctggcacttagtgcactcacagtgtcatacaaccagcctcaccctctagctccaaaacaccccttctcacccgagtaaaaccctggccccatgaaacagtgtctccccagcccttacagccaccagtctgtctctgtggattcacttgttctgatataaaatgggtggtaccatatgtggcctctccacctgccatctttcactcagcaccgtgtttgaagggtgtatccacatggtagcccgtatcagaacttcattcctttttatggctgaataatatcccattgtagggggagaccacattttgtgagtccattgatctgtggatgggcatgggggctatttcctctttcggtcctgtggatagtgctgctatgcaaatacacaggtgtacatgtagtcattggagtcccaattctttgtaccatcaacagtttttcatcgtttataaaacattagatctgtagaatgtctacctcaacctccctccgtttccaggcatgacttgaccaagggcacagagggtcaggaatggcaggggcaggccttggaccaggtcttctgaccacatcctccactgccacgaggatgaaggtccccgtggaaggaaacggagggtgtgacccactcgccttagcaggttaggcaacacccaccgggccaggccgcaggcagtgctgttgaaggcggggccccatcgcctcccaccacccactaaggtcacaggaggcagccaggcttgcccacacatgggggcagctagaggaaacctggttagggcttcagagaggggtcaaggttgaagccatctgaggggtcagaggcaggaggcaaaggggcctctgcttccttcagcggcgaatccagagtctgggtgcatggaggcgagcaagaggaacaggctcgttagagaagccccacccagttactcagcacctggtaaacatcgattattcccactccgggctaaaggaaagagaaggaaaattccctggtaatgccacctccccaagcagccaccatgagcctttgagggtttgtgtgcatggaaagagaaatctggtgtggatgattgtacgtcagtggatcagctctaaatcaatggagcgggttttatggtatccccttggtttcacatcaactaggaggtcacttgtgcacctgggacatcaccttttctcctccatgaaagctgtgaaattctcaacacctagtccagcagctggcatgtagggggtatagaaaaaatgcttgttgtaggaactaatgctgaaacccaaagcggccctcgtagaaagtaaaagcagatgcccttgatgcctgtcattctaggatccctcggagagaaggcacgcccaccacttccccacacctcccccagcccctggctcactcatgttctgagcccttttggactctcctgccggcaaaaacaagtttaggcagcattttcgcctctgtcctgttaatatctcagtggatatcttaactacagaatagacataacctcattataacaaattaactcaactcagcaactagaagggacagttcccgtttaaaggtaactaatgctgaatataccacaaagagatagaagatggatacatgaacaggaagttgagatttgacggacaaaattaaaaggagttctagattgaaaatcactttccttagaatgttgacagcattgttctcttgccttcaagcttccgtttttattgtctgtgtctcaccaaatcagtaaatgcacacagtgcaaaaagtgaaaaactccgggcaagaaaacacaacgcatgaagccctgctctcccacctgctcatcccctaaatccaggtctcacaccgcaggcagtcacactccagtcttgcagcactttcttccagtattctccccatcacatgcttacactgatgtttgtttgaatttttgtttaagattttatgtatttattcccaactagggaagatgaagatttagggctttcataacagccccagccacacccacagccaccctatagagttatgtcatcatttacaatgaaatcaaaatccactgtttgtacatcattatgattcaatgtgattccacccaacccaggcctgctcatttggctggatgttgagttctagcttggaggaggcattctttgctgccagttgcatggactaaacatgaaaacattcctaccgtacagctagaagtgttggataaaatgtgagactccttttaaataactagctaaacatacaagaagaaaggagacaaaatctccaggggccaaaagaagagggaaataaagcctgaatagtgaacatcggctgggcttagattgacttggggattgcattaatattggcacccagggacctggagttgaacactccagagacagaagataagctcaggggcccaagtgaggcaggatattataagcaaaatccttgaagggccaccctgagaggaaatatttacccaccagcagaggaagatgacctgaaagcatatctatctcagtccatgccaggagaaaaaaaaaaagagaagagaagagaaagagaggagaggagaagggaatgcctcttaagagcttgtaatgatgggtctgtcttgttcaggttttggatttgaatttatactccctgcatagtccaggacccacagagccacagaattagcacaaaaatgatcacaggctggcaagacaactgagagtcttgcaaacacaaaatctctcagtaaagacagcttcagctcaagcacaaaagattctcacagatagagtcctactgaaaatgaactcacaatccaaaattataaatcacacaaggaaacaatccaccagcagacccaacaatcagaggaattggatccctaagaaccctaggtaataggattatcagatgatggcttttaacaggtatgtttacaatgattacagatataaaacaaggaaatgagcacaagatgctaccaagaaaacaaggcagattcagaaagaatggagtagaacattgggaaatggaaagtatagtgagtgaaataaaaatctcagtggatatcttaactatagaatagatataacctcattataacaaagttagctcaactcagcaactagaatgagcagttcccatttaaaggtaacttatgcagaatatagcacaacagatagaaaaatggaaatatgaacaggaagttgagatttgaaggacaaaattgaaagttctaaattgaaaatcactttccttaaaatgttgacagcattgttctcttgccttcaagcttccctttctgttgtctagaagtctgacgcatctgatatctgatttagcatcttcttgcactccacctgaaagcatttaggatcacctctccagctccatcctagagtcacctccccatccctgtcctggcatcaccaccccatccccaacctggcatccttccatgctgggcttgcaatggctattctcctagccatcactctaagcacttgctgagccctctttatgtgagattcctgtactttagtttggaaacattttcttctttttctttttttgaaactcctattattgggatgatgggcctcctggaataattctctaattttctttcctttcctctcctatgttccacttctttgtctatttgttcttctttctctgataaattctttgctttgctttcttagacttattttccacttttgagagttttatttttctcatcacattaaaaaaatttcatttctgttctctaaatatttacacacacacacacacacacacacacactcctgagccggtgttcattaaaatgtatgttctgagacattatagattttgaaaaagtcttcttctgatccatactttgttttctctgcttttttaatctgcttgttggattggttaggatggtcgtgtctttgtctttcacgttagggctttctttgttctagtgggatctctgttcgtttttcagatgtcagttagcaacagatatttggaagctctgtgtgtgtgggagagcttatcactgggtgactgtcactgcagcatgatggagggaacttctaaatgtcaggtctgcagatcttttcctgcttggaggtgctgagagaagggagagagcctggaggggtggaggtggggtgcaggtcacgtcttaagtacatagagtctacccgatttcctcctgctgagttgcttcccccagccccactctggatatgcctggagttgtggggttcaggcacatctggttcaaacttgtcctgtctgctgatggagtggagagtgggaggccatctgggtgtctacctgctcctggtgagggcgctcaggtagtcctcttctgtcccactcttctctctgtccttcagagtctggtgcctccacccctaaagattgacattattgttggtagattgaatggacgtaacattattctgtctaatgagtatacattttctaaatgcttgtttagctcattgtggtctaggaacaaatggttttcagagccacacggcccacagacagactcaccacctcccgatgtggtctccaccaggccagtggctggcctataagtgacaacatccagccacagcctcattagggcaccaggtgggcttgtcaggtcgcacaccttggctgatcggcaaatgaagggaaacgccagcacatctccgtccaccattatcgtgagagggcactttccagctcttctttggggacacatccctccgcaccttccctcccttcctcctcctccatgcaccccttcccgttcaccgtgaagagaccagctgggctggctcctcagcagacccctcctcaggaggtctggtctggcttcactgagcccacaaaggtgatgggtttggctgtgtgccagcacgcggccatgccctcccctggtctccagcatcatcccacttataaagagtcattccttgaaggcaaagatggggtcccacatcacccagtgtccttccccgcaccagccaaggtcaccctcgaagagcaagttcttccccacagccaccaggaaagatggaaaggaaaaggagaggctctgcctgagttccacagcccaggaggaggccaccctgtcctttctcctggagcaagggcagcctccccaccggccccacctgcagagctgccgggtgccacctccctgagtctagtttttccagtagcaccactgggaccaggaagtgatgtaaggaggaaggaagacacctcagggaggccagcttcctctgggttgcctcagaggggctgaggttgctgaaacctccaggctccattccaaggggtgaggtccgcccaaacatgacaacgtaaagggaggtcctccccgaccctcaagtcccactctctggggccagccctgctcacgctttggggagcacctttctgaagagctccacacagctgtacattgatactgtcgagtttacatcgtgttgtgcagagaaatgagaagtcgagaattcatcctgctccaccggcttcctcaccttctcttgcattttctttttaatctagcatccaatgcatttttttttttaatttaagcttccttcctttgtgtgctaacattttacatgtagatcctagcacatttctttaggcaaggaaacagaccctttgttgagcaccgtcatcgtggccactgcagttgcctgggaggctccggaaggttttttgactcctgaagccagctgaggcagccacctgagcaagggggttgttcatcccagggctcaccctcattcagggccatgaccttttctagtaagtgtgcactctcttaggtcccaccctgtgtcacccggactctcttggagttcggtatgtggagatgactttcttcctcactctggatgcaatttgggaactacaccgaggattgtggccaggggctcttccctcacctctgacggatccagtaggtggtcccagattctcactctgacccacccactatgacttcaaagctgctgtgcacagttaccactgctgggcagaccttccagaatcttccagaacatcccatgattcagagggaagacaccctggatgagggagtcctccatttttccgagcaaatgcacgtgttctacacacaactccaggtcattctccagtggtacctgagccctccatagggcccctgtgagggatcctgggtggggacttctgtgactgtgacagctggcctctgggccaccttttccagaaacagcattcctgattctcccttgggaaaccatcacctccacattcagggtggcgtctgccagcctggcccagcccgggctgtgggaacactccctccccgggctgacatgcttggttttgaggatgggcgcaacctgctgtggggccaccacactgcatccactctgagacgccatgaattctaatcctaaatgtaccattgtcctgatcacctccaaaataggaaaaaatgctgccaatgacaattgtaagaggccattgactccctcatagctgttagaatgcagaaaaaatagcatctaaggaactacgaatgatttttaatctggggcttgggaaaggggaactattgggagaaagaagttctctttgcactgagatcctcaggccatttaaccttggagacaagaagacagggatatattttgcaaaggacttgcccattactaaaggtgacacaggggaaaggagacactaaacatctggatccagccatttctgacactggatttcatgaagcagtacttcttcttcttcttcttcttcttcttcttcttcttattattattattattattattattattattaatatttgtctgcagggcctaaagcagtgactagcaccattcctggaacagactggccacctggtgcctccttactctgcagtaaacattggtgccgctgccctcctgaacatcaaagtccgtggacaggtgcagagaaggccagagcccaggcacctgagaacagggccccgttgccttgtgcagtggagttctgaactcctgacctcatgcaacaattagttatgaaagaagggagaagcagggattgggagaagaaagggaagaaagaaggacaaaatgagggagggaggaaaatttgttcagggttgatagtctaagatgtcaacctggcatccaaaatgtcagctttggggcagggattccgtcctccaaatgtcaccttgtgccagtgcctgcccctccctctgcagtgccagtaggaggccttcacacactacacccactcttttgaaatgaacagaccagctaaccttggcactgtggatgatcctggtaaacaaagtcccctgagtactggggtcagtcaggttcaagggcctgggagaagatggcaactcctggttcaatagcctgggagtggagcactctgggtaaaccagttgtttgccaaggaagccctcaggtacacaggtccctctgctgtcaggcgtcctggtgaagcaccaagaggttgactggccactgccctccactcaagagggacttcagaagaaccctgaagtgaggcccaaaatgtcctaagatttgtaggacagtgtactgaaaccacagatccagaagacatgccaatcatgggtcaggtgttccccatctgctctctgagagtgtggcttcaggtgtgggtctaggttgagtgctgacaatgaaatcttggtgcatctgagcccagcaggctgtttctgacttggctggagctgaggatggaggagcacgggaagaaagtatcccaaggacagttttctgagccagtgtcatggaggtgtgaatgaagcggggcagagcgggaaacccgggcggagtgctccactactcctctttggctggtccctgaactggatatcctggtcagtaatgaggggatgtttggccccataccccccggtcctgacctcatcccctggccactgggagggctgcagtgagctagatggtctgggggcctggatgtcagggcatgcggacctgtcttgcaccttggtttgctccagccggggagaaccacttttcttctagaacctaccatctccacatctcacagctgatgaaggcaggctggaatcatctctctgacattgctcagggctggggttctggagggaatagccaggggtgtactaaaagacccttggccccagaacaactgcagagcatgtgaagcataagacccacttttgtttcctcccaggaacaaaggggcagacttttcctaaagtggaggatataaaaatgcattcaatcctcaaaccagaagatgctcctgaacgaaaaaacacagaatagagatcagaggggaaggaaaatgcctgaattttctgagaaattaagaagaaaaatgggaggcttgttaaattatcactatttcaagacaggcaaggaaataatgtaggttcctaaatgaaaaaaaaaaagttaagctaaatgatagtcttagtaagaaacagttcctaggcattgctacctagcataaaaatctttaagggtgagtcaccattctgcagggccagggagacccactgacagggtcactaggcacggcgcagccaagaaggccaccagtgttgtcagggagatcatcacacaccaagattgacctcgtgtgtgtgttgaggatgatgggaatggctcccacagccagagaaaggagatacaaatacagaccagcaagagtgacccctgggatgctgggctgtaaccgaaggcatggatgtgaaatcatagtttctagtaagacacagaaacgtgtatgtgatattcacataggttgcatgcagcttcctacgtctgtctgctgagggcctagaagcaatgacagcccagtaacaatgagcacctccagcacccacatcttggcgtctaagaaccattctccactcagagaaacggtttccttggagaaatggcttcttccaaggctggggaaataagtacaaggtgggcctggaactgtgtcagaaagcaaggaatcactcagagaaagatgggaggtgagggggcacaggagcctgcgtagaggtgcccaaaccggccaaatcagggctaacctgaccatcaaaataatcagaatatcccatcaattaaacagggatccaagactgcatattgatgtaaataaacaaaagtgggaggggaaaaagccctccttggtacacagtatcatgtctgtggtatttctgccaaaaatgcgtaacctaaaccatatcttgaggaaaattagataaacctaaactgaggacattccaccaaataactggccatacttcccaaaaggtctgaatgaacccatgaaggagctccatgtcataagttaattcaaagtcagaaaagagaagactgaggaactgacgattgataaaaacggaagccacatggctattgaacaccatggggtcccaggccagagagtgaaaaaaaaaagaggtgctgcttgcgtgtttttcaactttcttcttctataaaggacagttttgagacaatcagcaaaatttgaagagaatttgcagatttgatggtaatatcctaccaatgttaatttcctgaatgtgatgggtaaattgtgggtgatgcaggagaaactcttgtttttaggaaatgtacaggcaagtatttaggagtaacagggcacactgtctgcaacctactctcgaacaggtaggtaggtggatgagaaaggcaaatacaatcaaatataagcaaacagggaatctagctgaagggttaccagagttctatgtactactcctgtcacttttctgtaatctgaaattatttcaaaatacagaacgtaagaactataacatttcaataaaaacttcagtgttgggagcttccatcaagacacacttctctcccccacctgatcacccgtgtgcggagggacccaggcagaggacgacgcccggctccaccctctgctttctcggggtcccgcggcctgggttaattgaggacacaggggcccttccagaaggccatctgcaagcttccgtcactgcctcaagcctttggttttcagaaaccagattactcgagctcgttgataagaaaaagcagtctcaaccagcttcaaaaaagtaggcaagtactttgctttattgacatcaaatggaacttcttgtccctcacgcagtccacacaacagtaaaggcacaatgaggcatattaaaacatagccagtttcaacagcttggatatttcctgccatggaaaagtatcctgcccacagattcacattaacatacatggtacattaatatcaatctctatcatataccaggccacggtacatgtttgcacgcagggtcacgttctgcaacaaacttattctaataacagtattcagaaggcaccctatgggacacaggtgacagtgaagttacgaggctagatggccacatcttttacatccaagaaccgccctggggccacaccccaaactgctgaggtgcggaggcacgtctgcaaagcaggtcagaaacactccccccataccccaaaacactatccctatcccaaatcacctaacaaaaatgagagctgggaagggcgcaggtgagcagtgcatctacctaggtaatactgtctatgtctaggtaatactatgtaattttatcttcatactgcgtgtggagataaaaaacacagcttctcctgcacctcttccccaagactggtgcactccagcgacctgagggggctcgcctcagtccccagcactgaggttacaaagggagaattttttaatgacttaggcctgtggctctagagttgccaaaacatcttaggcaacgagaaacgaacggcagctagtaccatgtgggcacgtgtgtgtggttgtccacaaggactcacccaagtaatagactggaatggttaagagctggccacacatacgccccgcaaagctggctgctaccattcgttccttgttgcataaaacattgttttcaaagccaaccccactacttagtcatcatttagagactagactatccaatgttatgaacatttttaacaggtttcaagcaacagctgataaggtattcatctcttaagatattttataaaacaattccatggaaactttaagacaggcctctctgcccaccgtcatgtatgaagataaaaaacacagtttcccctgcacctccctcaagactggtgagctccagcaacccaaggtggctcgcctcaggagagagtggatgcttccacgcctggggcttcatcactgagagaccagcctcagcgacccattaggagcacaacgaaatgattctgacccacggtcccttcagacagcaggtgcctagatcgatgatggagcgggcatgtgcacctgagccagcttcacctggaggggacactccggtcagcagcagccgcctcctgatggcaccatgtcacctctgcttggttaacatttaggtaagccacaacagggccccacgcaggatcgttccatccccacgaggaacacaggacaggacaagagccccacgtggacccccggtctccgcaggcagccagctaggtcttgcttcgccgcaggagcgtggcggcggggccatggccgccctggaacttgaggctctgcaggttgatgtgggccccatgcctgagcagagtctccaccgtctgtgcgtgccggccctgggcggccaggtgcagcgcgctgagcccctgctcgtcgaacaggtcaatgacatcggcgctgaccaactcctccaccacctccgagtgcccgtgggcggcagccaggtgcagcgccgtctggttcaggggtccccgggccagcacatcggccttctcctcgacaagcagcttgacagtggccaggtgtccgttgcgggcagccaggtgcagagcggtgtagccgtctgaggtcatggcctccttgccagcgccccgatgcaggagcagcctggcagtgctcgtgtgccccgtctccgcggccacgtgcaggggtgtctgtgccagcaggctgcagacgttgacgtcggagcacaggtcgatgaggatgcgggccacgcggtagtgcccgcgctgtgcggccaggtgcaatggcgtcctcccatccagcgtctgggcgttcacactcacccccggctgcttggccagcagcttgacgatgggcaggtggccctgccaggcagcgtagtgcagtggcagccaggcatccttgccctgcaggctcacgtccacgcctcggcgcagcaggatgcgcacgatattctcctgcccgtgctggcaggccacgtgcatgggcgtccggccctcaaagtccacctcgttgaccgaggcgttcttctccaacagcagccgtgtgctagactcgtccccgttctgggctgcaaagtggagggctgtccactggtcctcatccttggcgttgacactgatcttccgcgccagcaggagctccacgacaccccgcaccctcctctccacggccatgtgcaacggggtggagcccctacggttgctcaggttggggttggcattgttgagcagcagccacttggcgcactcctcttgcccggcctccaccgccaggtgcagcaggctggcaccgctgtccagtgccaggtccacgtcctgcggctgcaggatcttcatcagtttgctggtgtccccggacacgatggcatccacaagcttcttcttctggacgtctgtggtgcccagatctgcagggagaggagaggcaaaggtcagagcgtggctgcacatccagggacgtggcgtctctgggagcctggctgtggcgctcaggtggaggagtgccatggcctccaggctgctcgctggtcacccgactgtgtttgagcgttgtctgtgcctcgtgattaaggtcagtcctagcgggagccccggggcaggctggcgaatgtctcccaggtgctcgttagtcggtttgcaaaataaaacccgctctccctgtcctgcggggtggtgagcccccttggtgcttagagatggcagtgactgcaaacatcccttcattaaagaaagaaggaaaaagggcacagactaaaaagaccaggccagagctcccattcgcctggaagccttggcacctgccacccacggacgccccaggcctagcagcctgcagagatggtgactagagctggaaggggctgctccagctcttgccccacctcgaagtggcacctcctgacctggggaggttaagtcggaagttttctatgataatcctgaagggaccgagcttctcgtttcaggaggacgttagtccagcactcaggatgaaaagttgtatttaccacaaaaatcctaccgtagtgcctggaatgctgaaaccctgcaacgagactctcctccgccctcatgtgaaacgcgtggggacttggaagtcggcggtgggaaggtgttaagaaaacggaaccctcccagtcaggcttggtgtctgaacactggcactccaagtggagccagtgaagtaattctctctcgagcatgaagacaagatgtcatttcagagtattagacccaaagagaatgttctagaacgtacttatccatgggagatggtggtatttctttctgctcagtcttagactttgccctgactctcctcctcaagcccatcacccactgcttatctgccgtcgaaccaggtcttccccactgtgtctatgtagcattgccttaaaacaagacagcctcctttgcccccaatattctaatctaaaaatcccgggaagtctgtaagatccaggaaaagtctttgcctccaagaggatgtttccaatccaccaggaaaagccaacttccccttcccccgagattgcagccttggccctcagcccccgtggctgtagccctgagtgtaaatccctgtattttccatcagagctgcagccccttcaggaacagggcaggaccacatcttacccctgcagccggcagaaaggaggccagaacaagcaccaggtccagcaccctggggcagggataggaaaaaaagcaccttccagaaacaaaagccatcaaaattaacataaaaagatgagattagctaaaagagaagtgctcctccctatcaggtggtttgcaaaggtggcctggtggtaaaacctccaaggataaccaacacattactaggcctggactaccgtgaacggggagcccacatatgcgaaggcgtgggtgtgtacccagcagcgtctgagcagagggtgcgggactgccacgcccgagacaggaggcccgccagggagtggggctcggctactcgccaggctcactgcactggagggggtttccaatctgtagacctgaggtcagcctccacccatggcactggcacaggcaagactgctgcacagactggtgatgtggcctgttccccacacatgctaagtgacataagacggagccaaatgcccaacacacaaaattaattacttaagacagagagaacacaaagaagaattcttgctgggtcaagaaactgtccccttgattccgtttagcttctcactgagtccagtccactgtcccgccaagcccagcatctctcgggacacagaggcgtccccactcaccgctggttgaaggttcccgctcaaaggacagcgacagtgatcctctggaagagaaggcggagtccaccgaggacacccccgagagcctcttcccactgccggacgatggcagcttggactcagaggagctgcggctgagctcctcggggccctcgacagcctgggaaactccagagtccagctgtgagagcagctcggagaggctgtagtcgttatcgaaggtgggggcagaggcccgcttgagcctcgcaggcaccacctgcgaagatgcagaagagggggtgggtgaagaccctgccatagaccgcatggcccgcccatgacacaaacacagaagagcaaggtgggccacgggagggagatgggggaggaaaggacggaccctggaagcaatgcagataacctattggtcaccgagctcagaccccgcatcggcacagcactagggagctcagacgccatgtccacacagcgccgcggagctcagaccccgcgcccgcacagtgccgggcagctcagaccctgcacccgcacagcacttgggatgctcagactctgcacccgcacagcgccagggagctcaaagacttggagctacaaagacttgcgctggccccacccagcacggagacatcttaaggaaagatagccttcataaaagtgcaaaatccagcctcatgcagctctggataccatctgctcagtaacactgcacagagcgtcacccagacaaaaggcaggcggtgtcaagctgcagaatgtgaggcatgtatggcgggacacagctgcccagcacaggccagcgttggcaggaaacgagaggacagacaggaactgggcaggacccccacacgtggccacaactgcgacctccccgcggagccacgtggggctggcctgggggctgtgtggggacgagggaaaggggaaggacccggctacagggacgaggggtgatccaatccgacatacaccgatggggccttttaaagagtctcgcttcatggactgcaggggcagcaggtttctggtgggtaagtggaatctgacgggatttcacgcttcttcccttaggcacacctgtttgccccaactccccaccctttgtgggacggctcgaggtcccgcactgttgctgggtgtaccgagccacccctacatgttggttgccttctttcccttatcagggcccaggtctgcctctgtactagcaacccccgggcacctttgctcccgggctcactggcacacatgcactttatgttgaggcagtgggcgcatattcctgatatacatatttcctgatctcctgagctcacaccaacagcctgggattaatcgcccaacaccagataacacgttataaagctcacttatcagctgggcctcacaggtctgctccagcctcatcacccgaaaaggcatttagccagccctgctacttggagcttcttatcacatctgaaatcacctgggtggcactcatcagagtgcagaccatttatgggcagctataaaggaactggatccccgagccaggggtgcaaagacactcagacaccagctctccctccccggccggggctgggccttctgatccccgtggtccacacacatccaatgagtggctatttagtgtcagggaagcccttccgccactcacgcagaatcagacaggaggtggggcggggatgcagtcgggcaggtggacctgagcccccatgggacctacacttctaatggagttgggtgcgggatgggctcagaagagagggagagtggtccgggcggcgggggactctgcaaagaggagtggtttggaaactcctgcctggaagccgaggagacaaaagacccctgtgggaaggactcgttacctcgctcctgggctccggggggcttttcacgtccagatcatgagcagtttctttcacttcgtcatcaggcttttcacacaggtcctcggtttcagaagtaatttcttgtggggaagaaaggggacatgtcactcggatgatgacttctgcgtacacacgcgttccatataaacgcagggcccccacgagctgggggatttctcacacgcctcggcccagcctgagctcaccaggcaagcccaggggccctacatggacaatttgctggccaaacccaggcccccccatcggtaatcatttgaaggcctcaccagactcaaggcggaagccttccccgggggagcgccacctgccagtcacagggagcagagctgccagcacctggcggatgagctccccattcagcccgtttcctgccgtaagctttaaatgcagcagtttccatctcatcagggtgactttcctatgccagagacacatctgtcccaggaagtcaactcctcaagagaagggcgacgccgccggccaccggccaggtaagtccccgggaagagcatggctgcacctgaacttcaggctcccatacagactcctctgggtggcaagcccaaccctggtggggagcagggggcggatggttggaggcaactcagttccagctgccgtggccgagccgtgagtaccagaggccgcaggcaggtgctgggtccaacctatctgtgcagggctcatttcggcccacctgttacacgccttgtttctcacccaggcctggtccctcaccctgtcctgtctgtcacctctgtctcctgtgacacccacagaatgtggcggggagaccccggggtgctcaccttggaaggtgggcctaactcgcggatccccctgccagcaccgctgcatgaggcgtatcaggtggctgcaggcgcgcggccgggctctgcacacgggcggcagctcggggcggtggcccttcaccaccttcaccatgatgtgcaggatgttcttctcatctgccaagggaaggatgcgagtcaggggctctgcagggctgggtggcagcatctcacccttgggaggaaacgacacactcgccgggggccacaatggggccatccccacaccaccccagggagacggctcccccactccgtttcaaaggcagagcttcctgtaaccctcaccctcatggtgcgccatgctctctagtttcctggttttgaaatcgacctctttccctgggttctgatctaccagaaggagtcagtgtgtttggtcacagagcagatctttctaggcatcccatccaaaggaagatgaggttcaaaggagaacaatatcttatgaggctcattccatcaacagcccaagccagcaaagggaatgaggctcacgcaccatggaggagccacagcgtcctacatccacagagacccaactctctctacaatggcgaagaagtcttcctcagttccaactccaatcccaagctcaggtccccagctggcctcccctgccggtgcaccagggctgggatgtgtggaagggctctttcccctcaattcaccatgtggggccgcacctgtcctttccaactgccttcactagcatgcatgggctctagcttattattattattgccacaacttctaccctgactgggaagggcccagggtgacatccagtgggccaagttcttttttctgcttagcctggaaccctcaaggttcttgttcccaacagccctctctgccctccagatccaaacacacccacgcatggaatggcagctctttggagaggccatgtgcctcagcaggtgtggaaaatcagccgagaatcacccacggctgccaggattccatacaatgttttgctccactttcccattaaatcttgtgcaataaatatcgttaagtgtttagcaggctatttccatgattattcagacttcaaaaccaacagctcctctaaataaaatggaagcaaactgaagtaaacgcccggaatgtttcctgctgccaagcacagactggaaaagctggggagaggccttgttctcctgcaccttgaaccccctcctacccatttttgcctgaggttgcaattttttgaatttgaaaaatcagaccttggcgatgaccttgaacagtaggacacgaataattcccatatgattagcgttccaataagggaacactaggcatattcagcaataaagcacaagggcttgagccttgacctgtcccctgcgcctagcttcgggtgtcacatctatcagacactgcctcatttcacaagccttcgggctgtaggccactgtgcgggagaacgtacagaaggcaagaaaggcgacaggcggtcagacaacacagacggacaccggccagcagaggcctggcaggacgcgttctgtgctttctactgacattcttttaaagctgccaagatacttgatcttgcgatgctggaagatctcttctcaccccagcactttcccatacatcggctcctagtctgagccccgactaacaaggggctaggccttgactctcatcttcatttttagacattttcggtcacaccacaaaatatcatgagtagcccagaaatgtctttagaggaaaagggaatctgtccaacaaagctaaaaagtcctggatttttatgataagtaagtcaaggtgtgacaactttgaggatggtgttcggaatggtggctgcctggctggggaagcaaacaccacagctctcaagctgggcaggggtgccactcctgcaagcaactccatggcactgagcagctctggaggttggctgcgcaagcacgcgggtacatgtaatgctcctgaactgtatgcttcacacggctgacatgctaagttttgttctgtgtattttatgactatttttttaaaaagtaaacaaaaaagaattagctggaaataccagcacaggcaaacccctggagacagaaagcaggtgagtggttgctggggcttgagcaggaggaagggcgagggactgcagaatggccatgggctttgccttctagcatgatgagaatgttctggaattagacagtggtaacgcttgttcaacactgccagtgtagttaatgtcactgaattatacactttaaatggctaacatgaccaattttatgttatatatattttactaccacaaaaaaactagctggcacctaaaaacattccattgaacaggccccttcagatctgtgtcttttcctgcatgcaaattacaccacagagcagcacctatggcagcgtggatcacaggctctgttttaggatagagaaaggacaacaaggtgtccccccattattccaggaaagacaagcacattacacctcaaagacaggtccactcacctgcaaacggcttcttctgtgtgagcacgccccagatgacgatcgcaaagctggaagagaaaccaggcacgttagcatctgacagccagagactcaaagccaaatgcactcatgcacagcaacaggcgtgaagacacctgttctgaagccttccaaagacagagccatgacaccgagatatttctcctgtttttaaaaagagaaaattctctatagtgaagcccagcatgttgatagctcagatgtcagacagactcaagtaacttcgccaactgggctacaatcttcaggcagcttgagggacttccaaagagggtgccaccctatgcggggcgtgagctcctggggaacagcgcctgtgtgcctcactgatatcttctcgcaagcaccaggcacagagcacctgcgcaggcatttactgaagaaatggatgaatgaatgatgggcaactcccatgccctcccccaacaatgatttcattctctgaaaacacggattctggttctgatcagcgttcctaacgtaggcttgctgagatttcagcgttcctaacagaggctcactgagagttcatcattagagggttgttaaagaaagtgcgcagaaaacgtaggagacaacacagctgaacgccccaaagcctttttcgggggctgcttagaaatatatagataatatgagggatacgttcatgtacattactctggatacaccaaaaaaagtgcccaaattgattaaaaaaaaaaaaaaaaaaaagaaaagaaaaacagaagtccgaaaactgagcctccaaggagcactgagttggtgagggctgtttatagacaacgaattcaccatcgaaaattagttcaaacggcaggttcaaaagctggaactccaaactctaaaataaatggagaggatctcaatctccccaaactctacaagctgtgactagtctccaaagtgacacttccaggcaactctcagcttaaagccccagctaagcacatgcacaatggccactgtcaaaccagtcagcctgggctgctggcggcggcagtgaccaaaaggcagagctcacatgcggggtccgagtcacagtgctgctggataacagccacaatgggaggcttagtgcctgctcacacgctcccacccacttttcttctccaagaagtctgtgtgattaagacctttacaatttgaaaaaggaagggactaggtgacttggggattgatctctgaccaacaaaggttaagtgccatgaagaagatgagctgctcgcctcacaaaatcagagtgaatttcggaaagtacaaacacacatgcgtacagaccactgaaagcagcaggttcttccaacagacaagccataaagcccacgggtcatgaaatcaccaaggctctgacagggcagggctgtcagcctggcccaaatgtggacctgggaacacccttcctccttggctagcaacactcacagcaaagaaatccctgaactctacaagcacccaccccttctatgtggacttagccccctttctgtttgtttgttttttagacagggtcgcgctctgttgcccaggctggaatgcagtggtgcaatcatgacttactgcaatctccacctcccgggctcaagcaatcccccaacctcagtcccgagtagctgggactacaggtgcacgccaccaagctgggctaatttttgtattttttgtagagatgaggtttcaccatgttgcccaggctggtctcaaactcctgggctcaagtaatcctcctgcctcggcctcccgcagtgctgggattacaggcgtgagtcaccgcgcctggcccgagccccatttctgactggcagcaagaggcctttctgaaagctgcagctcagggcatgaagcattgaggttgagagcccctggcacccacaggggatggggggcggcatgtcacacacctgtatacatcgtgcttggtgtcgaagagccggctcttctccctgatgcgctctggagggaggtaggcgattgtgccaaacaggccatccatgctgaggtcatgcgagtgggacagcccgttgcacttggccagaccaaaatcagaaatctgcaacacagccatcagagcggggctcattagcctgcaacagtgatattttatgatgctttatcaaaagctcccttctgcaatctcagagggtgggtgagagctttccaggagcccctaagagccgtgtctgtgcctctccaggtagccctgccccaggcagggagggagacagattctggggcagaagcaagcctggaggcattaggagcagcacatttgacgggcaggtgaaagaatcgtactgtaaggaaggagttatccgggacagaactgcagaagaattagaatccaccttctgtaaagcatcatgtttgccatggtggttgagagccggctgagccggcataaagggaaaaaaacaagccttcgagggttcaggtaaagagagacacatgtgaagaccaggtctgctcctagagaagtcggggagcaggttatgcaacctgccagctggggaggctggcgggcaagtggctgcaagtcctttaaagggaaacacagaaacacaccttcagaagccctttaaactttaaagcaaacaaaacacacgcctcagagccccgtccatctggagtgttttgtgatcagcagacactggctggctgcttcaaacacatgtgttcgagtgaaggtctgataaacacctctgctggcagcgcccgggccccaaggagcaccggccacccagctcctccaggaatgccctcaacgtccgcattcaggggaggcaggtctcaggtctccttcgggcaaaggtgaccttggagctcactggggagacttcacagacccccggtctgacctctctcgggggcatcccctttcctgccagtgtcctaccctctccagtgtaactcagtcccctttgaagctgctgaaaaccgtatgtgggatgaagacacaagtcatcagcattaatgggactcttgatccagggggagtgctgctctcaactttccttcaaggcatatggatttttttaaaaacccttttcattaactcttgagctcctctcaaacacacccatggagtgacaggaaatgaggctgagtcaggccttaattctgggctggccatgcccatgtggtgagccaatagggctgctgtcatcagcaccaaacagctgggagaatttatgacctgtgactcgggcttccagggatcctgagcacatctgcagggaggtaggggggaaggcctgcgagcagggaccggccctccttctctgcagccaggagcaccaggacaaggcctcgactccagcggctctcatgtcctcccacttccatttctcccagggccttcaggcctgcaccgcccttgagagccacactctgcactccagggaaagcgccagctccccagaggaacgccatcacccgaccctgcaaaccccggcggctgctggacgctgggacacaacaacgggtcctaactctccaaatagctccagagcacaggaagtttcagttcaacagtcatcagtggcttgaaagccttcaaattcagaaatgggctgaacaatgagaacacatggacagagggaggggaacatcacacgccgggccctgtcggtgcgtaggggaagagggaagggagagcattaggacaaacacctaatgcatgcgggtcttaaaacctaggtgataacctagatggtggatgggtgcagcaaaccaccatggcacatataaacctatgtaacaaactggcacattctgcacatgtatcccggaactaaaagtaaaataaaaaataataataaaaataaagaaagcatcacatactttctaggcaattcctcctccccctgtatggttgaatgtaggaaaaaaatatctccctcccacggttagttaaggatcagactcactgttctaatcttgcctgtacaagttagtagctccgtggccctggactattagcctctctgtgcctgtttccttttttcataaaaggaggcaatagcagtacccatcctgtagctttgttgtgaaaattaaatgacatctgagatcattaagaaagaaaagaaaagaaaagaaaaacgacaggggtgcagagatctcagcctggtgcttccccaggcctgcagccttttctcctcctgtctttgtcagatagagccagccactccaaactatacttggtgaaaagaaaacgagcagaaattctctgtaaaacctctggcaacaaaatgcaagctcggaattgagaattctaggagggtcactgaccctctatgttctcctccctccatgtctcggactcctggccggctgcatttcccctccgcctttcctcatcttcccacccaagctgcccctcaccccgtgtcctcaacagcgagctactgtggcatccactctgaccagcaaatgcttcaagagttacaaacactctcatcagcacccgactctgcatctccaagagctgagggctcacagctgcccccaagcacatggcccttcaacttcaaggtccagctgtcaagactaagaaagcagcctgccggggttttgctgcctctaaaagaaagacacagcagaacgtgacccgcgtgtgaccctttgaaaagcgtctgttttgggctaactggacatataaatgcagcctgagattttaaaccaagttatttcatttttaagttgaaattgattccaactagtatcttaatattggtatttagtatatgtaatgttgaataatatcaagcattaatttgatactattactttgtatactatttacatttaactgcttcatgaagtagacagttgctgtgatatttccagtttgaatcgagccctgagcactgagggagcccatctcagaggcgaatggcagcactggaatggcaacttaggatctaattgcaggattctggattacagttttcctgcattgaataactgtctactgaggactgcccagaagcccagtggtcagtccatgcaaagcttccacacttcgtcttcaggaacaaaggcgctgactctcagaaccccgacacacactccctgctgcactctacgcacaccagtagctatttcacagaaaaaataagtatgtcacgtaaaggtatttttcggtttgtttttgggcttcttgatggtgactaacatgcctgattaagaaggacgccacacaaaagcaatctttcctgcggcctgtcagggtacacagggccctaagatgtcccaggggcaccacacagagatgtcctgtcacttcctggccagcacccagcgtgccttcgacagcagcctccctgagaaagcagttccaggcagcatccgccccctgcagctgtcctgaaagacagggaagccctgctgcctgctgcccctgcaggaaggcccagagctctctgcgtctcttgggctgtttccttcacctaaaggctctgctgctgcctgccccgactcctgagggcagaaaagccccaccctgtgtgaaggcccagccccaggagcactcccaccccctcccacagggccgcctctaggcccagcctgcgggccacacaccctgcccccaagtgactgctacgtgcagtggtcatttggtttctttcatgtcaagcacagtggcaggccaggtggaaatcaaggtctctgctccgtgacttacagctggacgatcctggctgctaatttactcactctaagcagagactcagcgagaaccagaggccaccgtccactctgcacctctgctctgaggatgagggcagctcccgcaggtgaagcctctagcatgtcctttccggtattcagtgcacgttggacggcagagcttactagtcattagggccccagagcctgtgctacctagaaacaagcccgtaaatgttggcgggaatggggggtccgcatgtgaggcccagccctgcccatcacaggaaacgggaatcccaggggtcccagaacataagcagatgcgggaaaccaccagagagcccgttcaagccaagtcatttgatttttgtctccattatctcaatttcctacttcacttcgcaggacggtgcttcatcttctagctgaaatcttattactgcgcaacacctacctaagagacaacttataattactgcccgaagtgaaaaattgacctcctcaccaccgccctggctgagcaaggcacgcgagatgcactcgtccgcagagtctgggcacagggagcggccgtgcgcatgccatacgagccaccgctcccgtcccacccaagagctcaggggcagggccgggccctgaattcaggtctctcctaattaatggtcaggccatcagagaggcctggaagtgctgtgccaccaggaacagtagcacagccaagccaggcaggggactcctctgcttgtcccctgcatgaactacatggatccggaccatggctctcggctccttctcactcccagggcagacaccagtgtcatgtggaccagcctatcaccctgggcctcccaagagcatgtgaacatcaccacgtggggaaaaactacaacgcgccaggtgtaaccaccacatgtcaacgacagtacaaccctagccacgaaggccatcaaaggagatacaaggaaatacagccctgatgcaaaggtgatgatgctaacacctgccaaggcccagaggcaacactggttttcagttacattatctctcttacttttctgtgtttcaaaaacctatcagcgaagcaaaagcaagctccatctcccaggcgttgcactaacgcaacacgctgccactccgcactctacgcaggggcagacagaggcaacgagcccctcctcacaagcctctttccacagcactttgaggaccccactgcagaggacccccacattcccaccaccccgagctcctgaaaacactgagggaaatgcgtccctttgttgcagagcctaaggtctcgcaaggacacacctggcccacgggctgaattctaacctgatttcataagaccaaaacccacaaacccgtaatctttttccggaatgagtcatatgccaagatttgggggaacagcccccatgttcaccaagctaccctccagctacatggcgtgtggttttcataccaaccaggacaagcttaggctcctggagtcctcatgctgcaaaaggcctcggtttcaagctctttcctccaagaagaaccacctcctcttctgcccttgtcctgacctcagggcttgaccccttgataccctgctccccaagacacaggccctccctgcccagctctctcgggcaccgtgcggccccccaccttgacgtggtagtgggcatccagcaggatgttcgcgggcttgaggtccaggtgcaggagtggcggggccatgcagtgcaggaagttcatgcccaccgccgtctcgtggatgattcggaaccggagatcccatggcaatggctccgaagccagcagcttttccagggagcccgtctccatgtactccatgaccaggccgacaggttcgcggcagatgccatacacaggcaggatgtagcgaaacttggccatctccatcttcttggcttcttccaaaagctccatgcgctccctgaaaaagttcaaaggcatgaagaatacgcaatggtcactcagccacaaacatggaacagcaccctggccagaagacgaccagctccagagggctgagcaaatgcctcaagtgcacacacatggggcacacttcaatgtcacatcacgaatgcagggctttccagagtctcagtcctgaggctgctgaaatgtacctatgcatcacagggttatcacaagtgaggaggagggaaattctaatcgttttacaggtagcactgataacacatgtggggggtccacgtgtgtgaataattccacaggcagccatgagccaaggcttgggggtctcagagactgcaggtgcaggccgataatcccttctcctgggaggagggaagagaagttgacgttccactcaaggttgtaactaggcaactaggccgggcacggtggctcatgcctgtaatcccagcactttgacaggccaaggcggatggatcacctgaggtcaggagttcgagaccagcctggccaacatagtggaacccccgtctctactaaaaatacaaaaattagccgggcatggtggcagatgcttataatcccagctactcaggaggctgaggcaggaaaatcacttgaaccagggaggcagaggttgcagtgagctgaaatcatgccactgcactccagcctgggcaacaaagtaaaactccatctcaaaaaaaaaaaaaaaaagttgtaactagttatgttcaaggaacccaactcaccttctccgtttaagcccaatacctgagttggcccagttattcctgaatccaacctcacactcaaactaatgaaacagcataggtccaaagcatggggttgccaacagccaaatccaaccagccattttttaaaataaaaaatataggccgggtgtgatggctcatgcctgtaatcccagcactttgggaggccgaaacaggcagatcacaaggtcaggagttcgagaccagcctgatcaacatggtgaaaccctgtctctacgaaaaatacaaaaattagctgggcgtggtggcgcctgcctgtaatcccagctactcaggaggctgaaacaggagaatcacttgaacctgggaggcggaggttacagtgagccgagatcgcgccattgcactccagcctgggcgacacagagagactccataacaaaaaaaaaaaaaaaaaaaaaaaatatatatatatatatatatagagagagagagagagagagagagagagagagagaaaatgtagtcaaatagacataacatagtatttattattttagccattcacaggtgtacaattccctgacattacccacattcacaatgtggtacaaccatcaccactatctacacccaaaacttttccatcatcctcaacaaaaattctgcacccattaaccaataactccttccctcatccccatcctcagtaacctcttttctacattctaggcaaattcatataagcataagcatataaaatttgcccttctgtgtctggcttatttcattaagcatgttttcagggtctattcacactgtaacatatatcaaaacttccttttcatggctgaataatattctgctgcacgaatgtactgcgttttgttcatctgttcgtgggtgcaggccatttccaccttttggctctcgtggataatgctgcacatctgcacacattgggggacaaacgcctggagtcgtggctttcaattcttttcgatacatacctaggagcagaattgcttggtcacagtctatgtgtcacattttgagaaactgccaaatggttgcccacagcgtgccaccaccttgtttgtataaataaacttttactggaagaaagtctcactcattcatttaaacactggctgtggctgcttttgcacttcaaaggggagaggagtccttgcaacagaggccctgcggcctgcaaagcctaaaatgttgcctctctaggccttcgtggagaaagctgaccaacctctggtctaaggtcacttccctggtgcagcctgtgttttcacagactagaatcccagtgcaatggtctgtattggcatcatgggtcaaaagtctcagaatgcgttcagagtaagaggctgaatcccacggacgcacgctggccatgcaggatcgagatcagcagccccaaacacagacatggtagaaagcacccaggaagctggctggaatgctggttcccaggcctcactccttgagaatgcattccaggttggggctggaaaatctgtttttttgtttgtttttcttttttgaaacagagtctcgctctgttgcccaggctggagtgcagtggcatgatcctagctcactgcaacctctacctcccaggttcaagtgagtctcatgcctcagcctccagggtagctgggattacaggtgtgccacactcagctaattttttgtatttttagtaaagatgggattttgctgtttgccagggtggtcttgaactcctaggctcaagtgatttgcctgcctcagctcccaaagtgctaggattacaggcatgagtcaccgtgcccagccaatctgctttctaataatataataagctccctaaaggaaatgttcagaaccacactaggagagatccgacctcctatagcaggaaacccagcagctccatgtccacacacaggccacgcaaggcagctggctggggtggcctccagacaattcccccagaatccagcgtccagcccaagtccctgcctataacccagtgtccgctgccacagcagggggctcttctggagctcggacacaggcctgctcctcccagtgacaaacccgggagcaggtgctgggaaatcactcagtggctcccatttcctcgcctgctggtgaatccaaaacagtgccaacagaacgcatccatttcttaatgatctgaccgcccctgcgagagttcagcccctcctaggcttcccttaccatagtgaaaacactttccctgcaggaaaggccagcaggaacccctggatcctactgtttagctcttgctgtggaaattcccatacatcggacaggtaccaaaggctcggagatctcagcctgtctgccccccaacaatgcaagccctgcagctagggctctgcgtctcaggacatagcccactggttctcaattagaggcaacttcaccccccaagaaacactgggcaatgtctggagagattctggctgtcacaactaaaggatgctactgaacatcctacaatgcataagacagccccaaggctaagaattactcagccccaaatgccaacggtgccaagttgaataaccccgatgtaaatcaagtgagtgcattttcagccaataaactactactgtccagaatcaccacttcagtattcccagcactcacctgacctatattttaagcagttctgtgtattggcaagtgctcgcttgaatccaccatatgtcagaactaaggacaagaggtccctttcccgccttcatggtgtttacgtgtaccctctaaggaagaagatggcgaactacccccaaaagagaagtgtggttgaaaaatctaagcctcttgaaaggaaggtccagggagctatggagaatcaagagagatccaaagtcagaagtcagcataggaaagggcccctgagagaatcgggaaggctgagacctgcgcagagtccaggggcacccgggaggccagcagagcggagcagtcgctgtggatccccttgggcttggcaaagcagagaggggaagccagcagagcacacacactctgttggaagaatctgcaggatgggtccattgactgcatgtggaggggagaagcttgcaggacctctctggagctgcaccaggggtcactaggcagctctctacggtggacgcgggagcaccccaggaggagcagctggggggtgtggggggtgggcaggtcgagtgtgtctgaatacactcaaggagcaaagaatcccactggccttgggaacaagtgaagcaagtatcaggaatgaacgtgaaattattatgagacaaaacttaggggagcacggcctgctttcctagcgctctggttaaatgaccaactaatggaaaacaagatgcccaccagtgtgcagtgctagcctgtgggggtccctgggctgagctgaaagctgccccatcaccagcataccatcggctgcttcctccctctccaggggaaatccctctccctgcagccacaggcttgggccaggctctgggacccatcaagggatggggggtgcagatcagatcgtgggactctcaaccctgtccccagtctcagtgagcattgggaaaaaaggaagacgaggacctgatgccaacgtcaagcatcagctaaaatgaaaccggtcaccaaagaaggaaaatgacacctctcagctcccagcctttctcctcctctgggaacaccggttggctgaggccctcatttgttatttaaaggaataccagcacaacttccaacccggcaactgccactaacttccaaaccatcggactgggacatggtaccagctgctgcttctcttttatgtcttgttaagaatcagagttatgatttgtctgtttccgattgctcaaatgtggccagcttgccgcccctcccctaccagtgtggcctccctcctccggacactctgccccggggcgctggcgaaagtccttccgtaggactcagacccacatccactgtgcaaccgtgtgaggcacaccctcctcgccggagggttttgaggaaatgacaattcgggtgtttagaggccagccattcgcaagggtcatttttccacattaagtagacattctgagagtgaactctctaagccaaagctgactgataataaacacgtattctgagaacaatgtcaatcaaaggaaggctgagtagcttattaagtggaagctctgagccactccacaaatagtgttttcttttatttgcccaaagggcttaatacataaaaccccggtgacttctgattgcagagtgagctcattggcgactctaacagctacgggctggcagcagtgcacacccctccccagcgcaccgagttcagcaagtactttactctccctgccccgggctctttctgcagaacggagaccccatttaccttactttaaaagaaacaacaaacaaacaaaaaagggccactgctgctagttggctcctgaaagcggatcccggctagaatttcctaacggagtccaccccagctttgcgcaactgcctgaagggagcccggcacgacttcccccttccatgggccacacatttgagggcactttctcgaggaaaatcagctgtcctggaaaaaaaaagtcattgtttccgtggacaaaagtgttgtgacagcatgatccaaactggcttggggtagacaggattccagctgaggaagggggtcccgggaccgccctgtgggagatctgaggcccaggagtgggggtggggcggctcccttgcctaccagcctggatttcgctcagaagcaccagcatgtcctcagaaactttccacactgtttaccatccagtaaccactgggccaaaacccacacgaccccgccttccagcccctctccaggtgctccctaggcgcacatctgggaaactccagcggctttaggaagctccagcccttctggggtcgggtgtcgcccggcggcatttgcaattcaataagcctgaaagggcctctttgcaacaagctgcaagaagaggcttttctgatcagggaggttaagaagtgctcaggtactcgaagcacagaaagaacccaccaattgcttttgagcaatggcactattttttttaatacatttttttctcctaagcagtgtttctggcttattttaatgattctggcttattctgatgaccacacaaaaggaactgtagatttattactattatcattttaacacgtggagagatgccgaatccagcctaggtgctggggtggcggccagggagcacagaacatcacacagtcacattcgcaccgtctccaaatcgcatttcttactgttgacagtgaagtcaacgtttctgggttgaccagaagcccctctcgtcggtgttaattaaaacacaacctaaaaactgtgccttgctccaagcgcagctacgcttaggcacagttcagagggggtggcatcctattcccctctccttcgctgctggtgaaagcgttgctaattctgcttccacgcaggaacgggaaaagccccccctcccccgcaaaagtgtcctgggtcctgttttgggttccacatgaaaaatctctgggcattaattaggattaacttggggttcaactttttaaagatacggtgagtagcacttagatgaattcggttttctcctcatttagggctagccaaagtgtatttcgccctcccagggaggccaatggagtagcgagaaatacgagaaatatcatcacaccaatcatctctaaaaggaacttctaaagaagtcccaaggttcttctccaggctcagaaattccaaagacctgtggaccaggccagctgcggtttcccctgcaagcacgcatcctggaaagggggaaagaactgccccgggacatggtcttgtgcaagcggagaagcaataaacgaagggaaaagtgagaagcagggaggtgggggagacggtgagaccgctcaggtaacaaagagctccgaaggagaaacctagcaactaccttcaggaaaatgcagccggaaaatgtgtttcatcatctgttagctgatgcctctcagcgaggccttctgcacaccaatccaattatgttcccagggagcctcggaggggttcccacacggctatttttaaaactgacaagaaacgggcttgtccaatcgtcagctctgttgttacaaacctggggtttgctcaggctcgccccgaccagccagggctgaatgtggcaggagcgtctcccagccggcgccccgcaggcactggcttcttctgagcatccccttagctgggggctggtaggggaggaacggggcctttgggatcactttattctctccaaactggtcacagcacccatccctacaccccaccctaggccctgtgacccccacaatgagggtcagccagggaggccagctgcctctccaaagccaccccacaggaccctccgaggcaccgagccccatgatgaaggtaatctcagatcaatggggtgtcacctgtgaactcccaggagggccccctggcaggcacttcctgtccctgggagcctcgctaagtgtctgggggctgggcggccccccaacctttcctgcacagaaaagcaagctcacatggcctggcgcagcctgctcatcaaacaagccccgagcaggtgctgtggccaagggccggctgaaggcctggcccaggggagctgcagggagccaggagaccccagaccaccttgagaggcaagcagcgttggccagtgaaaatcagcctcacctgcacctgtacctgtggtggctcctatgtaacaagtggactagaccatcactgacccccagcagcctggaagaggcccagacccgtgtgtcaggggtgagaggggctgtccctccgagaagagaagcaagacttaggcagaaggggtacagggccgggggctgcacacaaagaccctaggagaatcctatgccccaattcagggaacatcttgcaaatatgaggggctggggtgggaggcagctcgtcagaaaagcactgagaaatgtggcagggcaagtggcacagcgactacttcaaggcctaggtacaaccttgtgagactgcaatgcaaccagctcctggagcacagtgggactgatgtacattcctaacaagaacctcaggctcaatacagtcaataattaacctaaaggaatcagcttcacaaagagccagggtttgaccaacttctcagaaagatcagccactgctgcacatggcaaagccccaacctactctaccaggcccagcagagcacaggaggtgaaatgcttcctgctaggcgatgctgacctcgacctagccacctgacatgccaccacctgtctgctttgggcagggtaggaaaggcttccagttaaagtacaaaacacttttcaaccaagctatgcaatatcctaagtgatccaccttaagtggagaaagcctccctccaaccaggccacccaagaaataagggactggtcgctagaaataacagaagatcctaaggatgtgagctggtgagtcagtccaggtaggtgcttgtttactttgctcttccaatataagaaagtggtgtgaaaattttcactgatgattaaagctcacacacatccccaagagataaaacgaatgcccctatggagagggttccctttcagaacctaaccactggctggtattcaaagtggtttggatttcatcaaaataaccacagcacccctcctggcctgagaagttcccagaatctgaggcaggggagaaaaagtgcacagcctgggccagcatctcacctttgaactagtggtgatttgatgacactcgtcaccactctactggtgtttccaagaaacactggatttgagggttacggcaaaaagccaccactatctctgctgtgtagtctcctagccaaggacgaaaatgcaaagggagaggacaggcctctcatccacagaggcgtcacagtcacggtatggggctgcagcacgcactgccaccccagacacaggcatcacaacgattctgcagaaaagctggggcttagcggccccatcactcaatcagccgagcattcgaaaccaggtctgccaggcagcaaaggctaaatggtattttaaaaaggtgtcgcttctgagtgtatgtgttcaaggaatctctaggtaaaatacaagcatagcttccatgtagaaggtaagcttcattaaaggataaataattaaaacgtgctaaattgagccttacatatgaaccatcaaaatcaactgtaaacagtgaaatctacaacaacaaagaggtactgttcaagaacattctccctacctctcaaattatgcacagacgacaaccgacccaccgaatttaacacgggcggctctgcgtccttcccattcgtctttgttaccttgaacactcctgctaggtaggtacaggcaggttccattctgacttttggactgggaaactggggtgcaggagggccccatggcacggccacagaacttgaatgcaaggcccttccctagcgggtcggtctcgaaattaagtcagctaaaacgagagtgtgcggcgaggaagcgctgggcggacggatcaacaccccgggccccgtgccggaccccactgccaggcccgagccccggagctccaccgcgcaagcgccgggcgcccgggaagcctcgcccgagccaagccgaagcttccgaccgaaataattacagtcttacaccaatttgtgttccaacgtaaattactaagtaagtcgaacggaggctaactccactcacaaagcccagaggcccacatggcaatttttctaagccctgcgcagaccgcagcgccccggtgggtcccgggcgggccggacgcgcctcccaagggcgcgggtccgaggcgcaaggcgagctggagaccccgaaaaccagggccactcggggagtgtcaggaagcacgactgggcgccttaggacgtccgggcagacgcggcccccgaggagccccagaggagccccagaggagccgcctgacccggccccgacgtgcgcgatcgagcccgggctcgccaaagcccccgcgcccctccggcccggacaggccgagtggacattgtcggagccccgcggcctcgccggcaattggtttcccccccgaagctgctccgggggtgagttcgggagagagaggcaggaccccgggaccagagcaccccgaccccgaccccagcccgggccccagccgccccagcgccccgcccgggccgctcacctgtcgtcgacgtgcaggctgggcgagcacttgatggccagccaggtcttccagtggacatggcgcaccttgtacacctgcccgaagccgcccgagcccaccttctcccagcccgtgaactcgcccgcgtcgaaggtgcgcagcagcgccagggcccatggggtcccgccgtcgccctccatcgcgcacgtctagccagcgccgcggcggctgcccaggtgcccaggtgcgcgctccgccctgttacgtcacttccgtaggtcgtcccgcccccaggccccgcccacttacccgccccccgggcgccctctctgccagcgcccggtgactgcggacggatgaatagacgctgcgggtcactgcgctctcccctgggtgagcagagcttctcacgcttctcacgggtctcgacgtgcgcatcagctgccctgcttttctttgctttttttttttccttaattgcggagtcacatgcagttgtaagaaatcattcactttgcctagtttcccccagtgttaccactttgcaaaactttgccaaaaaaaaaagtccaatctcacaaccaggatattgactttgatacagtcaccgatcttattcagttttgccgttttactcgtcttcctttgcatgtattagttttacacaatgtaatcatctgtgtaccttcccgtatccacccccacctggccactcctgtggcgattttacagccgcaccccggagccctggcatcactaatctttcctctatttctaaaattgttttatttcagaaatgttatgtttagatacaggaatcatacagcgcctaattttttgaaattggctttcttcactcgttagtctaattccctgcaggttcacgtcttgcttttttacacgagtttcctctcagaaagtaactttttttaaaaaattacccaacagcaaatctaaagtccatttcaaatgcaagagttccctcatcctttcctaaataacagcctctttttacaggtagaacagatggtttgaaaaggaaagatttttttttcacatatggggaaaaaaaattcccagccttggaaggatatttgggttagaggccgaagtgcatcacagatcacgcacgcgtccacacctcagaaaacactcactcattcctgagacgcaacggtgagtgaaggcttatttttggccacaggagattaataatgaagacaggagggcggagctaaaggagagggtattttaacgacattaactgtgtttttgtgttagtaactcggaaagagagaggctgccccaagtcagcgcattgaaagccgcagacctagtgtctccaggctcccccttccaaacgggcgcggaccttctttcatagcctgtagcggggagccgcgtctccccactgcctccccactcccatccggccgctctttggagggaactcacacatcccaacatgacgatgcttgctcggggggcctcctggggggaccagggagccacttcctttcccacatactccggaaattaaagttggtctccttaaggctggagtggcaaatagttgttttaagcttgtcacaaatgtaacttacatttggactaatgttttaaaaaataattggagttttgaatctacgaagataccttggaagtaaacatagttattattttggtgggaaaaaaatgaatggacttgaaagtgagtcacctgtcctgttcccggggctcagctctagcaaagtacctttctccatctacagtctccggcacacagctccgcagctgggggtgactaagagcccacaccacgcaagtaataaaacgctccaatttcatttatttaatcatctgtgtgcttcatttgacaaatatttatggagtgtctgctgctagctcagtgcctggtgcctgggactgaagaccagagccccctggagaccaaaagagccagctcccagctgtgagcagatcgggtccaaagatcacgggctcggcggcaggaacctggtttggtatccggctcctctgcggactttgaagtgctttaccgattcacatgacaactggtaaaacgaaaacaaacacctttccaggaattgtgaattcgagttccagaccctctgggattccgggagcgcagctgctatttatgttaacagtcattggtcccaggctggtgaggttagaatttccaagtataaaagtaatttagtttcgttttaaatacattttagggccaaagaaaagtggaacgatttaaagaaaaagatgaaatgaataatagggcaagttgggaggtggctgtcctgaggtttcatgggacaacattaattaacctcatgaagtgcctgcatggacaacgtgcccggtgtggttacaaacaaaccaatcagcacagatcctgggtggaaagcagggcgcagccacggaggcacagtaggggtgcagacttgaaggtttttaggaggtaagccccgagggcacgaagctccacggagagactgttgacccgcctgggagtgcagtgcaggtgaggaggggagggacgacgaggggagacaatggggggtgggaggtgggaaggaggagttggggaagggggctgtctgctgacatttgcaagcccccactcccccactaccctgtgttcctcctggccccttccccagaagaattccaagccagtttcctcctatactggatgtcctgacagcgaatctaaataggtgatcccttgagctccaggtccccaagctgtgcccttcttcatagggggccatttagcactgacccacccagcaggcagcccaaggtccctggtctggaagtgccaggaagctgcctttaacatcctaccgcagggaacaatgaaggttgccggccagggagaagacaggatagagacgtctctgggtttgcagccagcctgcctcagatggggtcccaggctgtgaccatggtgcatttgcctgtccctgacatgtgggatagagggacctgcttcgagatgtcggtggggatccacgcagatgataattatatgtgtgtggcacatgccaggccatgggtgaatagtgagattttcaattgagtcattttcgtctttgtccttctcagggtcctggagcaactcaacccttgtaagtgcatggctcagtgagatcgtggagctgacatagggctgacctggctctcagaggccccagaataaagctggagcccctggggtccacctgctggcatgaccatgggacaggggcgtggagctgagctgggtcagccacctgggaacatagtcccctcccgccaggcctctgcacccagcctcctccctgcttagtaggctcctccctcccctacaacagccactcctgccaccacttgcatggttgtttttgagaattccctccgcattgtgttattttctaaaagaacataacttgttcactgcagagattctgccttcactaattctgacaaagtgatttaggggagacattgagggcctgactcgcgagggctcccagaccacctctgggagacccatctccacctgacacccaactcctcgctcttactcaagcaaatattttctatttacacaaacacttccttatcagagacagctcctcctttgacccattggttccatgagtcttcctgcaggatcatacattccgtgtcctgggaacacagcataaagggtgctgttcagcaacctaggggcttgtgtctgatggcagaagccatgaagcagatgggggatgaattataattgtagtaatgctacgttctaatctgctttgcaccctcatgctccactccatagtctttaaatgtggggcttcttaaaacaccaatttggagcctccctgatcctcccctctttccccaggcagctcatccaggctcacctcagcttccatgtattctacgaagatccctaagcttctgtctgcaggccagacctttcctctgagcctcaaacccccaaaacttaacatggtgcccacagtaggatgtacctaaggcaccgctacccatttgagataagcctatgcttttcacccccaaactggttctttccagcatctcctgtttctgtgaatgagccctttccattctgaaggccaggacagagtagcccatggcccccacagcacactcaatccagtcctgtgtcccagcaccaccctgaccaggacaagaggcaaacctgccccggccccaaacgttaaagggctccagtctgctgttccttggaccttcctgtctacccagtgcctggagtcaattgggccaggagacacccatccccatagatcaagaaagctctggggaccctgaaattcccagtgcaaatgtccctcagccatctccagcccctgcacatgttcatttccctgagagcaactgcacgacaggtgtgagcacccgagcccccaagtgtagccaagagaaagctgcgtgcaagggccatgggcagagctcggcctgaagcccgggatattcacgcatgtgccagtgaggctgttcgtgggttaggacggagctgcaggcagaaagagcgggggactctttgggggccagaagctgagaatcctcagctgtgctctaggcgtgagagtgcatttgtcagtcagaggattgaacacacttcatttaaccctttgttagcttgatgtagaactttcaacaattcagacacgtagcccctaggcccagttattgtaccttccgctggggtccagaagcatcaccacaggtctggtcaccaagcctgcacctcttccatcctgagcctccctgcctgtgactctgtcccctgtgccagtgcctggaccccagtcatggtcactcccatctggtcatgacagcggtcaccctatctccggagggctcaggagggtctccagacatccatgggaccctagccccagccagtgtgtcttgacacggtctagagaaagaattcaggggacaagtggtcatggtgcgaaaggcaccgttttgcttttattgcagagaaagtgggcacctgaaagagagctcggacttgtgtgggagaatgagtcgcacacagtgaagtttgggtttctgattttgtgggcttttctttaattagggggtggaataatcattaagtattttagaaaaaagaggggatttcagggacctcctgattaccaccctttttctccctcatttgggtttgcctggaagcgtcctggacatgtcaccctgacaggggtttcggccgctttctctcccttgtttgggttttctattatcctggggtttctttgcctggtactagttttagctatggtttgggtttttccatcctcccacgaccaccgagtgctgttcctatctcaaccctggccctcttgggcccattcttcacctgcagctggacatctggaaaacacacccctggcctcgctttcacggtggaaatgagcctggcccctccagctccggcctgcagcctttgctgctcctggccctccagccgcctgtcccctgactgggtccagcttggtgctgcaggaccggtgcacacgctgtcctggggccgggaaatctctctcctgacaccactccctgatgcctgcctggtctcccccactcagcccatcatgggtgtctcccccagccccaggcttcgtcacattcctctgttacaagctcaggagcctgtgcacaagttgccctgcctcccccactctcggcttcatggggcggagcaatctctgccccttcccccaccaggcagaggctctccacgacccacccctgcccacctctactggccggcctctgctacccccactgtctctgctgcagccacactgaccctccttgctttcttccccaaaccagcgccctcctccccaggccctctgcactgctgctgcttcttcctggggggctgtgtcgtccctctgccctcactgcttccagtttcatgtgacctctcacagctgccctcctggatgacccgtctaagacagcgctggtcccctcccgctggccaccatccttctgggagccactcaagagtttaggggttacctctctgctgacactcaccctaaaatgcgtggtactattaacttgagtaaatattttggttactcaagggtgagccccacttagagtccctccagagtgccccccacagtgcctcctgagaagtacagcaaatgccgctaaaatcagaggttctctgcacacggcacttttagtacatcagtaatctttttatggcatccctagaccaaggaaacgtccagcggtttcatttattcagtggttaggatccaataatttaaaaaatattgatggaaaaatagtctagcagtttctccaaaagttaaatatagaattgccctatggaattgaaaacaggcattcacacataaacttgtacattcatggcagcagtattcataatagcaacaggcggaaacaacccaagtgtccatccatggatgaatggataaacaaaatgcagtctctgcatgctgcgaaaattcactggatccctaaaggaagttctgatacatgctgtattgtggatgaaccttaaataggttcatatgtattatacagttgtatgatacatttctatcaaatattgtatatggatgttaggtatatatacattcgtacggtccatttatatcaaatattcagaacaggcaaatccacagaggcagcaagtagatgggtggttccaggagctgagggacagagggaatagggagttaatgggtaggagtgtcctttccgataatgacaatgtttttgaattggatggtggtgatgatggttgcacatcattgtgaatgcactgcactaaacgaattgtacatttttattttttaattttttttagaggtggagatcttgttatgttgcctaggctggccttgaactcttgggctcgagcaaccctccttgcctcagcttcccacgtagctacgggtgcacatcatcctacgcagttgaactgtacatttttagatggttagttttatgtgatgtgaattttatctcaactttaaaacaaagttatatcttaacaacttagtagctttttaaaaatgatatgcataaattaaaagaaaaaaatttgtatctcattcttaacaatcgttacatacttatgggatggtttcccctgtccgacactatacaacttctcaaacctggaaatgtcctgtgctgcgctaattttcacttactgcttttagtcacagcaacctccaaaaacccaactttgcaaagatatggcatcgtcagaagaaatggggtgcaatctaatgttgacagtgtaagtagtccggagtgagcagctcacgtggtttctcagagactttgcgggttcctcccaaactttaaaatatcctggtgcacctgcaggagttccctgtgctgccccacagtgccacagcacccagtctgagaactgtaataatacatatatgctggattaaatattataaagttaattcttaaatacatccttaagatgtccatccattgcttcttttccctctctctttttgttttgtaatcaaccttacctttcaaataattttgtaaatatgggccaattccttccttaaaacacccacttctggaagaaatattacacgccctggagaatttctttgcacttactgactccctctctcaacacaggtggatgagagtgggacacctgccagttgtttgcatcagcagacactcagagtccatggaaaaaatgagcctagaggtttttaaaccacaacacaagcaaaaggcacctggtcccgttcctcttaagacagaagaaagaggcgtaaaaccagctccaggtgccacccttaagaaatgttacagtgccggatgggaagagtaaaccctgaacatctcttcttaatactttacagacttcaagtgtattttatggtgacaaagcatattgaagacaaatgaaactctacaaccctgaaaaccagcctgaattattttgagagacagacagtggctgcaaggagaagcgtcgggattttctgggctggccatctccagtgtcactgaccccggtctacccctgcatgtttgtttacgggaaaggagttgaggaggaggatgtatggctgagagcctgaaaataatccagggcaggtggagcgaggagaggactttactcctcacactcatgtaggcatcctgaaaagccacttttctttccaaggtgggcacgggccttgagcttggagtggagccagttaaagttgtccgctctgggtcgtcagatggagatcttatcttgggtcatgaattgtggttttaggagaaaggcagaagctaaacccatcttctgtctggtggggaggcccagcaaagggctcagaaacacagccacaggcctcttgcagcagctggatgcacatttcaggaggttgcctgaaagcagaattgacttcagagagtagggcagcagagcccagccacagagtggtcccaggagccaggaagtgccacacagcccctcgcttatttttactcagtatgccacagaagtcctgacctgttaaaagtgccctttaagaatggctggcccaccctctctcagagggttcatgctggggagagggttcctgcatgcccgctaagctccaaatgacaacccaggtgtagaaagggcttagactttagggttcaaacccatcctagagtccggtccaaggccagttacagccaatgggcagtggtaggtgcagcccagcccattagctcattcttgagcctcagagggacagagcagcactaatgggtgcacaaatggctagaatgttcaccaactcctcgagagtggcattggacatttgggcaagggtcttatggaggctgagagttgactgtgggctcatcacagctattttgagggtcttgacagcccaactagcaaacaattctgcagggatgagaggtcagggcaaagggaaatggcattgtcaagtggacagccaaaaagtccaggatgcccccaggtcctggggaacggcgggggaggaactcagggactggattacccacaggacctggtgagacccacagccacgggctgacttgtgtccactcagaagcgtatgttaaaatcctaacccccagtactttggaatgtgaccttatttggaaatagagactttgaagatgatcaagttaagatgaagtcatggggccgagagcggtggctcacgcccgtaatcgcagcacttcgggaggctgaggcgggcagatcacgaggtcaggagatcgagatcatactggctaacacggtgaaaccccttctctactaaaaatacaaaaaaaaaaaaattagccgggcatggtggcgggcacctgtagtcccagctactcaggaggctgaggcaggagaatggcatgaaccctggaggtggagcttgcagtgagccgagatcgtgccactgcactccagcctgggagacagagcgagactccatctcaaataaataaataaataaataaagatgaagtcattagggtagaccctaaagcaacagagctagtgtccttgtaaagaggggaagtctggacacagacacacacctgcactaagggaagtgggtgggaaacactgggaagatgccacatgactgcagtgacgcagctgcacgccaagtgatgcctggggcactggaagccggggagggttcctgcctggcccctaagctccaaatgacaacccaggcataggaagggcctacactttggggttcaaacctatcctggagtctggtccggggccagttacagctaatgggcagtgctgggtgcagcccagcccgtaagctcattcttgagccccagagggacagagcagctctaatgggtgcaaaaatggctggaatatttcaccaactccttgggtgggtgggtggggggggggcattggacattttgggcaagggtcttcttgaggctgagagaggccaggaaggagcttcccctggagttgtctgggagtgggaccctgctgacaccgacctcaacttttgacttctggcctctagagctgtgagagactaaacacctgtggttttaagccacctggtttgtgtcactttgctgtggcagccactagaaactaatacacccaactagatacgtatctttgtcacagttacaggaatctttattttatccaaaagcaaaagacactgaacttttgtgtacattccaggcctgctgattgtagctggtctataagctcgtgtcggagtctatggtggttgatttttgtgtccctttgactgagccacgaggtatttgatcaaacattattccaggtgtttctgtgaggctgcttttggatgagattaacatgtaaatcaatagagtcaagcaaatcgttctccccaatgcagatgggtttcgtccatgcagctagaggcctgaaaagaaggaaaagctgatcatcctcgtgtaagagagaatctctcctacccaacggccttccagctgggatactggctttttcttgcctttagacttgaactgaacaattggctcttcctggcctcaggctttgggactcagaagcacacattgactgtcctggggctccagcttatggactaccctgcagaaagactgtgggactcgtcagccatcatcatcctgtgagccagttttacacagacacacacacacacagtcgcactctcatgctcacacatacacactcacacacaatcacacacttgcacacacacagacactcttacacactcattcacacactcacatgtgcacacacacagtctctcacacacatcacacacacacacacacacacacacacacacacacactattggttctgtttctctgtataaccctgatgaattcaggatcttaaaggttacctatttcattgtaatgctgttttctagcaccaggctagtccttttgtcggcagaactggtaggctcacttttttttttttcagactgttttgtgttttattttcttccatttacaaaaaagcatttctaagccagggcagtgaagcctgacgctaccgttcacggtcagtgaaatgagcattcgaggatgggactcagcctgtctggacaggtccccagacaaaaaacacagagaatcaagaacgcaggcgctccctgtcggacgccaggccgggccctgtgacaaggatctcagcgctggcggtggggctgccctgcgggttcgaggcctggctcttcctgccccactgcctggtgtgtagcccaggggccgggccgcctgcgccccccgccggggggcacgcccggcccagggttgggggtgtccggcttgcccccagggggccagcggggcctctgttatctcgctccagaaccgacatcgccagccaagaccttcctcgtggagccctcggtctggccaaggacgctccttggagtctgcttagacgcacagcgggctcagctttgccaaattctccaaggagactttccatgaggcgcctcctgccatctgtgggcggcgttgggaactgcggccaccgctgcttgggaatcaggacgtcccagctcccaaccggcggtcattcattccctcaacacacactctgggccgcccgcctggctccaggcaggccctccggggactcgggaaataggagttgttaaacatttctgaaacattcctcttccatttattctgtgattttcttcagaaacacaaggcgtgcacgagtcagcttatcagcttatccttcacccacacgtaggctcttctttccaatcaattttatctttgtttttttctaagaaaattttagggattttacttgtttttgttttgtttttgggtttttttgtgtgttttgttgttgttattttgtttttttttttttttggtggggggttggcttggtttggtttttgcttcattttttaattttagggatttttaaaaagccagcattccttaatcttctgattgttgtgtgactgttgtataatattgagaaatacattcctgtcatccacaactaacaaccattaataatgtgtcgtattgtttacttttttgtttttaactaaattttgctttggggaagtatccatgacgatacaatatagctgtgagatatttcctgtacctgctacgtaacaccccttcatgtaaaacgcagagcatttggtttatccacatccccccgccccccgcccatgcatattagtggtttccagtgctaaagggacagcgccccccacgtgcatttctccaggtactgaggcaggagaataggggctggaggcaggggaccaaaggctgtttcactcagacttcctacaactaaattgaaaggaaaaccctaactttccactcctaagtaacaaaaggaccagaggctattccctttctaaacccccccaccttttcctcgaggcaaatgggaaattggctgtccgcaaccaatcagactgattgtgggtggagtcttcgtttgcacctctgtaccttcgctccagtctctgaacggttgctgtccacaacgaatcagactgattgcgggctcagccttcgtttgcatagaagtataactttgtaacttcaccctagcctctgactggttgcttttggcaccttcatttacatgaggtgagcatgatgtggccaattggaaacttctaggggatatttggacccaagaagatcctgtatccaggcccttgagccgctgctcgggtccgctcccatactgtggagtgtactttggttttcaataaattcctgctttcgttcttttgctgcttcattctttctttgctttgttgggcgttttgtccaattctttgttcaaaatgccaagaacctggacaagttgcagttatgaccctcgaccggtgatagtagcactcgctcctaacagcttggctgcagtaagcctaggcttccagggagagcctctgcacctgctgctgtgctgcttgagttctctcagacaaggaagcatgaaaagggctgcctttttcaaacagcaggggaaggaaaacacagtgataacaaatccaaatattatttcaattgagatcttatcatatacatcatatacacagccatttaaaaagtgaaaacaaatataataaaatcaaattatattcaataaaaaaagcaaggcgcaggcatttacataatgagacccacttctcttaatgtattatatagtctgtaaaagcaaaagatgtgaagcaccccaaatccccatggatgggcgatggttgaattattatcactcatccataggaaagactgccgtgcaattgtgaaaatgggaggaggactgtgtctacacgtgcctctggagtgattgcacagaccactctgaacagagcaaggtggaggaaatcttccatttttccagtacaggcaggaaatagggacccatccctctgtctatctatttactatctttattcccatccatctattatctatctatgtttctaccattcatcatctatgtactacctaactacttgcctacctgttctctatcatctatctaccatcaatcaatctatctctccctatctgcttccattctaaaaataaacagtgtgagcacagtccacagggagggggctggaagtctctgggggaagacacaagtccttgttgcacatgccctgttttctagatttgactatgaaaccatgcaaatattttacatccttataaaacacaattaactttaaaaagcaatgtctaaataccaaaaataaaataagacaaatgaaccaaatgtgtatccatttggtagcctgactaaccagaggggagctattccaattgactttaaaacgtaggaatttaaaagtaactactagtggaaaatgcactaagggcaaaaagaacagagaaagaaaggaaaggaagaaaggaaggaaaggaagaaagaaagaaaggagggagggagggagagagagaaagagagagaaagagaaagaaagcaagagagggagggagaaagaaagagagaggagaggaggaaagaaagaaaggaaggaaggaggggagggaggagagggaggaaaggaaggaaggaaggaaggaaggaaggaagggagggagggagggagggagggaaggagggagggaggcatcttaacccctttcccacaatcacactattggctgagtgttgatgttatcctgagactgccctgtgtgtgttgaagcataaaggaaatgtgatatagaaactctatcattagctctatggtaaagaactgagatttttggcatgagaaaataaaagttaagaagctgtaatttaaaagaaaaatattggccagacacagtgcctcatgcctgtaatcccagcactctggaaagtgggaggatcactcaagcccaggagttcaagactaacctgggcaacagagtgagaccccgtctccccccaaaataaacaaaattagcgaacatggtggcatgcacttgtgatcctggatattttggaggctgaggtgggaggattgctcgagcccaggagtttgaggctgcagtcagccatgatcacaacactgcactccagcctgggcaacaaagtgaaaccttgtctcaaaaaaataaaaaatcataaaagacaaggaaaatatcagcacgaaataataattaaaatcaataaaaatggataatgcaagcattctattaattaggctcattatcataatgtaaatacatatttggggaacttgttcctccaaacagcaatgctctctcttcctcctctacactttatgccaactaattttacataaatgggaaactgtcatttctaccaaagcgagctgcactgtgtttcttggggtgaacctttagggagacagccattgtgagaatgaaaggggaaatatattattgaaagtttacttacagtttttaaaaatgcctatttcctccctgttttctcccaccctccaagtttattagttacctctatccactagcaatggacagattttcatgatttaattatttttactatcaattttaaaagtcagcaaaacatatttactttttaacaatatatcattttaaaagggtacagagttgcagttacataggacgactaagtctagaggtccagtgcagagcctgaggactgtacttaacaattctgtgctgtaccccggaaatttaccaagagagatttcaggtgctgtcaccacacaaacacacaaaacgcaaccgtggggaggtggacatgttcatatgcttgaccgtagtaactttgctgtgagtatctctatcaacacatcatgttacacaatgtaaatatatgccttttttttttttttttttttttttgagatggagtcttgcccttgtcgcccaggctggagtgcaatggcatgatctccgctcactgcaacctccgcctcccaggttcaagcaattctcctgcctcagcctcccacatagctgggattacaggcgcctgccaccacgaccagctaatttttgtatttttagtagagacagggtttcaccatgttggccaggctggtctcgaactcctgacctggtgatctgcccacctcggcctcacaaagtgctgggattacaggcgtgagccaccatgcctggccaccatttttatttttaaaatgataaaacaaaacacattgctgaaccaagaaaagaattgagatgatcgtgcaaataatgatgcatactatatttgggaaaaataaaagttatgaaacagtagcaggtccaagttatatacgcaactgtgtaaaatgtgttctttaaaaatcagggtttctgtgctttcagcaacctacacatgttctgacttgtgatctcaaggtctgggagacatgtgtggtgaaatcacacacacctgccccagcagaggggtcactggacgtcttcatgcgctgcagggaactcagatgaaagggaccttaagtaatgtaacctttacgttagattcaaacatgcctttatgactgctcatctgatttgtaatttaaagcttaagcaaagtatggcattatttaaatgctcatttttaatttgttgaaagaaaagtcaatatttatcatgaagactgcggctcaagcctaagacctatctagtgggaagcaggaccagagcaaaggtctgactgtacgtgaacattttaaatttttttttttgttttttttttttttgagacagagtctcactctgttgcccaggctggagtgcagtgctgtggtgcgatcttggctcattgcaacctccaccccctggattcaagcaattctcctgcctcagcctccctggtaactgggattacaggcatgtgccaccacgcccggctaattgttttgtatttttagtacagacggtgtttcaccatgttggccaggctggcctcgaactcctgacctcaggtgatctgcccacctcggcctcccaaagtgctgggattacaggcgtgagccactgcacctggccaaaattttaattttttaaataaaatgttatccttagactgcctttcctcctctgtttactcttctttacactgtgtgtgtacatgcactggttcacatgtgtgcatgtgtgagcatgcactgcgctcatgggtgtgtgttgaaggccgaaagaacgagggtcgtgaccagctcagcacaccgctggaggctgtatgagcaaacagcaaactgttctcatgaatgcaggttgttggcaaactgacaaaccgccaccagaaggaaccctgagggcagtcacgccccaggcgcagtgtttcttgtgattatctacagccacatctgaagcctgttgtataaagaaagcaattatgtgaacctgtcataaatcaagcagctgaccaatcgttaccttttgctccctgttgattctgcctagtaaatacgaagggctttagaggctcagggcccttgctcactagaagcaaggagcccccgaccccttctttaaaacagatctttttgtctttgtcttcatttctgcgttcatcccccttcgttcagtcctgtagtaaccgtcataggtgtgcatgcacaagtatgtgtgtgtgtgtatgcacatgagactgaacctgagaagctccacactcagctacatcaggggcagcccaagacctgcggaactttccagcatgactcacgtctccccgtcctgcccctatcttccagaacactgccagccagatgtatcttatgtaacgccatccctcatgcagaggacctgcaggttctacacactggcatttgggggccccttgggaaagtgaccagtgaggctgagaggtccacaagccctacccataccccaagaaccttcaggcttgcagagatttgaggaaacctccagtacaagaggtaggaaacaaacagaaaagaaacagacagttcagagattggtggcagagggagagcttcaaatcttcagagaagatgtgtcacccatgaaactagaacacagtgagtaggggacaaggaggaccagataaccagaaagaacgcttagaaattaaaacatgaaggccaagactaaacattaaagagtcaagaagatcgtccagaaattaccacaaaaggggccgggcagggtggctcctgcctgtaatcccagcactttcggaggctgaagcaggtggatcacctgaggtcaggagtccgagaccagcctggccaacacagtgaaaacccaactctactaaaaaaaaaaaaaaaaatgcaaaaaaattagccagacctggtggcgggcgcctgtaatcccagctactcgggaggctgaggcgggagaatcacttgaacctgggaggcggaggttgcagtgagccgagatcgtgccattgcactcccgcctgggcaacaaaagcgaaactctgtctcaaaaacaaaacacacaaacaaaaacaaacaaaaaaacaagagaaaaaagaaaagaaaaacgaaattcccacagcactacatctgcagtaggcactgaaagcctcctgtcctgggagactcccctcctgcctcctggacagtcccactctgcctttgtctcccttctctcctcttagaattcccactagccggatgcctctgccaactgaagctactatgaacattgtgtgtaagtcttttgtggatatatgttttcatttatcttaggtattaggttggtgcaaaagtaattgtgttttttgctgcaaatttctgagttaagcctactgagccgagatcgcaccactgcactccagcctgggcaacagagcgagactctgcctcaaaaaaaaaaaaaaaaaaaaaaaagaagaagaaagcacagaattctcacccacactctctgctcctgcatccccgccagatctgtattggtgtggtgcattcattacagctgatgaaccaaaacggatcattattattaactaattatttaaaattaacatttagggctgggcgcagtggctcacacctgtaatcccagcactttgagaacccgaggtgggcggatcacttgaggtcaggagtttgagatgagcctggctaacatggtgaaaccccgtctctacaaaaaacacaaaaattagccaggcgtggtggcacatgagactacaagtcccagctactcgaaaggctgaggcaggaaaatcgcttgaacccagaaggtggagtttgcagtgagccgagattgcgccattgcactccagcctgggcgacagtgtgagactccatctcaaaataaaaaaagagactccatctcaaaaaaaaaaaaaaaagaaaagaaaagaaaagaaaaagtcatggaaagcagctcaggtgcttctttgttttatcactcccaggaaagtgaggctttttaaaaggtcctactctcagtgatgttccacaaactttatcatcaaagacagacaacactcaatacactctagaaaatctccatgtgcttaaagtcaggtgtaattgaagttaaatgggggccagtcgcagtggctcacacctataatcccagcactttgggaggccaaggtgggaggattgcttgagcctaagaattcaagaccagcccgggcaacatagtgagactctgtctctacaaaaaaaaaaaaaaattagctggcatgatggttcatgcctgtagtctcagctacttgggaagctgaggtgggaggatggctcgaacccgtgaggtcgaggctgcagtgagccatgatcacaccactgcactccagtctgggccacagagggaaatcctgtctcaaaaaaaaaaaaaaaaaaaaaaaaaaaaagaaagaaagaaaagaaaagaaaaagaaatggtaaatttcagagactcttcaaggagaatatgtcaaatagtacttaaagctgttaaggcttccaaccaattcttgaagtccttgaaggttcgtaggaaagtcaaagaggggagaaattgcctggagaaaacggttaacgacgcagggctggatgaggagttagtctgtggattgaagaagtgaaaggttattagacataaggctatcattacctctacttgatctttagaagaacagaacgggaggaaatatcctaaagaatccaacacaaggaagtttgtggacaggaatgctgttggatgattgcgtgaagttgggaaatctctccaacttgtttcattaataagaaaataaatcatgtctggggtagtttagccatgttcttgctcttggcttgaaacaatggttgtcaagttgctgccgggggctataaaacttgatttggtcccgagttgaggaaaaggacgctcggctcagctgtgagtcactggagcctggagccacttgtccacccatcagaagttctcacagcaatttgcacggaaaaccaaagctgaggttaagcctcgtcgagtcagaagtctgactctggctggtgaataaccagttaaaatatttcagctttgacgccacctgaaggcaggtgtgggttgggggtggctaattacatccagagtgggacaaagttccccgggcagctgtgtttgcagccgtgacagcaaacatcgcaaacagcagtcaggagccaggaaagcgattgagcgttttgctgttaccttttaaattaaaaaaaaaaaaaaatgagctgggcgcagtggctcatgcctgtaatcccagcactttgggaggccaaggcggctggatcacctgaggtcgggagttcgagaccagcctgaccaacatggagaaaccccatctctactaaaaatacaaaattagctgggcgtggtggtgggcacctgtaatcgcagctatccgggaggctaaggcaggagagtcacttgaacccgggaggtggaggttgcagtgagccgagatcgcaccattgcactccagcctgggcaaaaagagcaaaactccatcttgaaacacacacacacacacacacacacacacacacacacacacacacacaaataggtccctggttttaaaaacaaaagtctctgcactgtttggtgacacatttgcttgctggttgttttgggaatgttccactgaatcttggagggatgctcttcattagggcccatgcatttccgcctagtgtgcgccatccacgttctcattgttcttctccttaaaagaattattcggcctgagtaagggcctagcagcctctcacaattcccaatttctcccaaagtactgacagtgatccaaaaacaaagaaaagaaccccagttccacaaacatcaaattaaagattcattcagacaatattttgtaatgatattttactgaggccaggtgtggtggtgtatgcctgtcatctcagcgttttgggaggctgaagcgggcagatcgcttgagtcctggggttagagaccagtctgggcaacatggtgaaaccctgtctcaacaaagatataccaaaaaaagaaattacctgggcatggtggtgcacacctgtagtcccagctactcgggaatctgaggtaagagaatcacccaaacccaggaagttgaggctgcagtgagccgtgatcgcaccactgcactccagtctgagtgacataagtcagactctccctcaaaaaactaatagtaatgaatgattcagttttactgacaatgaattctttttattgagaaacctaaatcatctaataatgagataacaattatttcagggggtgactgagccgatgttagtagaatgactgagtatagcacatcgggctattcctcttatcctaaattgatgagctggatatttgaatagaattcttttcaattttatatttttactgatgctttcaagacccatatagtaactgaaaatctaggaacacattttagctctgtttctaaagctctggacactaaacaaatcagtgtccaatctaccaagtggagaaccacctgcagtaaaaagatcttagcttgggagactaagatacgaagatacttagagcatgtgacatgggtatttttttcactgtggtatttactgggagtttccactgttttttaattttatctatcaagcctctctaatagactgtcccaagctgggcaccagaaggttatataggaatggttgggatgtatggggacagtccagggaatatgattgtttaaaaccaaataaggcacagtaatacaccgctagcttctatatttaaatgccaacatgtacccagggggcatcagaatgtactacaattttagacatgagatttacataatgatgtcagataaatgcctttttcatttgctatttccattatgtaatcatcgagcataataaagatcacttgtcataaagaaccattttctactggacagttacattccattaatcattaaggtagcatggagaattaaaaggcttgaataatcatgttttaccatttgctgaaaagggacaacaaatataacttaatgaacaaagttgaagaattcattagtgatcttattaataagagtgaatcattggagatgaggattttcgaggctcatgaagacttgaaaatttcaagtgataattcaaactggatagaacactttcagctattggtttgaagcttcaaagctttgatggctaaggaagtatgtcttccaacaacacctagacccagaaaaaacatggttaacagtaaaagatgttgggagccttttctccccatggttcatccgaactgggcaaattctttctcttatctctccaaattatgatcttaattgttaaatttttctcttagaatacagcatgaataatttgtacaacccgtactacacaatactagttacatggaaaatacaaaccacattttaaatgatttaacattggttataaggcagttccacaattattccccagaaacctatacactgatcttcaattctgtaatctgactcctgggcatttattccagagaaatgaaaactcatgtacacaaaaatattcacacaaatattcatagcaactttgattcagaatagctgcaaactggaaacaacccaaaattgtccttcaatgggctactgcctaaataaaccatagtgtacccgcataatggtctcagcaatgaaaaggaatgaactgttgacacacccagcaacttgggagcatctccagggtggagatgctgagtggaaaatcacaaggtcagaagattgagaccaccctggccaacatggtgaaacccagtctctactaaaaaaatacaaaattagacgggcatggtggcgcacacctgtaatcccagctactcaggaggctgaggcaggagaatcgcttgaacccgggaggtggaggttgcagtgagctgagattgagccactgcactccagcctgggtgacagagggagactctgtctcaaaaacaaacacaaaagaaaaaaaggaaaaaccaatctcaaaaagtgatacatttggtatcttgacgtggggcagataaacagaccaacacaatgatacaccagcattgtatagaatctaatacacacacaaacacacacacagggtataaatgaaatctgaataagaccagtggattatatcaaagtcaaatctaactgtgatctagtacaatagtttttcaaactgttaccgctgggggaaaccagacaaagtataagagatctctctgaatgattttcgataactgtatgtgaatctactatctcagtaaaagttggttttatgtgatctgctatctcaataaaagtttccattaaaaaatcatggttttgggaggccaaggtggacggatcacctgaggtcagaagttcgagaccaggctagccaacatggtgagacccagtctctcctgaaaatacacaaatcagccggtgtggtggcacgcacttgtaatcctagctactcgggaggctgaggcaggagaatcgcttgaagctgggaggtggaggttgcagtgagccagcattgtgccactgcactccagcttgggcaatggagtgagactgtctcagaaaaaaaaaaaaaaaaaaaagcatggttaacatgtaaagaataataccttgatagacaaatataccatattttttaaagttatagaatgtatgattccattttatataacattcttgaaatgacaaaattatagaggtagagagcagatggtgattgcctgaggctagggaatgggggagggattggggagggtagggaatggggagggatcagggaggctagggaatgggggagggatggggaggggagggaatgggggagggattggggagggtagggaattggggagggatcagggaggctagggaatgggggagggtagggaatgggggagggatcagggagggtagggaatcggggagggatgggggaggctagggaatggggagggatcagggaggctagggaatgggggagggatgggggaggggagggaatggggagggatggggagactagagaattggggagggatggggaggctaggaaatgggggagggatcgggggctagggaatggggtagggatgggagaggctggagtgcagtggcacaatcatcgcctactgcagccttgatctgccaggttcaagtgatcctcccacctcagcctcctgaatagctggaactacaggcacatactacacaccagctattttttttgtttgttttatttttttttgtggaaatagggtctcactatgttgcccagcctggtttcaaactcctggcctcaagtgatcctcctgcctcagcctcccaaaatgctggtattacaagtgtgagccatcacacatggcctctcgtacattttataggtctctatattataagtcccataatacatcatctttacttttgcttgacttttaaatatatttaactgataagataataaagtatttgaatctacccacattgttaccatttccattgttctctgtgtccttggacaggtccagattcccacctgctatcaccttcgctctgcgtggaagacttccttaaagagaactcgcactgcaggctactgacactgaactccttcagccttgtgtgtctggaaaagtctttaattggggagctgattataatccccaaaaacacaatcccaaacaccataaccccaaacgctgaaatcccagaagatcaaacctgaaaatcacaaccccaaaagatcaaaatcctgaaaatataattctggaaaaaataatttttaaaaacatttaaaagatattgcagttcagaaacatatcaaaacaggactgcacacttcatagaccactttatacaacaaaataggtgataataataacatatactttgcaagcgtaaacactcaggtaaactaatgacagtcgcacaggttatgagcagatgaaccacattcttttttttttgagatggagtctcgctcttgttgcccaggctggagtgcaatggtgcgatctcagctcactgcaatctctgccttctgggttcaagcaattctcctgcctgagcctcctgagtagctggaattacaggcacatgccaccacgcctggctaatttttgtacttttagtagagacgaggtttcgtcatgttggccaggctggtcttgaactcctggcctcaggtgatctgcccgcctcagcctcccaaagtgctgggattacaggcgtgagccactgcgcctggccagatgaaccacattcataaagaaataggtcaaaacggaaaggtaaaaacacatgtcactatcggtaattgcgcacacccagctttctaactgtggtcatctgaaataccaaacgaacaaagtgtctttcaacaagatcaatcaaaacccccgacgggtcaccactgcatgtagttgcccaaagagccgaaatctggataaattttatctttcacaaatgcaaatgtacaaaaagaacatctcttcatttactgaggaagtttcaacattttctgatgtccaaggcagcagaagaaacgtctgtccaagctctcagagatagaccaacttgccttctgtatttgttctctcgggcaccccagctgattggatggtgcctgccagcattgagggcagatcttgctcacctcgtccactcagacttgcacaataatttccccaggagactcacagacacacccgaaagaatactttaccaggtttctaggtattcttcaatccaggtaagttgacatctaaaattcagtccacatgtgccaaccctggtcaacttggcacacataggtatctcatttgaccatacttaatttccaaataaagacaataagctgatagttttacttaacatgatgcaactatgctatgattgtgattttcaggattttaccctttagggattttgatcttctgagatttcaacattcgggaatattgtgttcagggttgtgtctttcaggattattatctaaacccctttatttggccttcttttttgaaagatatttttgctgggtatagaatttatcctgacagttgctttcaatgctttccctatgttgctccagtgtcttctggcttgcatctccttgatgtgaatttgacgtgtcatcattatctttgttcctctgtatgtgatatgtctttcctctggattcttccgggtttttgtccttattactggttttcagcaatttgattagtaaatgccttaacatagttttcttcatgattcttgtgcttggtgatcactgagcttctcagatatgtagttttatggctttcggcaaatttgacaacattttgctcattctttttttttttttttgagacagagtctggctctgttgcccaggctggagtgcagtggcgcgatctcggctcactgccacctccacctcccgggttcaagcaattctcctgcctcagcctcccgagtagctgggactacaggcgtgcaccaccacaccgggataacttttgtatttttagtagagacagggttttaccatgttggccaggatggtctcgatctcttgacctcgtgatccgcccgcctcggcctcccaaagtgctgggattacaggcatgagccactgcacccggcttcactatttcttcagatatttttttccatctctttcccttttcttccaaggactcttcaaaaactctaataacatatattaggctgcttgaagttatctcaaagctcgctgatgctctgttcattttctccctcttctttttctgtgcattttattttgaatagttttttttttattgccctagcttcactgatcttttcttctgcaatatctgacctgctgtgaatactatccagtatgtttgtcatgtcatcactgaaattttcatctctggaagttcaattcattttgtttttaaaaaactacatctttcatgcctttaacaggtttaattatttaattattcctctagcttttagaacatctgaaaaacagtcataatttctcttatctttgtctaccaattctgtcatttccaagaagatttgatgggttaattttgctccttatcatgagttgtattttcctgattctttgcatgcgtggtcatttttgattgggtgctgtcctgattttgcattgctgggtgtgaggtgttcttgtatctctataaaatatccttgagcattgttctgggattcagtgaagcgtcttggaaacactttgatcttttccacgttttgctatgaagctttgttcagtgggaccagagtaaggtttaggggtcatttctcctcatttttaggcaaaatgcttctgagaactctgcccaaatttccctaaattagagaattttttctctctgcatgctgggaacaggtcacttcctcacatgcgtgcttgtccgtactcagctgagagtcatggggtcctctgttgagctctggcgctgtctctgcacagccctctcctcccccataccctgccctgagaactctggctaccttgtccgtcctggaccttacctttgtctcatcagttcagggactgctgtgccctgccttgtctccctctctgcactgtggcctgggaagtctctccagtccatatgctgggcagtcatgggattcacctggcttgtttttcatctctcagggaccactgtcttcactcctgatggccatatattgtgtctgggcttttttttttttttttttttgagacgagtctcactctgtcacccaggcaggagcgcagtggtgcgatgtcagctcactgcaacctctgcctgctgggtttaagcaattctcgtgcctcacctcccaagtagctgggatcacagacgcccaccaccacgcccggctaatgtttgtattttcagtagaggcggtgtttcaccatgttggccaggctggtctcaaactcctgacctcaagtgatctgcccacctcgaccactcaaagtgctgggattacaggcatgagccaccacgcccggccgtgtctgggctttttagctggttcaagcagaagagttaagtctagttcctaccccatcagggtcagaagcagaaatgtttagatcagacaattgaattgcctgtgtgagcccctccatacagtatgaatggcagatgcaagaccctggtgaggggtggtggcgggtgagaaggaagactggctggcaggaagcagggccaggccctacagacctggaggctgcagaaaggatctgtgggtattcagagagctctcaggatccaagggaggacgctgggcttggtgtgtgggccacactgtagaatgtacaccttcaagggttactgaggtgacggcacggagaatagacttcctgggacaagagtggaagctgacaggcacttaggaggtgtcagctggaaacctggagtcggggaatagtggaggacatggtgaaatatggacattttctttttcttcctttaagagatggggtctcactatgttgttcaggctggtcttgaacatctgacctcaagtgatcctcctgccttggcatccaaaatgttaggattacaggcatgaggcaccacacctggtcttaaaacctggacatttttgcaaacacttggatgtcaaggtgggaagcagggcaagtccaggatgaagctgggctctgagcttgtgtgtttagtgatgacagggctgttggctgagcatagggtcagtggggaagggccaggtttggggccgggccggggaaagggcgtgtgaactctatgagctggacgtgctgagcttgatgatccggtgagacccgcaggtagagaggaattgtacgctttaattcaaggaaaaaatggcaaaatacaaaggacacataggactctcctgaggccagcatgcctcttccagacggttttagataagcagcaagggcagcctctgggtttctagaggctgtttcctacaacatggaggcaggtgcctctctttccttcattaccttgctgtaagattttgtgactaaaactcaagagagaagaaaacagctagtgttcaggtcaagccccaaattgtgatgcaaatgtggtgacgtgaaggaagtaatgtatgcagtggtccatctccaagacaaactgccttgaattggcttaggtcagcaaactacctaagaaacaggatacactagacctctgcttggatcatcaatgcctgcttgtcagcctcccccttccccctttctcccctcccccttcgttgccctcacccaaaccaaagaaatttagtctaagatgaaagtttactagcctgcaaaatagctcattttatctattcgtatcagcgtgcccagctacttaggtcataagtcaaatgcttgaagagcccctgggctgactaggattgcaaagcattgtgggctgcaacaaaatgcagcaggaaaaccctaaaaagacacctaagacccctgcccaacaaccaataggtgatgtctgggaaggttgtgagcccatagtgctcagcctatgaggaactcggggagggacctgcacactaggggatacattgtttgttgaaactgcactgggtgtgcctgcccatcagacacccaatcttgcaagaccatcattaaaagtctcacttctgctgttcttcgggtctctgagtccgttctttgggtttggacggatgagtctgtttctcacagatgcaccagtgttcaggaggaactgaatgtctcactcggggaacaggctatattggcaggagtgaagtcttgggtctggtcctccctctacccagaggtgtgctgagcagtggtgtgtctctagacaggtaggtccacattccaatgaagggtgccttccccatggtctccctctttataaaacacatagaaggcaagcctgtcagtggggaaagaacgggctacttggctccaagacagtctggatgtggctgccatgcttcgaggacacggaatgcgagctgcctgcacttgggaaccctgggctcaggggagccacattccccggctaagggaggagaagctctcagcttcactggaagcaaggcttgggtggaaggggaggccccggccagctttgtccgggcaacccagcgccacttccagatgattctgatgattgcaccgccatacaggcaaggtcactcatccctgtcaggccagaacgaggacccctgtgagaatacactcacaccagatgtacaacctgatggggaagaagccaatggcccgctctgttcccctctctacggagcttgtgcctaatgcttgtgaaaaggccgtattcagactgtgtgcttgtcagttttccaccacactgcatggcttttagcagagcaaatcactaggtggtaatttgcaccctgaaagaaacatgggggcactgatgaatcgaatgtgcatgctaacatgctaacaacatcaccaccgtttctccctgcagtgttctgaaaggctgaaagtctgcctttgtgtgcaatgagaaccacacagggctggcacacacaaggacttgctcacaggtggccaaacgtgaaatgaatgaatcctacttcctggcagaattcattgctggcagatgctacctaaaatacaacaaaaatatccaaggcttggttctcacaggttaaatcctcagaagactggatatgtaaggtgtttcctaactttaaaatgacctagcaggccgagtgcagtggctcatgcctgtaatcccagcactttgggagactgaggtgggtggatcgtttgaggccaggagttcgagaccagcctggccagcatggcgaaaccctgtctatactaaaaatacaaaaattagccaggcatggtggtaggcacctgtaatctcagctacttgggaggctgaggcaggagaatcacgggaacctgggaggcggaggctgcagggagtcgagatctcaccactgcactccagcctgggtgacagagcgagacactgtctcaaaaaaaaaaaaaaaaaaaaaaaacctagcaaattagaatacatcattcaatatttgatcaaaagatcaataagataaggggtcattccagaccatctgcccaaagaaactcctgctgaagtattcgcctctttctagctgtcaatctttttggtgcctgttctctctcaatctaagctttacaaaaaatgctacatgcaccctcttggtggcttttttttttttttggcaatccctgtgaaagcttctgatacctcaatatctcagggaacatttcaaataatccaaacattttatgagttctggacctgagaggaatcaagatgtggctgacggcaggaatcgtgagcgttctcaaagtatatgaactgcaccaccttccctaacaggcagcgggagcagaaggccagcaattgaaaacacgggtcacagcaccttttattcgtcatcatacaacctgatgtgacaggaaatacagccaacatctccaaacagtcttaatgcctttcacaatccaatgggaaagcccaagacgccgcctctagtggggaagccatgagccttccgcctttggatgccacaaatgggaacgatagaggtacaggaggtctgccttccacgccggaccctccagcgcagtcccatgccggacacagcgaggcggcacttggcacagaacgttttcctgagaacacgtcacacgctagagcattccagaggcccgagccccttctcaacccacagaccaggattcacggggagcagctgtacctgtggcctccccgcaagactcacaccagtggatggcactcgagtccacagctgcacggagccacgggtccaaaacgaattctccactgagatgggtccacagagcctggtggccacaatggctggatctaatgtcttcctttatgaatacatctgtgcacctgggatcagttaaaaaacgaaatacttcctgtcatgatgatcaatatgcagaactgcgtataggtgaggactcttctgcctgggtggtacatggttgttgtattttgctatctagtttctttgatgcaaatttgtagcaattgctttaagacaacccattttgcctcagacagtgaccctattaagaccacgtatgtttacagaaaacttgggagtttgatttttctttagagttctcacttataacaagaagtaagaggtgtctgtgtattgagataaacagtggtatataccacacaatctaaattaggttctttaacaacatttgatgcggtcttactctaggcactaaaacaacttctttaaaaaaataaaattgtgatttccaaggcctttattttatagggaagaggaataaaagatcaatgctagtgggtgtttcgtcatgagcccaaagcccgttgggagtctctgcgaggtcatttgccctttagattctgcaaaggcaaaaagaaatcgatactgatttttaaaaatatatcttaggagccctggtctcctgctgattccatggatgcctggagcacttgtatctggagaatggagacaatatcaccccaagcccgaattcatttgatgagactactatgtataaaacagttaattatatacataaataacataaaataattctcataaattaaaagtcaaatgatctcccactattcattcaactgagaggtgagagctaggcgcgagtgatggtgggtaaggtgaggaggtgagccccacagaccctcctgcatgctgcctggggatgaacattccttagttcatgaaggcatatattgcacaaaacaaattccagccctgtcctcaaaagtctgctgtttggagtgaagtgctgagaaagttgcgttttgaaaaacacaatcatcctttgttctgctggcaacatcaggactgctcctgatcaattactcagccatgccagtgtttcctcaagatggactcccagtgagtgcaggatctgggataactggcaaagcaggacaccttaaggcaggtttgtcctctcactgtggccacaaacagagtaccaggaaagttaagagcaaacttctccccacacctctcagtgtttcttgtcgtgggcagcaggagggctgggtgcctcccccaaccctggcccctgcccccgaaactggtacacagacgtgacagcacgtgtccccgcacacgcagacctggctgttcaccgcacattcagttttaggggcaattaatgcttctattagtgaactaacctctctgctttcattaccacctggcaggaaatagcattttctctgtgtttcagaaatacctacacttttccattgtaaagagccaaactcattcaatatttttatagaaaactggtcatgaaatacaccaacctttggaattgaagtttaaacagaaggaaaatatgacttttcccccgtttcttccactcgggattctggctgggcttcagccagaatggatacatttggattgcagagaatcctgagacaacccggaggagcccctgggggcagcagggaggctcactcctcacacacagccgcgcgaccctctgcatctgggcagctgtgaagggtggacagggacagatggtcctacagtgcacatgactttatcatgttaacataaaactaaaacacaatattggccataacagtcttgaacacataatgtatgtttgaaataaagttaaaaaaaaaaaaggaaaaaaactctattggaaatcgattcatggatattactaagatgcgttttgagctggagtcagtgacctcacgtgaccccttgcacatgatgaccgtgatgacctcgaaggttgcaggatcaggtgcggctcagcacgcctcatggtttcagcccatagttgtataagaaccgactccactcctagttcaaagagaatacacgttactttaacttctatgtgctcgcttgcaaaaaaatccagaagtgaggagaaaatgttccctgctgcctgctgccacctgtgaatactgtctgtgttctcataggaaccgagctctaaaagaaaaaagaaaatgaaccatttgtgttcctaataacttatctcctgcctcttaaaatcctgcttctctctcagcttcactttcccgaaccctgtgtcgggcgaacactggttctgtaaggggaggcagatgcggccccggcccaggacttactgccttggtaaggcatggtgtggagccccatccagtttaaaactctggcctgccagaggtcccttctagagttaagctgacagaccgtaatggttgctggcgggggatctggagatactctgcaaagctaagtcaaccttacattgcaatgtatgactttttgtttgtttggtatccagcaaacacatctaaacaaatcccaaacatccctctgcagttcttgccccgagtctcccggaacgcagctcagtagctgtacatctgctgctgctgctgctccgcctgcacctggggctgggccgcctgctgtgggggtgcctgcggctgcgagggtggcaagacgtcagtctggggcactgcccgccacgtgagcgggtgctggtcactaagctggctccccaggggcgtgatggagttgaccagggtcgtcaggttgatgaaatgggccacagactgtgggttcgaggcttccggctgggggtggatctggacgtcattttggcggttgtgcaacatggcagagccgctgacggtatcaaaggtcacggtcaggattgagttgtccagctgtaactggcgttcaggggtggtaaggtgccccacggccaccggctggagattggtaaactgagtcgcggccgcagtggtgatgggggtcacggtgatgttggttaagccgactgagctcgatggtgtggtcacatttgggtcacccagggtcaccactacctggaagattcacacacaacaaaaatccgttcatttttgcaaaatggggaacgcaaggacctccccaggatgcgctctgtgttaccacaccaaagaagcacgacattctttggtgaaagaggaaaccgagttaattttgttctggaaaaattccagcgagaaacaaaaacaagaaacagacacaatcatgaaagcaatgagaaggaactaagaaacaaattaatttcactggctagaaaaaaatagaaaaaagtaagcacgaaaaagacggaaaacagatgcttccttttctatccattcctctgaagtgccctgctgttggtaaatgaaaatcccaccacaaagctacaaagagcaataaaggtatttgcagtaccaatcgctaataagagaaagcattctctttcatggagagggatgaaaggccaaataaatgaggaacttttgcagtcaagattaccatcccccaaaacaagagagagaagtgcagtattagacacagactgatcaaacactcagaggcttcaaaagcaaaagtgacgaaggctgagcaagacagaaggttccactcgagaaagtgggattgtgggattgtcttcaccttccagactgagggatccttgctctccggctagtcagcaaatgcacagggctgagctttcaccataagggcacttgggtaggccacccgtgacctccccaaactgcaaacagcctacctaattgccacccgggcagggatatctctcttcaacatgctagaatatatgttgctactaacaatgacaagcatgatttgtaggtcagaactcagaaatgcttacatgaaacatgcttaagtgaaaaacagaatgtctgctgccttcaaccacatgaagtccacatgtacactgtgtatagtaaaaagagatggagtcacacacacgtaaggctctcatgcttagggaaagtgaccggcacctaatcagaacataaagcagcaaactgacctgctgaatgctctgtactgcggaattggtctcgtcgcctacactgcctgtgaactccgtctctttctctgagtattcgctgaaggtggcgtcctcgggcaccggagcacccgcctcctcttctggcttctgctttctcttgtgacttcgcttggcagctttcccgtgcttcccttcggccaaatcctcctgctccagagtcagctcaggctgcagaaaaatcggtttcagccgagaaccaggttagtcggtcacgtcaggcagcggccagggcagccccagcactgccctggacacactctccaatcagtggggacgcttgtgggccaccgagctgccacaagaaacagtgaccacagctgggtcttgtatttctaaggatcggggcaagttcctttagttgcagatttaaaaaaaaaatacatgcaagtcatatttttaaaagttgtattttatgctaaaatgtaaacacttcttagaaacttaacgttttaagccactgggtatttccaaagggaaatgtttctgcccgggtgagctgctagagcaaggctgaaaatgctttcaaatcagggctctctcttccccagggctgagacgaatccaccataaaaaacaattttgaattaaaacagatttgaccacaaaacctgcagggacagggaacgagggcccagctgcagtggtgagcccagtgggcccctccccgcacgattccctgcaagtgtccaggacactgctgggctgtgaccacatcctctgaaccgggccggctcaccaggctcgctcaggctcacagaggccgcggggcagtggtggccggtgagtggtcacctgccactcctcttgggcttcctgtgccattccacacaacctgatcctaacccagtggcagacagacccagcgtgggcctacaccgctgtcatggtgggacgacccgtcccccccatgcctgtgacttgccaagggtagaaatggcctgtgggttctggggctggggctggagccgccgtacgtcactcagccggacccagtgcccttcatgaagactgcactctaaagcgctgtttcagaacgagaggcatacatgtgatcttagaccactgagagcatggcacgttctctttgaaataaaaaaaaattttgctaactgaaagtttagtattaactaaaaatttctttaaaaactaagttcatctaattggtatgtttaaacttattttgcttagaacattttaatgattgttctgatttttttttttttttttttcagacacagtctcgctctgttgcctgggctggagcgcagtggcacaatctcggctcattgcaacctccgcccctgggttcaagcaattctcctgcctcagcctcctgagtagctgggattacaggcgtgcactaccacatttggctaatttttgtacttttagtagagacagggttttgccacgttggccaggctggtcttgaactcctgacctcaagtgatctgcccgccttggcctcccaaattgctgggattacaggcgtgagccaccgcgcccagccaattgttctaatttctatttttttctggaaaacatctgttttccaaagtgagatacaccagtattcaacaaactgaggtcacagaaactacagaaacgaggagatgatctaagaggttctgaggggaagagaagccaagaaaacagggtaacctggccacaggcttgcccagagctgctccctcccggcctgtccaagcccctctggtcccttctgcaggtgtccacttaccccaaagtttctgagcccctggggccccatgctgctcacctggacgatgccaatggaggaggcgtcgatggtggtggtctccgggaggtggtccaggtcatcgatcctcaccgcgagcacctatgaggagcacagggcatgagctgggggtcagggtgctgctgatgcaggtgggaacccagaagccacacacgccttgggaccacctccaccactcctgcccttccctcccaggcatcccccgcacttcccagtctcctctgttcagctctgactttgaaactctgtgtccagaagcccagggcttatcctcaccccttatttcatgctcccacaatggtcttgcccctgtatcatctcacgtccactcccccagtggggagactatgtcctccctttttggccccccaccaaaggggtgaggtttcagtggcgcttctgttatttccaagggagaccacagcaaggtaaagatacagtagagtaaacttgttctatgagcaatcaccaaaaatgagacatttgtgccttacacatcgtacttttcagttgaatccatacacaagtgctttcatttgttggttttgtgatgaagtgacgccctgcccctaccttccctccaatggccccactgaacggggtcctcagcacgccccatgtgtccacaggggccctcccaccagctcagtgcgtcctgcccaaaagtgagtgaccttcaccgcccacaccctgcttacagcagttgcgtttgttcctgtgatgacctaattagatcataagaaagacaacggacaacgagtacagagacagccgaacgtgataaaggggaggggctgcaaaacaaaattagcaagagtctgcctgtaagggtgcttcacccaaacagctttgcaaacatctttaaatttctgatcaactaaaggaagttaaaatgaaaaagcagactatgctttgtggatgtaactcatttaaaaaaggagagaagtgcatcattaaatttacattccatgactaggtctgggccccttcctggaaaagatggcaaacaaaggctggtctgtaagtgttttaagttaacataaatcctgcaatggctttgaagactccagtgtaactctcattgacactgagcacagatctatactgtgacactcgcaaaggaccctgagcaaaagcaaccagactgctgtggacgcactctctaccgtcaccaccatcaccaccataagcaccaccaccaccatcatcattaccacctctatcatcagtatcatcaccatcaacaccaacaccaccaccaccaacacaaccacctccatcaccattaccaacaccatcaccaccaacacaaccacctccatcaccattaacaacaccatcaccaccccctccatcactatcattaccctcatcaccaccaacactgtcaccaccatcatcagtaccactaccaccacgtggcatcaccaccactgccattcctatcaccactatcaccaccaccaccaccatcaccaccaccatcaccaccaccaccatcaccaccaccatcaccaccaccaccatcaccatcaccaccaccatcaccaccaccaccatcaccaccaccatcaccaccaccaccaccaccatcaccaccaccatcaccaccaccaccaccatcaccatcaccaccaccatcaccaccaccaccatcaccaccaccaccatcaccatcaccatcaccatcaccaccatcactaccaccatcaccaccaccaccatcaccaccacccatcaccaccaccaccatcaccatcaccaccaccatcaccaccaccaccatcaccaccaccaccatcaccatcaccaccaccatcaccaccaccaccatcactaccaccatcaccaccaccaccatcaccaccaccaccaccatcaccaccaccaccatcaccaccaccaccatcaccaccacccatcaccatcaccaccagcaccacccattactaccaccaccatcaccaccatcaccatcaccaccaccatcaccaccaccatcactaccaccaacatcaccaccatcaccatcaccataccaccaccatcaccaccaccaccattactaccaccaccatcatcaccaccatcatcaccaccaccaccatcaccaccaccatcaccaccaccaccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaccaccacctcccccatcacctctaccaccaccatcaccaacaccaccatcaccaacaccaggtcccccatcaccaccatcacctttaccaccatctccaccactacctccaccaccatcacatcaatatcatcagtatcctagtcacacagtctgaaagctgacgccatcaaagaaccaccatagaagcattagcttcactcttcttaggatataagaaaaaagtgaaaattgctttctgtgttttgtttttaatgtaacattcattcaaagtaaagagaaaaaccatagcttggagtcataaaatagtatcaatcctaaaagattctgaatctctgtaagtagtttatgcctgtttaactagtccaacagttaaactataactagtttaacttaactagttaaattagtgtgactccaacgaacaccttcttcctcctgaatctgtggcatcaccaacggggacaggctcgggggaccgttatcccactctcagacagccaggcctcactgcggtacacacacagctacacaaagctgacccgagtccccttccttcccctcacactgctgtctagggtcatctcttccatatcctctattctagtttgtaatcactttgcctctgtctacttcttatttttctgtctcctacccagaccgtaaagtccaggagggcagggatggaccctggctggccggcccatcacatcactggtaggcatttgtttgagttaatgtagagggaaacaactgtgagatgatcaaaaggaatgacacaaagagagcacaggataaaaggctggagaaacaaattggttcgagaacaaagacggacaaaatccccccgcaccaccttccctgggtctggaaggctttcctcttgagtcacttggttctgtccgggttgggcttgaggggagtggggatgggcaacacacagcccagttgaaggagcagagcacagaaggcgaacttgcagttgggccaccttaggaagtggtttaatcctggtgagaggactctgcctgacagtgtttgtgggagatgtctttatcagtaaggcctctccacccagctatgtatatcaaaactccggtgtacaaaagtgatgtgcaccgtctttatcaatacgcggaagtctagaaacccacacgtcatggagaggaaccgctcaaacgccagccttgctcacgggctgctgggtgggctgcagggcctgccctgcccctggggtgccaaggtggtcctggcgcttcgggttcctactcccccgactctgttttctaggtaaaaacaccagctggccactacatgagaagggaggcaatggagctcagttagagggatccaagctccccgctgagtggggcacagggcagagtatgcagccacggtcccctggcttcccggactggagagcaggttgagtccctgcatctccctgggagcctgatcgggctgcagaggaacagcaacacggcgacgtcccgggtcacccccaaactagggagccaccagactgacacctgaggcagacggtgctttcccaattccaaaaggaagtcactttcattacaggacattggaaaatggagaaaaatgtgaagacaagaaattacccatcacttcaagaacaagagagaaatcactgtgggatgttttgctcccttctttacctacctcatttatataagtgagtattatatatacacacaatgtatgtgacgtgtattgtgtatacacacattatatatgtgcacaacgtatactgctctttcacgtacgtaatgagcatttcacaatttcagatccgtgtaagcatgtgtgtcaggcaaacacactgctaaactatcactaattgaatcacgttcttattgtagggttggaataggggttggaataaccatttattaaacactcgagaaatgctgtgatgctgccttcaagaaaaacatccaacggtgagagcggcaactcgtgccagccggccagtgtggtcactctgaatctaaaaccccccgcccccgcaagaggcgaaggatgccatcctccgccgctaccgtttgcttttctgggatgcgcggtgagctgaacgcctttccgtgtgtttttcaccacggctgttcttcccgcatgagctccctctccgtgtacaccctgagtgcgcttcgcgtgtttctcagtgagtgcttgttatcactaatgttaacaggctctatctgtctaacacagccatggcctatgcaaattttttcttttttttttttttttgagatggaatctcgttctgtcacccaggctggagtgcagtggcgcaatctcggctcactgcaacctccgccgcctgggttcaagcgattctgctgcctcagcctcccgagtagctgggactacaggcgcccaccaccatgcccagctaatttttatatttttagtagagacggggtttcaccatgttggccaggctggtctcaaactcttaacctcgtgatccactcgcctctgcctcccaaagtgctgggattacaagcatgagccaccgtgcccggcccagatttttcatttttcctttggcctgtatttgttctgagtgcttatggagtcaaacctgtgttcacaactccttttgctgcttttacgcttagagagtctactcttttctgtgacctgacaactaagttttcctctggttttgtctttcagggtgctccttcttaaagcacatttaattacggaacatcctggcccttcctgtggagcaggctttcagagcagttgggctctgcctgcgtctgtacaacttccccctccccatcctcggtgtcatactttacttggccccaacaccacgtggagcccccattttgcacattagttccatgagtgggaagaatggggggagtggcagggctgtgcttccatcttgccataatttcagggaggacgtaatttataaccttagcaaaggtccgcctgaggctctcctaacctctcgcagccactcactcagtgcctcctgtgtggcaggcagtgccagtcacagacgcacctaagactcagggcctgcctccagtactgggggtctgcagagggaggtgggccatgtgccagcatgggggtgtccggtgcgcggcccgctggcggggcacggagggggcacagccaccagctcacctcggggtgcttgcgccgcatgtgtcggctcatggaggccctggtggacaccttggtcccgcacagctggcagctctgcgcctccaccttgtcgtgtgtgagctgaacgtgcttctgcagcatgtactcggtcacgtacttcttgtcgcacacggagcacgtccactgcttgcccacttttcacacacacgcagacacacatgcgcgtggaaaggaagagacacgcaggtcactagtgcagccatcccaatgaccctggcctgctggacgaggcaagaagcctgtcacgccccgcccatcctgagagggccggtgctggtccccgagcacacatgagcacagagcctctgtcccttggggagcactgccagcagcagctgcatcacggaaccaatatgagaaaattcaagaagggatacttgaaagctgtggcgggttgaccttcagaggccaaggggccaccatgaagccaagacaacactaaatgtgctggaaccgtctagataatagaatagtcgtttccaccccagcaggcactcagacagccccggcagcctgccgcgtgcgccccgaaggctccttcaggctgcgccgctcacctgtgtggatgagcttgtgggtctccatggtgttcctctcgctgaatgtcttcccacacaattcacacatgaaatctttaatccctgcagagaaaggcgcacataacttcctacgtttaatgagtgttgtaagtccacatcagggcatgtcttctccctgacacgttccaggcactgtagggccttcaggagaaggtgaattgcaagaagacagcagacaatgaacgctcatccccagcctcggccagcaaagtgtggcttggaaagtttatgcttccatagtgacatttcatatcaaaaaaacatgagatgtgggaaaggctgtctgaaaacacagacagaaagtggaacccacatgtggacaagcagaaaaacgataggaatttctttaaagcattaatgtatccacacctcccttagtccaggaagctcttaggcagcacatgtgatattacaatgagagaggaaatggtaactgaaatcaggaccaatggcaaggaggacacagacgagccaagcgtaaaagacaacagaactgccgtgctcggacaaaatgagtgtgattcttcaaaacttgactaattcaaatgagagctgatgccaggcacggtggctcatgcctgtgatcccagcactttgggaggccgaaggaagatcgctcgagtccaggagttcaagaccagcctgggcaacatggcgagaccctgtctctacaaaaataaaataaaataaaataaaataaaataaccagccgggcatgatggtgtgtgcctgtagtcccagctactcgagaagctgaggtgggaggatcacttgagcccaggacttcaaggccgcaatgagctgtgatcacatcactgcactccagcatgagcaacagagagaccccatctctaacaacagaaaggtaaattagagcttacctgactttttttttttttttttttttgagacagcgtctcactctgttgcccaggttggagtgcagcggcgcgatctcggctcactgcaagctccgcttcccgggttcaggccattctcctgcctcagcctctctgagtagctgggactacaggcacccgccaccacgcccagctaattttttgtatttttagtagagacgggctttcaccgtggtctcgatctcctgacctcgtgatccgcccgcctcggcctcccaaagtgctgggattacaagcgtgagccactgcgaccggccttgactttttaaaatatttgataagtactcagtcagtcctggctcatggattggcctcacgggagccagaagcggatgctttaatagaccaacaccagaggtggcaattgctcccgcacggccactcgtgcccacggattctaagactccaccttccaagggaggggccttaaccccccagagcctcccagagtagggagggtccctccccaggtccagggacaagaccaggaagtgtcactgttttgttgcttattttaaggacacttttgattgacatcaaactcatagacagaaaaacacaaattgtaagtgagtgcgggctcaacaaatttccacaaagtgcatgaacaaaataaccagttccctgattactagggaaaaagaaccagcatagccatcatcgtgacattcccaggatcaggaggtgcacggtaggtggccttgtggtggaaacaggtttaattagagcccggggggaggcgtacagataatcctgttaaaatctgttattttatgtatgaggaggctgaatctcccaggacagtctgtggaacttgagagggtgaagacgaaaaggccggcccttagcgactctgattgagagagtctgggaaagaaaacccaagcctggtctttagacaaagcctctcagatgattcaggacatccaagagcaagcatccccaacagacggccacgtgaggaaagttgagaggacattcctcagaagctaaaggaccccaaaatgcttagagaaataagacaagctgtgggccactgccctgaggaacggccaccgccttgggaacagccactgccctagggaacggccactgtgggggatgatcgccaggggagaactggggagtgtgtttgtttcaccagcccagacaccttgctctgacggctgtcagcgccccaccaggcggcacaggacccgtgttccccggagcgaagggaaacgtgtggcacgtaattatgtatgtggtccacagagagggagacagggaggaggccaaagggggaccagcttcctcctggtgcaagtgctcacatcagctcacgtctggggggctctggggggtcaggggcaagcaagaatagagtccacggtctgtttcaccccaaaaactgatggggaggtggaccctatgaatgccctttaaacaaaggttgcccctcaaaatgggaacaagacaagtaatttttaaaggcacttaactcagtcctgagggctcactgtggagcatgggacagaggccaccacagcccagcgagttggtgggcggcaggcagagtgtggggtgttctgagaacccagatgagggcatgtggcccagtcttggggagcaagagtatcccaaaaatggtaaagcatatactggacagagattccccaggaaagagatggacagtacacttctgcagtccaggggcagaggaggctggcacgcccggccaacccaaagcagacccgtgtggcaacccgcgccactctggggagcaggggaggaaggtaggcaggtgacgtgggctggataaaggcaggacccaacgtgcagttgaggggcccccagggggcactgaacaggctcacgccagggaacttcacgctgagacacaactccaccactcagggacaacctctcaattctgatgtctcaattttctctccacaagcacaaaaacactcgcccatacagaagggttttatgagaatggccttgtattggcattgcgcagggtgctttagtgttttataacaatgctttgtgttagtgattgcgcagggtgctctagtgttttctaagatcttggccttgtgttagtgattgcgcaggctgctctagagttttatgagaacgccttgtgttagtgattgtgcagggtgctctagtgttttatgagaatgccttgtgttagtgattgtgcagggtgctctagtgttttataagatcttggcctcgtgttagtgattgcgcagggtgctctagtgttttatgagaacgacttgtgttagtgattgcgcagggtgctctagtgttttatgagaatgcctcgtgttagtgattgcgcagggtgctctagtgtgttatgagaatgcctcgtgttagtgattgcgcagggtgctctagtgtgttatgagaatgcctcgtgttagtgattgcgcagggtgctctagtgttttatgagaatgcctcgtgttagtgattgcgcagggtgctctagtgttttatgagaatgcctcgtgttagtgattgcgcagggtgccctagtgttttatgagaatgcctcgtgttactgattgcgcagggtgctctagtgttttatgagaatgcctcgtgttagtgattgcgcagggtgctctagtgtgttatgagaatgcctcgtgttagtgattgcgcagggtgctctagtgttttgagaatgccttgtgttagtgattgcacagggtgctctagtgttttatgagaacgacttgtgttagtgattgcgcagggtgctctagtgtgttatgagaatgcctcgtgttagtgattgcgcagggtgctctagtgttttatgagaacgacttgtgttagtgattgcgcagcgtgctctagtgttttatgagaatgcctcgtgttactgattgcgcagggtgctctagtgttttatgagaatgccttgtgttagtgattgcgcagggtgctctagtgttttatgagaatgccttgtgttagtgattgcgcagggtgctctagtgttttatgagaacgacttgtgttagtgattgcgcagggtgctctagtgttttatgagaatgcctcatgttagtgattgcgcagcgtgctctagtgttttatgagaatggctgtgtgttagtgattgcgcacggtgctctagtgttttatgagaatgccttgtgttagtgattgcgcagggtgctctagtgttttataagatcttggccttgtgttagtgattgcgcagggtgctctagtgttttatgagaacgacttgtgttagtgattgcgcagggtgctctagtgttttatgagaatgcctcgtgttagtgattgcgcagggtgctctagtgttttctaagatcttggccttgtgttagagatggcgcaggctgctgtagtgttttataagaatgtcttgtgttagagatggcgcaggctgctctagtgttttctaagatcttggccttgtgttagagatggcacaggctgctctttgacctgtcgcgtcaccgactcctttctatgcacatcagcgtagtacacacatcacccgagcggacaccttgctcttttctggattcaccatggcttagccagtgccctaccgaggccacgtctgaccttccagcgccttccctaactcaaaagatgacaagcaaccttgcatgcacatccctggcccttgtctggtcgctatttcttgtgcacattcctgagggggaaacagctgaacgggaggaacatttaaagactgaccagtctcccaatgccggaagtgagctgtgcagcatgctctccggtgacgaggcccctgtgggagggggaccttttgagatatgcagctgctcaccccggccccaggaagctctcttggggaacccggcactcagtgggaatcacaaagaggaatcgtctcaaggcggctctctcttctcccacggcccacctggcttccctacacagtgagcgccgtggctggcgcggcccgggcctcggactcacccgtgtgccgcttgcagtgcttgagcatgttgaccttctgcgcgaacctgcggtggcactccttgcactcgtactccttgatgcccttgtgcagcttcatgtggtggcgcagcgcgtgcttggtcttcatgccttcaaggacacagcgagtcagaggcggccacacccccacgcagcccacctgggggcccatgcccgagaccctggggcaggcacaggcagcggcccgtgcggtactggtgagggtgtgggccggcccccgaggatcccggtcagtccaccagcggtgagacctgggaagtgactgtgcccagaggccgggagggactgactgcaacatcaggttcactcactcctgccagggcctggccgagccctgaccacgcgagcaacgccggggcggtgggtaaacttccctgcgtgcccatggcaacccggcgggagaattcggtgagagatagattaatacaagcatgactaaaggttcccttcaaccttgacaatatgagtggtgattgggattcggacgcgagatggtttcaatctacctgtaatttaagaagccaatcttaagaagctgaaatactccaaagcctcactcacacagccagtggagagagggtggccctggcataggggctgagtcagaggttgtggtgcgctggcagggacagcactgtacaaggccctccgcagggggcacaggcatgtgcggcttggtacacctgaccgtgaggctgacacgcaccagggaacagggcgacccagcccaaaggcagcctccccagccccgaagaggcgccttcactgtgcctgcccagggcggtgggcagcctgcactcccaggccaccgtgttccctccacatttggggaagaactactgagcctgaacacagctctgtagtaagctggtcaacggttcccctgtgattccaccctcaccagatgcaggggtgaccatccaccagctcctgccagaattctaaaggccgggccagaagacctccctggctacgagaaaactgcgcggctgggccagcagggggagcaaaggccccacgatgaagcccgctgcctgcacacacagctgcacaactcctggcctcgggtggggacggcacctgcaggcctattaccaatgaccgaagagtgattccacctgaaaaagttactgtcaatccttttgattaaaaaaaaaaaaaagagtgccggtcactgctgacacgcccagaccccagcacttccctcttcctgcttctaaaatgaacatattccaaatttcaaaactaatacacagtcacagaaaacccagaaaatacagaagagatggcatctccacattctgacctccccaccacagccagcattggtgacagtaatgttttttcttccatttaacaaagaaaatctgccaacagtttcaaaataaacacaactgccagacagaggaaattttaaagcttgctctactgggattgtgagtcaatccatttacaaattaccgtggggaaaactgatgttttttaaatacttataatttctaatcccgaacaggggatgccttttttatagctttcaatacctggtgtcatattcttactggccacagtaagttcttgtagatcattcctgagtagttcaaggcccatgatgtgattctgaacaagacgttttcctccacacacacagaaaacctactggctgggcccctgcctccacctgctggtgacaggctctcacgactactaacagcctcccacttggtccctgacactgactaattcactggtcagggctagaatttctggaaaaaaatgtaaagtaataatatgcaacagtgtttcttgcaacactgtaataataaatgactataacaaaacaaccagaaactttataaaataaagggtctggttatatgaatcgtacgaagggcttgaaagataaaaccaggcaatatttacatgttccgatatagaaagatctccaagacgtattttcaagtaaaaaaaaaatagcaaagtatcaaaaaaacaaatgagcacaagcatgcgctggtatgtactagcaactgttgcgtgatagcacgatgacaatactggaatttggtattctgtaaaataaatctggcaactgatgtattaatgccagcattttatttcagctattcagaattcattttaaaaaacgatgcaactaaataattaatacatttcaaacactaaaatgtctacaacattataaaatgtggctttaccccacaccccttgcctcccagggcatctggtggcatttggggacctgcaggggacccaggtgtggctcctctctgcctgcctaagaggcccggccctgaataagcccccacccctgcccctcctgtctctacgcgctactcaggacccctccagccaggctcaccacactgtcttaaacattttacttcttgggggcattggggaggaaaggggaggagcaggtggtgaaaggggctgggagcttaaggcagacgcggataaagagcaagccagcctgtcccgctaaggcaggcagacactgctaccgacattctgttcagagaaaccacctgtcccgctaaggcaggcagacattgctactgacattccgttcagagaaaccaccgcagtggctctgcgaggaccggctggggtttgaggggagagtaactatgccaccttccagacctgtttgtattgtttaaaaaatatgtcttggcgaggtgcatgcgctgcttttttaataaccacccatgtgccgtccttgcgcaaagttaccctggaggaggggcaagagcctgtgctggcctctgaggtgaggaacagagggccaggaagtggggaaaggaaagaccccctttctggccttttctgcaggcagttcttttaggctttgacacgcagcgttattctacgggtgctcataggggtcacccggcgagtgcagttcatgcagctcctgtgtttccaacacactgtcaccgggacagcatgagcagggtcgcttgaaacagcccaagacaaacctgctgctccaaaacttttaggaagttgttttaaaaaaaaaataaaaacaggaatgggttaaaattatgatgtgtactggaattatctttgtattttgcttactaagttgagacatcttattactaggtttgttattaatgaatgttctgtcgttacaatgaagattcctcggccgtggtgagtttctctctcaccacgcagccgattctagtctgcgtagtgaatacgctgagggttttgcatctactgtcagaccccgtggtggctttgggaatcattctatactttaaacaattagatcctgcattattttcctacttttaaaacgatttgtttgtgcctttaaatttatcacatctttctgctttctggactacttgatttttcttgcagattcctgatttaaatgctgcctcgagtccttctttccttaagtaagcgactgaagcctatgggcttccagggccacactctggcaatgcctctcgcactatggtagataccttggtcacatccccttccagagccctgcagctgggcggcctggctgagcctggcccgtggcccccagcacccacacccacctttcccacactcccagttctcgctcacatcccctcccagcgccctgcagcagctgagcggcctggctgagcctggcccgtggccctggcgcctgtacccacctttcccacactcggcccgtggccccggcccccgcccccgccacacccaccttccccacactcccagttctcgctcatgtccccttccagcaccctgcagcagggtggcctggctgagcctggcccatgtccccagcacccgtacccacctttcccacactcggcacacaggtactcgcggacattgtcgtgcacacgcatgtgctccttcagcatgtccttcctggcaaaggacttcccacactgctcgcaggcgtggctcttcacacctgagaacacaggcatctgccactcagagccgagcagctccgacctgcagtggctgcaaagaggatgcaccaaggagaggggcccagcctccccagcagctagaagcgcagtaacaggggtggggtcgcctcttcagcggcctccacagagccctcccggggatcctgtgactccagtagatccctgaggacctggaggggtgagggggctgggggcgctgggctgtgagtggcagggctgataaggacgggaaaagctggagaaacagaggaaggcatgggggaggcaaggtgcgacggctctgtgtgtagaatacgcggagacccccagcatccctccctgccagccccctccagcgagggccgggaccccaaatgctgacagacacgcacctgtgtggatgagcttgtggcgctccaggttcccgatgctgttgaagatccgcccgcagatctcgcaggggtggatgtacctgaaaccagagacaagctcaggatggccgcacagcctcggggctccacggcagcgagggcactttccccagcaccttcatctgcaaaggtgaggcaacaaggtgccacggggatgataaaagaagcagatatttgagcctctgccacgggctcaatcgtaaccccccgaattcctacatcgaagtcttaaccccggcacttcacaatgtgactatgtttggagatggggtctttgcagaggtgattacatggaaaagaggccatcagggtggtccctgaccaatctgaccagtgtccttataagaagatgagattgggcacagacacgcacagtggaacggccctatgaggacacagggagaagacggcatttaagggccaaggagagaagtgtcagaggaggcggccctgccgccaccgtgacccctgagctcccgcctccaggactgaagatggtaagtgtctgttgtttaggctgtgccggctgtggttctttgttagcgcccctgcacgggactgtttagtcactcactcagcagaccgcgcagattatggcctgtatgtcagatgtggcctggcattaatgaaatctaattgttgcaggaaaaagcattttgggtcattctgtaggcagggcaggaaccccgctattttcctgtaacatggccagctggtgccaggagactatgcggaagcacaggataaaccccagccctgctgcccctagcccagctgcccccgagccctgctgcgcccccagctctggccctgagacccagaggacatcacttgttggaagctacaaatggctccttatagcatgtgtctctttgcaaggaagcatgtcccctctctcctgacacaacccgggagcccccgaccaggcctcacttctgcacgttggggtccggcaggttttcacggtggatgaccatgtgggcgtggtaggtggccttcagtgcaaagcgccggttgcagatgctgcagccatagcccttctccttgtgcacctccatgatgtgcttcaggtactccttcccccggccgaaggtgagctgcgggccaggtggacagggcactgctgacacccgcatgaggtccctggtcctcttagctaatgaggtcgtgtccacaaaccagggcacccgacacgccctgagagcccatgactcatgccagggtggaagggactctcagaggcttgatggggaacttttccgaagccataaggcctcatgcccaaaactcaagagcacgggtgtcctcggaaacaaaccaccctcctttttggagagccccttccatgcacaggggaggcctcgtgagggcttcaggcctcagcagggaggaggagggggaggagagaaggggaggggaaaaggggaggagagaggcgccccagcctgcagccagcacagccaccttctaggaggccgacccccacacttcatgtgtgttcctgaaccgtgtcacaaggcaagttcctggagggcgcctgtgagacccacacagaccgtccctgagcaccaaggtgacacaggctggccttcccaggcacaagtgatggacaggcacccagtctgcagtaggaccactggccggagcctttggggagggagggctgcttccgagatgcatgaaggtgcctgctgtgtggggcccacagccttgaaacgaccaccttcctctccagaccacccaggcaccgcggggcaaacccgccatacctggcaccgcttgcagctgtacttgtgaggctccgagtctgcgctctcgtcagaattgtcatcgttttcttccgaggagatcccgatcttgccgataaactcttccctctggtggtcatccatcaacgcgatgtcctggaaaacagccaccacttccggtttctaacagcgcagcagacgcttcactcagttatctacaccgcagggacgaccaatcatttccccagatgcagaagaaaatgcctctctgatgcccgtggcgccctaacgagctacacttgtgccctagcccatcccagcttgtccccagaggtccccacctaaacgctaaagctgcccttgctctccacgccgcccgcggcttcctctcacatgcgcccagcaagatcccaatctgtgcccagggccaggcactgctgggaagtccccctagtgagtctcccataccacctgttactttttcagttcttgatcagcgcttctcccagcctttatcacaccccaagtcctccctgctcccggggcttctgctccgttcctctctttcctcaaaggtggggagggacacagatgccagcaccgggctgagaagcagccacggtgggagagcagtacttcaagcctggcagttgggccacaggaggtgaggccaatgcagtcacagaattcattttggagagataaaatgcgaccagttgtcaactatttgaggacgctgctgtggtctgaatacttgaaccctcccaaattcccatgttgaatcctaactcaccaggaaatggtatcaggaagcagggcctctgggaggccattaggtcatgaggctggagccctcaagattgggatttggggtggggcatggtggctcacgcctgtaatcgcagcactttgggaggctgaggcaggcggatcacttgaggtcaggagttcaagaccagccgggccaacaaggtgaaaccctgtctctaccaaaaatacaaaaattagctggacattatggtggatgcttatagttccagctacttgggaggctgaggcgggagaatcacttgaacccaggaggtggaggatgcagtaagatcttgccattgtactccagcctgggcgacagaacgagactccgtctcaaaaaaaaaaaaaaaaaaagaatgggatttgggcccttatagaagagatccctacccttctaccatgtgaggacacagtgagaaggcgccgtctacgaaccaggaagtgagcctcgccagacaccgaatctatgggggctttggggtctagcctccagaaccgtgagcagcacatgtctgcccagaagctgccctgcccacagaactctgctatggctgactgtgacagacgctggcctgggggcctgccgtgagcatgcctgggtgagggcagcacgcgatcgacaccttgaagtggacatggatgtggtccctgagcacatccacgcggaagaacttgcgcccgcagatctcgcaggtgtacttcttgtcgccgtgggtgagcaggtgcttgttcatattgctccggcaggagaacacctgtggcagaggagccgcatggtgaggggctgcggcgtctcgtgacgggaaggagcctctccatcaggctcctctggggaaaccacaacccgggacggaaacacagcactgtgctccaggccttgcatctccagttcctcagtgtgtgagagacacaaataatcactgatgccggaataagggttacttgctgaattgtgtaaacaggtgcttacgttacaatagaaaattgaccatttcctagtctttattataaatgttagttcagctccatttttttaagcccatttaaatatttccctaggatggactaccaaggaaccagcaaaccacagaagtacctgcaattttctgaaaggagatatcaaaaaagaaagctagttacccccttggcttttatactgtgtttaatgcacattcccaatgtctctgatttcctgctctttccagcctggcatgatgggtgtggagatgcacccattcatccaatacgcatccaagggggtcacctctgtgaccagggctggggttggcgctgggtggtccacatgacagatgtggccccactggcacagagcagtggacaaggctggaagctgagaccactgctagggccctagaaaccccagcgctccacagaactctgcgggtctctatctggatggctattcccagcggccacgtaatccggggtgtgacctcctaaagttcgcctgatgcccacattgtcaagaagagaacagatgaatgaaaagaaatgagtgattcgctagggagaggatgccggcatctccaggcgacatctctttccaagatgtgcagatgacttgggctgacagcgctgtgccccatcccagggatgctaggtggggcaatgcgacagggtgaaaggtgagcaggagaggacagagtctgcagatgtcatggtctttacagggaagactgggctgaagacaactaataactggaaacaacaaagaattcagtcacccaaactacaggctatttcacacctgcctcaaccctcagtgtttattcaataaacactgcacagaataaaaacctgtttggatgtcaggcacagattgtttgcacaaacaatctctcaacagcatggaaggcacttggagccggtaccccccaaggggcagaggtcagtggacagaaagactggggacgggggataaggggcacaggcttcgcccacctctgccctgtgcatagctggcccagctcgcaaagtcactccaactcacctgctctaccccagccctgcccctccagcccacagtccggagcctcacctggacccccagccacacctccctgctcactcatttgctcaggcttgctctgtggtttgaaaaaaatcaggaaatttcatataaacactgagatttccattttctctttaaaaggtcaaaagctcggtgatggtgctgcatgctggaaggcaggacggcggggacggtgacagcgggcctcctgcgggggcctgtgctcccagctgctgaaacgctggatgagcgtcactccggggctcacgtgagctgtgtgtggctggggcaccctcccctcggcggctcctaaagccacttgagcgacgtgctggagctgctgggcccagagcccgcttgggagctgctcagaacccttactctgcagcatgagctttgcatcctgtgagggacagttcctaggcctccgaggacagatgacatcttacagtcacctgagtgaaagctaagtaacgaagaagtgatgccacctccagtcacaaccaaggtgcttctgcacagaacttggggccatggcagcctgacagctgtgaggaccacggcatggaccccaggctctcccgggacgcgcagcgtgtttgctggatgtttaggatccagcatctctgccaagcagccaggtgtctgaatcctgagctagtgccaggatggccccctcaccgtgcagccctcggatggatgtgctcccatggatgacatcaccctttcctctcttgggcagcgccgggcatccactgaacgtgcctgggagcacctgccatgggatcggccatgctctaacttacagaacgccagccatccactgcacggaggagaccggcactgacaggcaaaataaagccactgggtccccctgcgtcctcattcattgtgccccagtcctgaccacaaggtcactgtctcaacgatgctatacaggagagtgggagccagggagcagctcaggaggaaaatcatggcaaagaggaaaagaggctgtccaggaagaatccttctttctcagcccactcactggaaacccatcttaagtaccaaagaaatccaaatggcaagtgtttaaaatgggtggacaccagtttaagacaacctgagcacccatcgttaccccccaaatcttccctgcaatattctataagtacagctcatagagtcttaactgaagaaaatgatgtgctttccatctcagcgtccgacgtggactgcgagcattaccttgccacacaccgggcacccggaaggctccttcttgtaacggaccaggttctccccaccggcctccaggtcctctcgcttcactcgccgcactcctgaaattgccaaccccaccagcaagacagtgaatacacatagaacacgcgaaggtccatcagattccacttcagccagcatcctttccagcgcacgggaggacagggctgcccacagtggggacagaagcgtggcagtttaagtaacatcacttgcacactgtttggcatcagcactaaccaccattcctgaagcagccccagggaaggaagggagatggcacaacgtatgtgggatctgccgagacagttctcgcatctgaaacatttggaaatataatggcatcgagtgctaaatgttcctaggtggcagagctatgatgagctcctatggaagaaggcacttctaactccatctaaaggctcaaagccaagttatgattcttatagatagtgaaataggcaggcattttttatttaaaagatactaatattcatctctcgcaaattaacattagtcaaatcaacatcaggctggtaaatacaacctttatggttttgaggcatattgttccaaattgggatcaagacagacttttaaatgttcatgcaaaacaggtaagttttgaccaaaagagagaaacccacttctcaggatctctttctacactgccgacccattctgggagcattcctgcctggccaggtgtaagtgcagagttggatttaaaaatgctcagcaaactggacgttggacaaacggaccgttctccaaaggctcccagcatgacagacacaggagtctgaggcgcagcttagactaagctccagtatgagggacaaacccataaaacagtcacaaaaacatgagtttactcccacagaagacgacccgagttacattaaactgtaaaatgcaacccagctacactgtgtccctggaaacagctgacttctggcagcatccacagttactggcatttatgggcgcttgccatgtgcggggtcctgtgtgagaagtttcaagagcagggtctggtgcaaccatcacagcaatgctagggattcaggtctgagtactgtctcccctgcataggtgagaaaactgaggcacagtagcttgctaaggctacccagtcactaagtggagtccaggtttgattcgagaggccctaagtataccacccaaggaaccacaaagaaaaacgttgtcggtctttatgaatcaacatgaagaaaagagttgagcaaaaaaggaaagtgctaaaaggtacacaggatgcaattccagccttgtttttttaaaaaagggacgaaggcacatgcgtatgcctatttggacggacatggttatacttcattttttatttttgtatatattttttgagatagggtcttgctctggaaagcagtgatgcaagcacagctcactgcagcctcgacctcccagcctcaagcaatcctcctgcctcagcctcctgagtagctggcactacaagtatgtgccaccatgcccagctaattttttgtagaagcagagcctcgctatgttgcctgggctggtcccgaactgctggcctcaagcgatcctccagctgcagcctctcaaagtgctgggattccaggcgtgagccaccatgcccaggagggttctactttacacaggactttgtggtctcacatcttcttttcaacaagcatatgcttcatttgtaattataaaataattttttccaaattttaatgaaaaggtgtatgaagggctgctgctcttagttgctcttatactggtttttcccactttctgtcatattgaaagcatttttcacaatatctagtatctttgaaaaaacacttctaatgacagtgaaacactggaccccacaaatcgtccagttttcttagctccttccccagtgtggaacatttagggtatttccagctgtttctccttgcgcacagcaggtctgacacctgtgtctcagcaacttactctcctgagacaggttctcagaagaggatgagcccatcggatggcgggcgtttccaggcaaaggagcaggcggcaccgaactgctccccaaaggccctgctgactgctccatgccgccctgccccaccccgcaggagctgcctctccccgcccgcagcaggtgcgcaggcggcctcaccttccaggtgccggcgctggtggtccagcatgacgtccttgcggtagaacatcttgctgcagacctcacaggcaaacttcttgtcgccgtgcttcttcttgtgcttggagaggttgctgttggtggagaagaatctgaaacacatctcacattggaacgtcttgtcatctgtccagagagcaaacaaacacacaacgattttgaggtaaataacatctcacgcaggcacgcacgtgtggcctgaacgtcaataaagcgcgggtgacgggcatgagagtcacggggatgcgtggccaggaagaaaacagcacctgtgtgtcatacactgtctaccccaggaactcacgatgcagagacgggaaccccggtgcttgaaaagcagacacggagctcacctttcatcaccaagcaacgccagccgcctccctcccgggccaccctgccccacagcacctggggacgatgactccacttccgtcaggaaagctgcccagtccaaagcttcccctgggcctgcaccctccacccagcatgactgactgacagatagaatgacctacctaccaaccaaccaaccaaccacccgagcaactgaccacccgaccaatgtggccgcccctgcccccaggatccctggtgttggcccctcccaactccttccccgtgggcgggcatcaatgtgcccatattccccccttcacccaaatcctcctcagcacacacacaatcacacaccacacaaatacaaacacactcaacacacaccccccacacaaatacacaatcacacacaccacatacacacaccacgcacacatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacacataccacaaatacactcaacacacacaccacacacctcatattcaacacacaccacatacacacaaacacaccacagaaatactcaacacacacaccacacaaatactaaacacacaccacacaaatacatccacacaccacagaaacacacagccacacacagtccatgaagcttccagaaacacctatatccctgcatcccagacctcatctccagcccctcctggaaggtagccagtcaaactgtggtttcggctccgcccaggacactgacagccccccagtgccatctgtccctctgactctcacacaggcacctcgggggtcctcactgcccagtccctcaccctgcagcagcagccccaggtcccctcgccctgcccccatccatcagatgtctcaccagttgacggcgaccccggggcccagcagagctgcattctcctccctgtgtcgccaacgtgggaggacatgacagctgggtgacccaggagcggggcaccagagcagactgcacttctgggcccctgggctctcacccatggaccagctcccaggctcagtgtttgccaaatatacaaatccccaaaactgcactgaaagctgccatttgtgcaaagcagccgccctgcgcctgtccctctctgctgcccgagggagccgccacagagtgtctcagggtccccctgtctagggtttccctgcctcagcgttttgggccagatcctttgttgtgggccaccctgtgcaccgtgggatgctgagcagataccgggcttccacccagtaggtgccaggagcacccctccccaccaaggtgtctgcagacattgccgacagcgtcccttggggcaaacgccctccactctccacccccgccaggtagagattcactggccagggctcacaaaatgagactctctggggtgggccttgggcctccgcatgtgtctggcctcactcaggtgatcccaatgtgcagcccaggttgggggtgagggaagcagacaacctcccccgggagagccaggcgctctcaactcctcccagctgggaatggacaaggcatggccgacagcgaagacaggagacagcagtggggaaatctatgccccatgggtgccaccctcaggacaggggaagcgctgggaggggacagtcccctcccacagctccaaccacggcaggacagtgggaggtggcctctgccagggctgaacacagtagaggtggccctgtgcgaggcttctctgcccacatcccaccccacctgcagcgtgacctcagcccagagccagcctcacctgggccataagaggagcaccgtgacagatgctacgctgagtcccagcctaacatactgcttgccttccttctataaagtgaaacattatccatacagccactgccctcagtttcgttttggcttaagatttgatgggctctgtccggatccacacgaccgcatggtatgtgtccttcacacactgcgtctgaggcgtgcgtgtttacagtgctggacgttttcatgatcactttaatggctacgtgatattccatccagctcacttctcaaaactcactttgctatttttgacactgtagataatttagtgatggaatctttagtaatgcagatttttttcttctgtcaaatctctttatcatgaattcttaggaatgggaccactagagccaagcgctttgtgaaaggccacaccttacagcgctgtggcatcagattgccacaggccacaccttacagcactgtggcatcggatcaccacaggccacacctttacagcactgtggcatcagatcaccagaggccacaccttacagcgctgtggcatcggatcaccacaggccacaccttacagcactgtggcatcagatcaccacaggccacacctttacagtgctgtggcaacggatcaccataggccacacctttacagtgctgtggcattggattgccacactcccctcaacctgggcctcctgaacagcataggtgagcctccctcccagccaggcactaaagagcacaggtgagcctccctcccgggcaggtgctaaagagcacaggtgagcctccttcccaggcaggtaccaaccaatacaagtgagcccccctcccaggcaggtgcaaatcagcacccatgagcaccccctcctgggcaggtggctccactagtcctgccgccccgtggaaggcaatggtgctgccaagagcttcagctttctccctcacaagcccctcgtgaccatggaaagagaacctacttcaggccactccccagctgtcccggacaactctgccaagccgagggtggcttctcccgcagccacccactcactgccagttcaggaacccacaggggcactgggtcccaacaatgcttctccctccaataaccctgcgccgaggggatctaggtttatgtctgaataaatgagccactgagaacagctgcctactggggtctgacgaagggagaggggtgcagggcacctggggatggagaggggattattgggggaggctggtgggccgcattttgcctgagggcctggacgtgagcctttgctattccgtagcacagtacttatggtcagacacagcacaaggaacacgaagatgagttacaccagcacctggtcacaccacaagggacaggcaccacaacaggtcccatggagggagcttcagaaaaacccacaagactgtaacattttaaaactgccccccacacccctctccagggtgtgctatgagtcctcgagagagggtgacacaaaggcaacagtgacccatccctctgtgccccgctggggacccccactgcttgggcctccagtgccacccaccactgggaatggggaaggcgtgactcccacattcttggtttaattcttggtacaaattcttggtttaattgtctaaggaagatacacattctcttaacttcaatactataaataagtataagagcatgcaaatcatatattatgcaaacaagctccatttcaaggtttttatcctttctgttcagtctaaaacgggtaacctttgaaactagaacatctcaggggaagaggtggtgcgatgcaggtccctggcgctctgcgggttctaggtgactaacaaaggccagcacctggcctaacagcacctctggctgacaggaagctgctgctgccttagccgcttctagtactttgttttatttgggtccagagaaatagttgaaaatatcagagggcaatgcctcttcctcaaccttgagtctgcctcaccagagcgccttagctggtagcatcactcttgggaaccccgaaaccctcgcctgctacactcctgcaggactgcggggaccccaaggggaggttcgcaaacaagatgaaggttcatctgtctggccggggctgcgttaagtggaagtcttcaggggactgtgccccaggtttcttgggaattcttgtgataggagggcttaaaatgcaggaggtgcggcacactggaaattcatccagaagcttctggaggccacctcatgccagacatggatccttcagagctgctaaagcttaggcaaaacatgactcattcctgcccctcagaacagtccaaccccaggaagaaggcatcagggaggaagaaccaaaccctggtttcaaataggagccctcagagtagaactagccaaccccaccaagggccccccgcgcccagcagctacggcaagggagcagggcctctcacatggcccatgtgcgacagccctggtcagagcccctgggagtccgctgctgcaggtgccctgttctcaacacaggggcgggtggcaccttaacaagaacaacacagagatgcaagtgacagacacagagcaggcggacaaggacggggtgggcgtcgaaggctaacctggtaggtctctaagccgactgccgccgggccccccctctccagggtgtgctatgagtcctagagagagggggacacaaaggcaacagtgactcacccctctgtgccccgctggggacccccactgcttgggcctccagtgccacccaccactgggaatggggaaggtgtgactcccacatcccagagggtgcacgtcatcactgcagaatacaggggcgtcctcgggccacgtggagaagcgcagccggcaggacggccttggctttcctttggtctgtttacttgccagcagcaaattcggccagagagacaggggcctcagacgccccccaggcccgaagaggccacctctccactacaggctggtccaggcacacccggcttcaggcctcacacaaggaaaatgctttatttttggaagctggtgcacacaagcaggctcagaacaaaaagaatgcgtgcaggggcaaccccgttccaccctggacgccgcaggagatgtggatggaggagggctcgcggttaggaacaacctttgcaagcaagcgaggagcgctcacactcctccagccattatcctgatcttttcctttcttcctcagacggccctagaaaacattggacactgctgctccctgtttttagccagaacggaccccggctttacaatgctctcagtgtggggccatacgcagctcggctgacaaatgcaggaagaaaatcaatccctttttactggaaagtttccatctgtgtatctttagggtaacaactgctttgaagcaaaatggacagagggaaatgttaaaagtgaggctgtctattcatgaaaacaatctttactttggcctaaagttccacggtctccgcggcgtatctagaatccgtaccgcacagcggccgaggggagacgtgaccggcgccctcacctgtcctgcagttgtggaactccagcgcgctctcgatgcggaaggtcttctcacaagtgccgcagcggtacctgtactcgccgtccacctggtcagagggacacgccgtgagtgagatggcccagcgcagagtccacagatgccgagcccccgacgtgctgcccgggcgactccacgcctgtgtctgttatgactctgacctccaccaccctcccgctctatttaggaacacaaaggatgtttgctcttgctgttcacctgccctagaaagggaactccacactcagggagccccactccaagcaccaaacacccccattctcctgactcttcctgctgcgcttgtgggcatctgaccaggacgaggggctgacaggtggcccagggacgccaggacacccacagccttcacccgctctcatccctcctgggactctcccttctcagggacacctgggcacccacagccctcgcccactctcctccctcccccacagggtttggccgctctcctccctcccccacagcccccgcccactctcctccctcccccacagcccccgcccactctcctccctcctgggattctttcttctcattacaacatggtgatttggtcagttgtctgtgttgtccacacaactgggaagagaaccctgggcttgtttccacccacctcgttcctgctgtgcttgtaggaaacgtgctgctttaggctctctttgcggctgaacaattttgcacactcttcgcacttaaacagcttgtcacctgaggaaccaaccaacagagagctcattcactacttagagcatttaccgagagaagcatgcccaccggggaaatgccccacaagccgcctcgctcccaccatgcgaaggagctgcagagatgatcgcccacaaatgcagcctctcactggcgcagctcgtgggagacgacccaaggaggggagactccgtgctgtcctcccacccccagccccagtcctggccctggccccgggcgccagccgggcctcgcggactcaccatgcgagcgcacgtgcctgctcaggttgctgctgttctggaagatcttgctgcagatattgcactggtaaacccgcttgtgctccccgagctgtttgatgagcttgcgccggatgccgtgtctgcttgagagaattaagctcctcttgagcgtgatggtgttattctgatgatgggtgaacctgcccagggacgtcaataagttgggaaaagacaggtgggaaaaaagttccaggttacaagcagcatgaaaacggcctccttccaaaacttcccagctaatcccgagcctgtatgcgagaaaggagggaatgcgcccgggcgtcactcccagcttccagggcatctgaaagggacaccttgaatatataatgacattaggcagctttagctgcaacagccacacacctgactctgttctaactctggccaccagaaagcctggaggtcaatttgtgcctcaattagaataaccacacctgttttctgctcctgtcactctgtcttaactcttctctgttttacatattatctgaacctgattttcaaaacttcttttccctgttaaatgtatttttgatggtaagccacctgaactcttctgggcaataagataaagtataaataaataaacaggtaacatcatttctgatattacttttgccaactataagaggtgatccgaaaagggccaaaaagaagtgaccaccaacttactcaactccatggtaaaaatgacccaagaatcgtaactaaaacacagggcaagctgttatatttactgaaattcaaatagcaaagtattttaccacagcagcgtcacgaaagctagaagcaacccaactgtccatcaatggatgcatggaaacacaaaatatggggcatatgcatgatggtatattactcagtgttgaaggaaattctgacacaggctacacatggatgagccggggtagaataagccagtcacataaggacaaatcctgtctgattccacttataagacatctctagagtcatcaaatccacagagacagaaagtagaatggtgggtgccaggggctgggggagggggctggagcgggtgcttagtgcggacagcgtttcagcttgggaagacgggaaagttccacagatggatgggggagatgattgcccaacagtgtgaacatcctgaatgccactaaattgtgcacttaaacatggttaaaatggttaaatttatgcatatttaaccaaaataaagcatttttctaaagctgttttcacagtggatgcaccattaaactcctgagctccagaacattcctgagctccagaacattcctgctgcctcctcagcaggtctgtttccatctccttccctggggctttcctgctgggaaggtgccttccctccagaatggcctggctgctgccagcattgtctgtccacaggacggccccaggtgccaggcaggacttactttggaaccgagctggtgtcagtggtggtggtggccagcttccccagaaccagctccatgatccgctcatctggcgttgcactcacaggctcatccggagggacctcggtaatgatctctgccacttgctctgtacgaaggggatgtgacaagctaagtaaccacaagagcaggggacaaacacagtcaaaccatggtgacacactgccccatgggaaccacagccaggccagaatggtaggcacaaatgttgaggtttacagaggggaaaaaaaaaactgtcaatattttgggatccacacatttactagtacaaacagaaaagcaaaatgtttttcttagcctaaactgaagttataatttgttattctttttaaaaaccacaacatcataacattacttcaatccctcttcataccaaccaaaaacattttggatatatagcagaaacttcgaacttactacatcaattctgacagagttttagaaatgttaatgtttctaattaaatgtgccaacattagtaaaaccattttagctaaccattttgtataagagttaaagatcacatcatcgccaatactggagaccctggccagaaacccaagataaatgaaataggggaagattacacaaaaaaattcaaccactggtttctaccactttgcctactaaatgtcttctcaacacaagtaagaattagtgaaatatctacctgacacgctttcccccgcccccatcttctctgcctattcacagagacctggggaaactggccagggggctttcaggcgctcctaaatcagcgcccaacagtgcacagcctagaagctgcagacccacagcagaaaaggggaggctcagaatattccacaatggctgctcttcccaattgtctctaattaatagaagcaataaggactccttttcactctcataaaagaaatcctggtgtatcccagacagtaaaaagaaaaactgcccagtgtcagtaacaaatgtgaaggggccagtggctgagcatcagatctcatcctcactgtgaggcccacgaggcgtgtgctgcaggtggcttggatgggggctgtgtgaggaccacagggacaagagccttacagagaccacacaccctggaagagggtcaaatgcctcttcaaacccaactgaggatactgcacaatcaaaggatgagccctagacaggtcctgggagcaactcagtgcccacccacaggtgatggaccaagcactgttcagcaatccaggagaaggagccacagataaaccacgtgggcgggtctcgaggctgtaagctgcctgaaggaggcagacagagtccattcgtgagaaattccaggatgggtggaatgaactcgtacagaagacagtcaggaaagtggctaacgagacagaaatgtcctctaccctgacgggggtgctggtttcacagctgtatccatttgtcaaaattcacaccctgtatcctttttagtgtgacatgtattacatggaaattgtactttactagagttgattgagagaaaaacagacgggcttagagtctaccttccacgaggcctttctacactgagttttcccgccccgccctctgccccctgccccgccagccctcgggcgccaggagggctgcgccccacgcaggcactcatccccgggacccgctcatcacctgtgggttccttgtcttccacgatgactagaggctgctcagctttggacactttgggttttctcccccttcgaggctttttcttctgttctttggtggcaacattctcgctctcgggcactgcagggggttccccccggggtgtgtcctgctccttctcgggagctgctgcctcgctttggctgcctggaggaaggcttttggcttgttctaagtggcccaacagatgttctgcaaagagagacgcgaatgcaccacacaattaggaagcctgccaccgtccacacccaccctggcctctggttcctatgtgtgtgtgttttcaatcttgtttgccaacctttgtataggcaagtgaactttatttctactgttttatttcctctgcatcaaacacaactgctattttgaaaagtaaattaagtggtaaaagcaagggtaggttcaccatgagggcagtttagtgaaaaaagcagacatacacacacacatatgtctgcaaagcaaaaacctgagaaggagatatcaaaatatgaatgtgtccaggcacagtggctcatgcctgtaatcccagcactttgggaggctgaggcaggtggatcacatgaggtcaggagttcaagaccagcctggcaaacatggtgaaaacccatctctaataaaaatacaaaaagttagccgggtgtggtggtgtgtgcctgtagtcccagccactggggaggctgaggcagaagaactgcttgaacccgggaggcggagcttgcagtgaactgagatagcaccactgcactccaaccaggtgacagagcaagactgtctcaaaaaaaaaaaaaaaaaaaagaattgcaccctagacctgtgaaagctctgggagacgtagcagaagcaaaatcaaaacactatgtaacaatccagagtgcatggaaggaccactgtaggggcaggggagaaaagaagattccttgctaaagagcttaccaaaacaacaacaacaaaagcaagaaaagtcccaagaaaactaaaaaattaagcaataagccatcagggcgtcagcagacacatacacacaaactcaagaagaatggaattcctagataataacacaagctgagaggagaaaactgggggaaaatacatttaaatgaataaagaagggttaaaaaacacatattaaaaaaaagcaagggcatgctgaattataacaagcggttatgaaaaataaccaaataaaacttatataaaataaaaaggaggcccaaaataaaaacacaatgtgtcgtattaaacaaaaaattagacacaactgaagagagaactcataaagtaaaatgaagagctgcaaagattacccagaatgtagaaaagagacaaggagctagaaaaatatgagcaggagctaagaagacatgaagtgtaatataacaagaaggtctaaaacatgtacaataggacacagagaaaatagggaaggagggctaaacaatgagcaagataagggtgggggattatccagaatgaatgaaagacatgactcttcagattcaagatctgtaacagggaaaacaaataaaaataaagacataaatgatgactctgttataaattgcagaattccaaagacagaggaggtttcaaaagcaaccaagtacaaagcagtgattacctatgaaggaacaactgcagtgacagcagacttaccaagaataataatggaaggcataaagtagcataacaacatccccaatgtgcagaaagagaataagaataaacccaaaattcaatatccggtgaaaaccgtttccagtgcagatggttaaagaaagatattttgagacaaagactgaaaagattgccccagaggaaattctgaaaggcaataagagtgattttagattgagggtcagaaatataaaacaaagggaactaaagttaaaaaaaaaagaaaagccatacataaggaaattagcaaacatcattctagacaattacaaattcaaacaggaaaaacagagcaaattagaaaatacttagaactaaaatatgggaggaagagagcccacacatcaaagagatgtatatatactctacttgttagatgcggcattgtaaatatacttattaaatcaattgtgttaactgtgtgcttcaaatctgtatccctgtgattttttagtctgatttataaattaagatgtatgtattaaaagctcccactacagaggcagatttttctatttctcctcgtagatctgccaatttttgcttattattagactatgttattaagtgcatataaactcagatgcactgtatcatcaaaatgtggaatgcagctaacatggttcttaagaaaaaatcatctgaaatgcttacatgagaaaataaaacagctggaaagtaatgagttaagcatccaacttgttagaaaggcacagaatgaaaagtataaaaagcaaataataaataagagcagaaataaagtaaatatacaataaaaaggatcaacaaagccaaaagtgggtgctttgaaaagactaatgatattgataagtctggcaagaaaaaatagagaatgcagaaataaccagtcctagctgcaaaagagaaaacagcagctctctgtaaccactcgtccccacctattatcacctttccattttttagtattagatagcatctattatttaacatggaggagaaggatttagctttcttatagactatactctccctcccaaatgcttatcttctccacaatctcaccaacatatttatatcactattttggggtaaatcaataatcagtgtattcataattatgaccataaaaatgtattcacaactgcaccaatatatgtttatgattctttttttgtttgtttgtttttgagacggagtctcgctctgttgccaggctggagtgcagtgtgcgatctcggctcactataacctccgcctcccaggttcaagcgattctcctgccccagcctcctgagtagctgggactacaagcgtgcaccaccgtgcccagctaatttttgtatttttagtagagacagggtttcaccatgttggccaggatggtcttgatctcttgacctcgtgatctgcctgcctcggcctcccaaagtgttgggattacagccatgagccactacgcctggccttttttttttttttgagacggagtctcactctgtcgcccaggatggagtgcagtggtgcaatctcggctcactacaacccttgcttcccaggttcaagacattctcctgtctcagcctcccaggtatctgggactacaggcatgcaccaccacacctggctaatttttgtatttttagtagagatgcggtttcaccataatggccaggctggtctcaaactcctgacctcaggtgatccacctgcctcagcctcccaaagtgctgccattacaggtgtgagccaccgtgtctggcctgatttttttgtttttttgtttgtttttttgtttgtttgtttgttttaagtatatctataacctttgttttctctggagttaattaatgccttactttttattaataacatttgcttatttttttcccgtgtttatattactaattgagacttaaactctgccagaagtataactctttcctctacaaacacatcagttaatgctcgatttcttttcctttttgggccattcttcctggagcccttgctgctgctccaatctggaccagttatctatccttgaactagggaacgtctcttgtcctacaatctccttcgacagcaacctgggcattccctttgctcctttccctcaaaggatcctctattgtatcctacacgcagaggacatgtgccatcttttctggccatccagcactgtgaaacatccttgtgatgtttcgccaacttctgagccccacctttcccaaaacactcctttcccaaactctcctgccctgaatgcaggtttgtgccatagctctgtgagcaatgtgaggctgcagggggcctgagaacacattttctggcatggtgaaggcattgggctttcagagacagcacaagtttggccctgaggccaccgtcagtatgggtggcaatgtccctgccatgtgggcctgtctgggacagccttgttatggaatcctgagcaacagagcaagaccctgtctgtacaattagacctgttgacattcacctgtagttccagctacttgggaggtcaaaatgagaggatcatttgagcccatgagtttgaggctgcaatgagctaagatcacaccatcgcattcctgcctgggtgacagggcaagaccttgtattgtaaaaaaaaaaaaaaaaaaaaagaaagaaagaaagtttaaattcagagcactggtggtttggtttggaagttacccaacttgaaagaagaagcaaaaatctgtcaaatttgattctaaaactacaaaacctcttcaatagcccttccaacacttcctacaccaactcacaaaaggcagcttcacatcccttgagatcagagaggaaatgagacaaatggacaccgtttgcctcattagaacagcagcactgaaagagccaagtgaagtcccttctctgaaggcttgtgcagaacccgtctgtcatgtggctctgggacagcgctcagtgccagtccgctgaggatatccaaagtggcatgtggcacctccgccctcaagagaacacacaacccctcagcccaaaaaagagaaacacagtccctcctatctcagggaggtgacacagcccctcccccctcacagggacacacacacacacacacacacacacacacacacacacacacacagagcccctcccccctcacagggacacacacacagtccctcccccctcacagggacacacacagcccctcccccctcacagggacacacacacacacacacacacacacacacagcccctcccccctcacagggacacatacagcccctccccctcacagggacacacagcccctcccccctcacagagacacacatacacagtccctcccccctcacagggacacacacagcccctcctccatcacagggacacacacacacacacacacacacacacacacagagtcccttccccctcacagggacacacacagtccctcccccctcacagggacacacacagtccctcccccctcacagggacacacacagcccctcccccctcacagggacacacagcccctccccctcacaaggacacacacagcccctccccctcacagggacacacacagcctctccccccacacagggacacacagcccctcccccctcacagggacacacacagcccctcccccctcacagggacacacagcccctcccccctcacagggacacacacagcccctcccccctcgcagggacacacagcccctccccctcacagggacacacagcccctcccccctcacagggacacacacacacagcccctcccccctcacagggacacacacacacagcccctccccccctcacagggacacacacagcccctcccccctcacagggacacacagcccctcccccctcacagggacacacagcccctcccccctcacagggacacacacagcccctcccccctcgcagggacacacagcccctccccctcacagggacacacagcccctccccctcacagggacacacagcccctccccgttcacaggccggcctttggggctgctcctcagtctccttcctgggctctgctttccacttctaggctcctgagccatggatgttcccaagaagccccccagcgagaggctgccgcagaaggcagagccgtcacctggaaggaatgctcaggacccctccggtaatctgggtggcagaggccgggctgcccgagtacctggctccagccctcaaggctgccgtgctgtgggcagggactcctgcctctgtttactcatccctgaaatggagccacggttgtacctcatggtgttgactcaaggaagtttctggaggacctggcactgaagggtcttagtcaccatcagcctaattgtaaggggagcccgagtaccacgtcttacgtagttgatgacatacaagtagaatttcactgaaaatatgaaggaatttcttttttcttcactcaaaactagttattaagaagaaacacaaatgagcagcaacgtctgtctggctttgtggaggggaccacctggcgcaagcagcaccctcccactgtgaagcacctaccatgggtctccatgaggtccggggcgtgctctgcacaaacgcggcgtttctagaaaacccagctgccctgctctgctatttatgtcttggtgacaaacacaaaatacttctcaccaagcagagggcgaaatgacacattcgtaaattcattaaagccaagatgagtaggatgtctcaggaacgtgtgaccaggtagctaaagtctgctggtgtcagcacagtggctgtcccagtcactcctcacaactgcactgcctggaaccccaccaggcctggggcctctgagcacgttccacatgtgacgaatgccacaaactgtttctacgtgattcccccatggtttatttgatgcgagtctttcttcactacagattagcctcctaagacttgtggaaaaatcagctccctaagagaaataaacagaaagttcccagagcactgcagaagctggaaatgtgttcaattctctcccggccaccttaaattggaatctcaacctgagtagataaaaatgttctgcaggctgggcacggtggctcacgcctgtaaacccagtactttgggaggccgaggcagacggaccgcttgagcccagcagtctgagccagcctgggtgaaaccctgtctctacaataaatatacagaagtttgctgggcgtggtggcacatgtctgtggtcccagctactcaggaggctgaggtgggaggatcgcttgagcctgtcaggtcaaggctgcagtgagccacgatcatgccactgcactccagcctggacaacagagccagaccttgtctcaaaaaaagaaaacagtgtctgtcagataaagaaacaatggaaggggctgtcaagtagagacaacaaaggcaagagtgcacaacacatgccacggctggctcctggcccctggcccctgccagtgctccagagtcaaggcgcccagctgaaatgcaacttcccaaccaggaggagtgaggagtgaggcctgcaggggtcgggggtgggaagcgggactgcccagaagctttaaaccctgagaaagccttggttctggcgactacattgtggggcaatggggcagacaggacaaagtctgggacatcccgacagccgcagacaggtgacagcgtaagtcagagagaaatcgacacaggagttttacaactggggctccccacacgtcctccttaccattgaggagctgcagctccaggaaggtggcagaacacactttacacgcccactggctgggctccgactccacgggggcgctgttttctggggtgcctgcagcttcaaaagacatgagaggagaaaaaggtgacccccaagcagctcatatgtctccatgaatcccggcgcagcggaggaggggtgtgtgctgagaggcggtgatgacagtgatgacggcagcagacgggcctgtggtcactccacatgacagacaccattttcagagctttacacacatggctgatacggtcgtgtgactgtccccttttcacagatgaggcaactgagcacagagacacgcctgctgcagggtcaccagtcacagagctgagaactcctccaagaagccagtccagagggaccaggctcatcccttatatgacttcatgagaaaagtgcattcctcaagaaccaagtgtaattcctcatctctcactggctcatagaataagagacagtggaaccccaaacggccagccagtggcgcccccgtgtgtggctgggctgctgctcccgcccagcgctatccggcagagctttctgtggatgactgacgtgctccacagctggtatccagcaaggcagccactaaccagatgtggctcatgttccaggaaataagtgtttaattttactaagtttgaacttaattttaaataggcacctgaggtagggggccgctatcccaggaagcacctctatccctcagtccatgccacacaggaatctggggagggagagctaagctgggggtacatggcatgcggtgtaagcctggctataaagagaactacaggcaccttttaacaaaaaagtcactgatgctcttgtgcaacctacaattgggaggcgttttaagtgagtgtaccatgatctggcccaggccagtttctctacacctcgtctggcagctctgggggctggcccagggcaggacccctgcccatcacttcgactctaatcacgatacagcctgcattgaagttcatcacccacggcaaactccaggggccactcacaaagacaaactcctgggtctttaaaaaaataatccagaagtacaactgcatatgcattcagcactagaaaaaaacatgtatcttttcatatccaaaaccagcactaaggatgcaatgaatgaaggaaaaagatataggttactgctatcaccctgtgcatgcatgttctgagttttcataagataacaagaagaaagaggcataaatgcaatatgaaattttttgtcatactaaaaataaagaaagagcagaaaacggtgtggggggcaccctgccagcagggcatttttctgggacaccccatccccaccagcttctgttcccttttacgcttgctctctgagaatccgctgcttgaagaatcccaaaagatcaaggacaaatggaaatcagagccaaattcccatttcccactcaccttcccaaacatacacgggttccaaagagagaaaaacactcgcatgtgagtttcagaaaaagaggacaagggcccaggttagctggaagccaccacttctgaataaggggaatttcttcgaatccacgtgggccattgtctccagcaataagcctccacacccccacaagtgtgggttctcctcaacttggcgctctgctgctaggtaaagaggactagaaaaacttgtcatgacgactgcccgctcatcaagagaagcactcagggttttccgaatagtaattgtaaaagataagaattcttaagaagaaaatattagttaacagtcagaaggcaattcttgactgccaatcacttaaatatccaacaaaagagaagtgtcccagcaaaatctaacatcatacagctttaaagtgatgccagagatagtaacagtaggaaaaaggcctaagatgtggtgagccagactgtgcacacaaagaaaagtaagcagtaagatgggaggtgcagctagagctccgctatgcaaaaatgcagagtttaaaacaaacaaacaaaaaaggaacagcaaagctacagcacagcaaacagcctggcattccagtgggcgcggctgactgcagggccgcacgagagaacttcctgggatgaagtcgaggtctgtaactcagctgtggtggtgcttatacaactgtagacactcaaaagtctctaaactggcgggaacactggctcatgcctgtaatcccagcgctttgggaggcccagatgggtggattacctgaggccaggagctcaagaccagcctgggcaacatagcaaaacgccgtctctactaaaaaatgcacaaattagccaggcgtggtggcatgcgcctgtaattacagctcttgagaggctgaggcatgagaattgctcgaactcgggaggtggaggttgcagtgagccaagatcacaccactgcactccagcctgggcgacagactgacttaaaaaaaaaaaaaagtctctgaactgtacacttaaaattgttgagtcttactgaatgtaaactatatgtcatcagtgctggtttttaaaatacaggggccagtgaggtggctcatgcctgtaatcccagcactttgggaggttgaggcaggtgaatcacttcaagtcaggagttcaacaccagcctggccaacatggcaaaaccccatctctactaaaaataaaaaaattagctgggcatgatggtacatgcctgtaatcccagctactggggaggctgaggcaagagaattgcttgaaccgggaggtagaggttgcagtgagctgagattgggccaccacattccagcctgggtgacacagcaagactctgtctcaaaaaaataaaatgaaattaaaataaaaaatactagaaaatgcgaatcaaatggcaacagcagttgagttagaacagtgatgctatatgtgactgaacagtttccccaatgttataaaatgtgtttgtattttactcttttcaccagaaaggtgattttgaaaattttctcgttggaacccatgtgtgtttgagaaggtgagtgagaaatgggactctggctctgatttccattcgtccacgatcttgtgggattcttcaagcagcggattctcagagcgagactaaaagggaacagaagctggtggggacgggatgtcccataacaacgccctgctggcatggtgcccccccacactttcctcctggtgcccccccaacactctcctcctgggcctcatgctctctcccatgaagatccaggatgtttcttcggctgccccctccatctgtcagcaggttcaggttcttgtaaagaaacaaaatcaatcttaatgtgagctcaagaacaagttaaggccaggcacagtgcttcacgcctggaatcccagcacttcggaaggtgggaggattgcccgaatccatgagttcaagaccagcctaggcaacacagtgagacccatctctactaaaaataaaaattaaaaaaattagctgggtgtggtggcacatccctgtggtcccagctactagggaggctgaggtgggaggatcacttgagcccacgagggcggctgcagtgagccacgatcatgccactgcactccagcctgggcaacagtgccagaccctatctcaaaaaactacaaaaaaagaaaaagatggaactagaaaagtaaaatccactaccagaaaaaaataataagttacttttaaagggatgtgttactgctccttcagtacaaaaccaaagttttctctgtatttagaagacggcgccactgatctgcaaaactgactgatttctacacgaagatgcatgtttggagcaaatcaaagagacagaattaagtcactgagtcttaggatctctcacgctcaccaggaaagactcggccaccacaataagtaatttacaggaagacggttcctgggttcgtcggctgccaatacggttctaggagcacaccaatggccccggaggccactcacatcactctgcctactcccactgggccagaggtacaacaatgcacaaaaggcctccttttctcccaccatgcagcagcgttctctctgggagtgtccaccccagagggcacgtcactgagcaggagtgggattacgcagttaccctagaactccagtccttcacgtatccagtctgaacagtgagaactgggcaagcggccagctttctggatgtttctagcctctcttcgaaggtcttgttatctatcgagatactcatttctgagacgcaggcagcgttgggctccagtgcatagcttcagctgggtgaggtgctcgacacacactcagactctggtgggccctgggtgcattgggcgggcagggctctagaagcgccactgtgcctcgagagggacccctggcagggtcagggaggaggggctcaggggaaggagccagataggtggcagagggtgagaggcagtgtgtgtgtggcgggggcgctgacgcggctgcagagggtgacaggcagcgtgtgtgtgaggagcaggtgttgacgcggctgctggcttgccatttgaacaatcagcaggtggaccccagggaaagttccccagggcagccggcagcacttcaagggccaagccagagctcaacagggggctctctcgggaaggaaagggaaggaaggacccaaccagccagtgagtggaatcgccatgttcactacctctccagaaataactgcttgccatttgtccccaaacacaagtgaccatcctaaaaagcatttctgaaatctaagagtaactaagttgtttatttatttccccaattaaaaaccttgtttaggtttaagctatgctcaggtgaccatacgttcccatttacacagactgtcctggtagaattattacaagtgtccttttattctgagaggttttagggaggaatgggaattaccctaggatctccgaaatcagaggcgactctgttcgacaccacagtcccaggctgacttcatttaaatctattgtttcaaactcagctccagattgaagggtctccagcaggtaaaatgaatacgaaacacctgtagctccaataaggcgtggcaacctttgctttgaccttagccttgagggtggtgagggcatcccccaggatacaagctgacaagggggtaaacggccaaggccggcatctcagaacccaaaccccggcgtggctgcagtctgggctggccgtgggcacacgtgctgccagctgcctaggccttcaggaattccagacacaaggagcccaggtcccgaagatcacagttacttgggctctgctcagagagcccagcctcgcaggacttggaaacggcccctgacccagcaggcaccaccacaggggcctcccttgtgctgggccaggccaggcacctggttttggcaaagccacgagggtggggctaggagcagctgggtgaagagcagtgggtttctccaagttctttttgtccttttcattcttaaacatctccccacaaagccacagtctttctctgcgaagggtgcgaagcccccagtacactcagctcactttaccaacctggccgaagaggacgccgccaccgctgcaggccccagagggagccgcctggctcctcaccaaccctccccagcagcatccccagcggcccctctccacccagccctcacatggcccatagtgggttcaatagtggctccccaaaattcacatccacctaccacctttgggagaggatgtgtgcagatgtcatcaagttaaggtgaggtcatgctggattggggaggcctgaatccaatgacgggtggtcttatgaagagatgacacagagacatgggagagaagacaggcagagactggagtaacacagccataagccaagggacacaaaaggctactgtgccagccaccaccagaggttggggagagtcccgggacagattctccctcagggtgcccagaagggaccagccctgctgacaccctgaccgtgggcgtgtggcctccagcactgcgggaggcacatttctgacgtgaaggcactgggttgctggtgttttatgggggcagcgcagcgccgggacactcccacacagcccattgtggacctgggattagggacaaccaggggcattttacaaagcctcaatcatactgacaaacaggacagaccagaaccttccaataagttaagaatcttaagctaccgagctactaatattttggattacactgcatttataaaacaaggaaacaatgctcgtatgagaatcaggtcatttgggaggggggtcaggagagtcaatatctatttcgcccccttgagcaaagaatcttcatggcaacattaaataacatttgctcccctgggtagtgtcagcttcggcaatatgaaattgctgttttgcaggtcaaaagacatcaaataccaggaatttcatagagtttcttcaggttttatgaggaggatctatgtcaaaaagacccataacatggatgagaaagatttaaaattcagcagccccgcttgatgggcaaagtgatgccctgaccccggcttagcaggacaggcactgtgacccgctttttcagcaggaatgctagatttgggcagatcacgcacataaccttcactagggctttctttgaacacgcatgcacacacacacaggtatgcacacgcgcgcacacacacactgcccccaaatctgggaggaggccattgcacggtgagcagcaacactggagccgggtgccatggaccaatcctgatttcttcatctactccactgtgacctggggtcagttccttaacctctctgtgctgtttcctccgtccaaagacagggctagtaccccagcctcataggattaggaggatgggtcactcactgcacgtagcccccagggcagagctaagcagtcatgcgccatgtgacaaggtttcagtcaaagacagtggtcccatgagattctaatacagtatttttcctctattactttgtctatgtttacatagacaaatactgaccatgtgttacagttgcccacagcatgcagtacagtcacatgctggacaggctggtagctagaacaggctacaccatacagcctgggtgtgtagcaggccaggccatcaaggtgcgcgagagtgcgctctaccatgcactcatgacaatgccatcgccccaggacacatttctgagaatgtatctctgttgttaaacactgcctcactgtgttaacttgtgttacatccacgtgcccaaactgaccaaggatgtttaaaacaagcagaaagacagacccgactctccactcctccactctccgcatcccagcagctggcccagcccaacccatctcatcagtgtggggtcagcacagagccaagggaccataaccccttcggcgaggcacaagggaaggtgggctccggatcgggggccgccacataccgtggacgccagagccggcctgcttcagcatgggcttgtccatcttcttggcatagaaggccgcataccacacgcgcagctcggtacccggggggatgtctctggaggtggtgaagtacacgtcgctgccgtgctggtaggccgtcaggttctggtgctcggcctccgccgctggccgcaccagcatcatccagttgcagtcatcctcgttggaggtgtcgaagcacacggggtgcccgtccttctggaacacctgaaggtgagtcggcccatggagaagccggggaaatggctgattacccatctgtgtatcagcgtgtggggggcaggtgctgaggaacccatctagacagtgccacgtcagaggccataagggctcctgtacgggatgttgaggtgtttacaatagtgaggagggtcacaggtagaccatgtggtttggacgggtcaggttagtcacaggcaaaaggaagcagcagacacagccagcggtctatgtgtcattgggatacctgagtgttactcacggcccaggtgcggaactcaagttctaatcaggttctagtgggcatggggacaccaaagttctagtcctggtccaggtgggctttgagctacctgagcttcactcccagtccacgtgtcacggggacacctaaggctctccagatggcccactgggaactgggacacagttctactcccagctccgccacagggtgctgggctcctcaggctttatgagctgcctccccatctatcaaacagcactattgctttatggattaaatgcaggcaggcagcagggagaaaaacttacatattttgaagttcaaatcaaccacatgactataggagggttttgttccttattttctgatgtcatggtctcttcctccctgcaggaagagagctctcccctctcctaagcttctcctagagaggcctctccaaagacggagcccttggaagtgagaggcaggggtgggggaccaccaggcacctaatgaccaccagctgctgaggaaggtgtgctcccagctggcggcacgctctctctggtgggcacagaggagctgaacgctggtgcatgcactgagaacaacccagtaccaggcgatgaccttcagaatcgcgtagctgaaggaccaccaaaatgggcacaaaagacttctttaaaggggcctcgcccccaaccgtgcacccacaccaactgtgtacgtcgaccggatgggtgctgcaaaggacaggcaggtagccaacggcctttctgaggctgttttaagcattgttacatatttcttcaacttaaaacagccttttctttccttccttccttcctttccttccctccctccctccctcccttccttcctttccttccctccctccctccctcccttccttcctttccttccctccctccctcccctcccttccttcctttccttccctccctccctcccctcccttccttcctttccttccttccctccctcccctccctcccttccttccctccctcccctccctcccttcctttccttccttccctccctcccctccctcccttcctttccttccttccctccctcccctccctcccttccttccctccctcccctccctcccttcctttccttccttccctccctcccctcccttccttcccttccttccttccctccctcccctcccttccttccttccctccttcccctccctcccttccttccttctttcttttgtaaacaaatcaagtgcctttccttcttcccccctttttgctgaaatctgccttacaagctcagctttccaaaggacttccaaaaacccaagcttgttgacttcatctgcctgtcctaagacaagcagatccatttcaagggtctctaagaaaagtttgctgactaacaacccattcctcatttgtttatttcacagatatttctgaagactggctggcttggggtacgatacagagggcaggcatggcaacagtcaaaaaccagcctcgcctggcctcatagccttccagagggctcattttttacttattctaaagcctgccttgcaatttacatacatcttagttttctcgagttcacgtcaaagtagagaaccactgtcttctctcagtctgatgtgctttttagaacggccaaacttcacactattgcccaatgtctcatcactgcctaaacaaacaccttccctttgaaagaggtttgcaaactaccatacgctctgcacaggtgtggaaataactagagcgatgggcccctgcaagacgctgcctcgtaaagcctgcgacagcaatggaggtcgtaagacagctggagtcagcatttgggtttctcctgcatatgtcttaaacacactctttagtgttctgcaaaattgaaaattacaaaatactaacttaatatcgatgctcttgcaatgtaaaaagaaacattttcttggaaattaagcagacctacaatatttggagctgtttttgaggcatttataaatcatggaaactcagtggtccttgctccccattcccacatgggaacgccagaaaaacacccagttcctgagctcctgtttggcaacagcctttaccttcaggggaaatgcagactccttttcccatttggcgaccctcctggactcaaagggaccgaactgtgtccgcttgacgagctgagtgatggcgaacaccccctcggctccatcttccagtcgtctgatctccaagttgggaggaagggatgacctggaaatggaataaaacaagactcaaaagagagcactcacacccagggaccgactcgttaagataacctaaaagctcgccctcactgaccgccagggttcttcggaaataaaattctccaggtgataaaatagaagccttccaggccaggcttggtggctcacgcctgtaatcccagcatgcactttggaaggccaaggtgtgaagactgtataagcccaggagtttgagaccagcctgggcaatatggtgaaaccctgtctctacaaaaaatacaaaatattagctggacatggtggcatgtgcctgtagtcccagctactcgggaggctaaagcagtaggatggctgaacccgggagtttgaggctgcagtgagccaagactgtgccactgcactgtagcctggatgacagcacaggaccctgtctcaaagaaaagaaaaaaaacaacagaagccttcctaataggtgctcaatgatgactgagactgaggttgtgatgatgccctcgggctgtggcaaactacccataatcttgtggccttagctacacaaggccgaccacagggccctggtgagattcacccagagcacaccatggcggggctgtgcactgaaggatgggtttaattccccgtgggaaagacagtgccaacaggtgcatccctggtggggctgctacgggacagaacagggtcagactggtatggggtccagcgatggaggagggaccacagggaactcgctgctgaggagccatatgaagagcaccccgagaaagacgcaagggccatggaagtcccaaacagaaagggtttccagccaagtggagcgggccagtttcactgaggatgtgacctctttaactgaagtagaagaatgtcaaggactggggtctggggaggaaggcataggagccgggacgagcccaggacacgtccaggacagaggcggacatggggtccccagagcacaggcccctcggacagaggcggacattgggtccccagagcacaggcccctccgacagaggcggacattgggtgcccagagcacaggcccctccgacagaggcggacattgggtgcccagagcacaggcctctccgacagaggcggacatggggtgcccagagcacaggcccctccgacagaggcggacattgggtgcccagagcacaggcccctccgacagaggcggacattgggtgcccagagcacaggcctctccgacagaggcggacatggggtgcccagagcacaggcctctccgacagaggcggacatgaggtgcccagagcacaggcccctcagggcgggcaggaggccgctgagacaaggagccagcacggagggtctgactgcaggaccaagggtttcagctgaattttcatgggcaacaggcagtccctgagggttctggggaagaggggggttgatgggaagaggggggttgatctactgtctactttaggccaaaacattaatctctttgagtcacactaagaaaaaaaaataaatgaacggtgttgtggggcagtggggaggctcctggaaacagttctggaaagacggcggccacctgtgcagcggcagcacgtgccaggtaccatcacccacaacaccacaaccaccccacgggaactgccatcctctacagaggccaccgaggtccggagaggagtgccttgtccaagctcacctgccctgggccaccaggtggcacagcctcccccaggtgagggtggaacggcagggcagctgctgcccactgagccgcctcaccaggcctgcagggactgcttctggaagctgctgtgggtcagccctgtccctgtcctcataaccccgcatcccctgccccgcctgggtgtgcacgtgtccgctggcaggccaagacctggaatgcagagagaagccaacgagcagacctccagcttggctgctggtgctcagcacgtcaaccaccttggcaagtccactcttctgcagcctccacacactgtgtcgggaacagctgggctccagctaagaaccctggagtggatcaaagaaactcactctggagctttgaagcacgtgttttggtgtgtcccggcagcaacgctgctcagttcacagtgggagcggaatcgctggctctcactcagagtgcctctgttctccctcaggctccttcctccccgtctgcagacccaaaggccactaggctcctgccgcagctggcatatggaaggcccgggagctcacggcggtcactcaccttgccctgcttaacacaaaggagtctttgaccatgaccactgggcccagctcgggacattcggagtcgtggtactggctgcagtcttcacaccctgcaagcagacatccgggcattagagcacccagggagggagacacctaaagaacacaaacctgggaaatggggaccctggccccatgagggtgacccagagtcatgagacacatgcatgccgacactgcaaagacaagcaagggagggtgcattggatggcagaaggcctgtgtcccgaaggcctctgtcagcactcgtgcacacatgaggagtgcaaaggcaggacacgcccccagggaaagctctagctccgccgcacgcctcaaatcaagcacggtcacctccatggtgacgaagaccaagaccctccccaaagaatgagcataaatgaaaatggccaatgttagcaggttcatccctcctgcctagccctggattacttttctgaatcaagtgctaccccctgcaaagtgccctcggccaggagttctgagaaaggtgatcctattaaaaccatacccctgtagtgtactgcttattaaataaatgtttcatagggaaattttaaatatatagcttttctatattataaaaaccaaatgtagacgtggctttgcccagacagcaagcgccacgcccatctgtgttctatgacatagggctggtctcggacctgggacaggtccctgggtcacttacagatgaacatgatctcttcgctcccatcttcagccatctctgacacctgtcaggatacaagagagcctcattaatgacaagctcttaccaaaatacttttgttttgtttttgaaattgagctccctctgttgcccaggatagatagagtacagtggcaggatcttggctcactgcaacctctgcctcccaggttcaagtgattctcctgcctcagcctcctgagtagctgggactacaggtgtgagccaccacacccagctaatttttgtatttttagcagagacggggtttcaccatgttggccaggctggtctcgatctcttgaccttgtgatccgcctgcctcggcctctgaaagtgctgggattacaggtgtgagccaccgtgcctggcctcttaccaaaataatgtttaaagacaattcctactaaaggcctcctccagccagtacaggaacattacgtggtgttctaaagagagcacacagtggggtctcctcttattgtgggatggggctgggatccctgaaacatcttctcacctcaaataatgttatttttaatgaaagcaatggatttgaatggcctcatgaactcagactttcatcttttcatattagccatcaatttccatttttaaaacaaatatatcacctttttttggtgacagggtcttgctctgtcgcccaggctggagtgcagtggtgtgatcaaggctcactgcagcctctacctgctgggctcaagcaatcctcctacctcagcctcccaaagtgctgggattatggcacaagccatcgtgcccacctatatcaccatttttaaaaagccggttgtcactttttttcccctcactcctaacctatgcctggtgccccataaacacttgcttctctggggactaaatcaatgcgtgacgttgtggaggactctcgtgctcccacataagctgttatcagatccaataattctattccctatccatccttgaggttcacctccagaaacacttgcatagtgggtagatgagcataaactgacaccccccacacacatatattcacagggtggatctagacattgttcattctggggcctcacattcctgggctgtaaaatggaaataaaaacacccacctcatgcagtttgggaggagcataaagtgagatacacacagtatgtgccaccaaatgattattcctcctctgcccccccccaatccccaactgtgcgcaccggcatgtccttcctgcaacctgcttctctgatgcccgttgctgagtggtttaggaaagtgtgcatgctggcacttcttgaatgctgattccacacgccctccaccccgctcatccccagcagcttgaagggtgaaaagcagaccgtgcaaaactcatatggaaactcacagtcactgaacttgtgtgtctgagagcagtgccgggttgaaaacttcaagttaggagagtgagttagctacaaggaagtgaggcagaggaaagagagttccaatttgcccttaaaatgccagaaataacaaggggaggggggtgaaattttctcccaaaacagcactgtatcttcttttcctgggaacacacattcacgttcaaaggtatctcgtgcggctctagcaagtgtgactcagtttcatagccgcattcggccttgcctgccccagttcctgtggatgggcacctcggcgcaaatagggaccagtctgggatgggggctcagctgggcagtgagcaggagatgaacaggacaaagggcagaagaaacccagagtggggtggggagggcgcacgctttcatgagttgctgctgtgctactggaggtgtaggacctgcgtgccccctgcaggaacccacgtgactcacggtcaggagcttgggcgatgggaacgataggccttaagaggcgccccacactgcggtcagatcaccgcagaacacagagtcccaacaaaggtattggaatcggagtgggaggatggaaggaagtcgtcctggccttgcttacttgggagcctgcacgaatcccctgaggccttgtgtggccgcctctccccggggcagaccttgcctctggcctacacctctcacagactgcccaccccttctaggtgcccccaaaaaaggtcccctctgagcggagctgctgggagaggaaacccagaagagaggggcgagggaagctggagagcagggttttagccccctgtgctgcactctgattctatgtaaatgtccgagtcctggcaataagggtcccgattagcagcatctggtccccaaaatgaggcctctctaaaacggctcctctgggcccaagatcagaggccacagccaccctgggctgcagatcaggcctgataaacggagcatcttcaaagtctttgctgtcttggcaaaactccctttaacactcagaaagtgccttcatagaaggggaagtgtggtctccagacctctaaggcacacaagacatcccagaacaaggcacacaggaagtactgtttcagggaaaaggagaggaaaaaagaactagaagttcgagatcctgggcaggcgtgtggctcacgtctgtaatcccagcactttcagagatgaggacgggcgatcacttcaggtcaggagttcgagaccagcctggccgacatggtgaaaccccatctctactaaaaatacaaaaactagccaggcgcggtggcacgtgcctgtaatcccagctactcgggaggctgaggcaggagaatcgcttgaaccagggaggtggaggttgcagtgagctgagatcacgcccctgcactccagcctgggcgaccgagtgagactccacctcaaaaagaaaaaaaaaaaaaaagtgtgaggtccccctatctcaaccaccaatcctgggaagacttaccttacattagtgatttcaaaatgtggtccctggaccaggaaccagcagtgccagcactgcttgggaacatttcagaaatgcacatccttgcctcccacccccagacctgatgaatcaggcttggcagagggccctgcactctgtttgcaaaaccctccacgtggttcggatgcagctcaagtctgagaaccactgctctgcctgaaaaatctctttacaatttatatgactactactacaaaaactaactaaacacacctgccatcacagtaagaccacagtaataatatcaggaaaccaaacttatcagaaatgtcaattaagctcagaccaggaccatctgcatctaacctggtggtaaacgggaaatggggggtgacttcaggcaaatggggggtgacttcaggttccttacacggaacgctccgtgaagacacctgttaaaaacaactttgaaaaagaaggctgaagtgacagactcagtctacctgacttcaaacttaattatcaagctaccatcataaaaactttgataccggtgagaaggtggacagaaatcaatggaacaaaacagacaacccagaaatagacctaaacaaacatgcccaaagcattttttttttttttgagatggagtcttgctctgtcgcccaggctggagtgcagtggcgcgatctcagctcacggcaacctccgcctcccaagttcaagcgattctcctgcctcagcctcccgagtagctgggattacaggcacgtgccaccacacccagctaatttttgtatttttagcagagacggggtttcaccatgttggccaggagggcctcgatctcttgacctcgtgatctgcccacctcggcctcccaaagtgctgggattacaggtgtcagccaccgcgcctggcctgcatttttttacaaagacaaaagcggattggattttaaaatccaagcgaggaagggcaaccatttcagcagttagtgcaggaacaactgggcatccacagttcattcaaagaaatgaactataacttcatatcttactagaaaattaactcaaaatggatcacagtcttaaaacataaaatattaaataataatagaacttagaaaaacagagaaaatctttgggctctagggcaagccacagtttttaggcttgtcaccaaaaacacaatctataaaaggaaaatcatttgcatcttcattcagaaggcaacaggcaacccaaaaaccaacatgtcaaaaagtaaaaacatctggatgctcctgacaaagtctctctgcccccacctcctacatcttaggacgcagttgtcagagagacctggaaccgctgtgacctctctcgcctccctctgacacccgcccatcacccactacctgcagccccccttactacctcccttggccacatcccactttctcccacctgtaaggctgcaaagggtctccagataactcttcctcctctgcctgggccgccaacccattttccacactgcagagcagttcttctagaacataaatccaatcacatcgcttgccagcctgaagcttcactggcttcccactgtcccaggaacaaaacccaaactcctgcacatgaccaggcactgcctttctcagcagccttctcacctcacctccccacccccaccctctccagccacgcttcccggaacgccaagctgggtcctgcctctgggcctttccacatgctcgccccccaaggctggccctctccccagccctctctgcaatgcccgctcactcctcagtccccactccccactcccctgctcagtcctcactccccagccctctctgcaagttcccactcccctgctcactcctcactccccagccctctctgccatgcctgctcactcctcagtccccactccccactccccggctcactcctcactcccctgctcactcctcactccccagccctctctgccatgcctgctcactcctcagtcttagcttaacgtcacttcttcagggagggtctccctgatccacctgtccacagcgtggcatgctttctaaaagcgctctgcgatttccttcacagcaccgtcacccgtgtagccatgcctgtgtgtgactgatctcatgtctctcccaccacacttcaacggccaagagggcaaggcttgtggcagccttgcacagtgggatatacttggaccctcctcggcaccagcacacgggacaggtcaacgtctgataagagaatcagccacttcctggtacaccccctaacacaccccaggctgtggacgcgaggtccaccccaggcacagccacttcccctcagtccaccatgggggttccaccgtctttcaagacagagccctaacctcaccctccctgacaccttgctcccttcaattactctcacatcctctgtgatccccccaaaaagctgactcttcctaaaccactatctcagtttcacataatgtcatgcacatggtctgttttttctactagatttattttctttcattttattttgacacagtcttgctctgtcacccaagctggagtataatggtcccatcacagctcactatagcctcaaactcgtgacctcctgcgatcctccagcttcagcctctcaagtagctgggactacaggcacgcaccaccatgcccagctaattttttaattttttgtagagatttggtctcactatgttggccagactggtctcaaactcctggcctcaagcaatcctcctgcttcagcctcccattttggattacaggtatgagaccccacgcccagcctctactagatctttaaccatgaaagacagaagcttaaaagtgacttttccactcactccttttgttcaattcttatgtattttgtatgtagcaccctatgtataagagagccctgataaatcttttgacctgacaccttcttcacctccagataattaagagtggttggaaagttccaaatgtttcatttgcacaagttacgccaagaaagttcagaagtttagtcagattagcactaagatctggaggagaaattttacatgttccatataaaaagggattttaaacttttatattattgttttcgatatttacaaagcacctagcaaggttccaatgctaccacaatgacctgcgcttggcctctgccatcccccgtccatgacaggaggtggccccggcctggggtctctctccttagtggcctccagggaccaccctggtctggctttggccaggccgctgccttccctccacttgacactaagcctgtgtatggggttcctggttcacgtacttgaaagaaagttcaaacaaagcctgtgctactgaagaaatcttgcaagccaacaatgctgttcttggaatctgcagcctggcacccacaagaccatcttatcagctcaaacaaaacgaagtccatttcttgtccagatattcgtgggacacctaacatggccagctggtgttgaaggggctgttcatttggggcagcagaacgagcacaacgcttccccccttccacacacactacacaacagagggtgcgaccggggcctgcacaggggaagccagagagggctggtagagcccagatccggctggaccacctgacccgcatcttgattcctggggagacgccacaacacctccactccctggggagaccctactcactcccttctcagtacaaacagggaaaggtctagaacaaggaatccgaactttctgttgttaccagatgggtggatgggttcaaccacaacctgctcgcctagcagggtgacctccccagacagggctaagggagcagggactcctttctgtgctgagctctgagatgtggggagatgcccgacaccctcagcccagaaagcccagaaacctcactgactatctgagttttgcacagattttctattcacacacagagtgaccctgcagaaggcagccactcaggggcctctgctgcgccggtagtcaaacttcgtaacaccaaaaggagttaagatgcaactcctttctactctagccctgacctcctccgttcgcaatcttccccagggctgggggcagattttcctggttcccccaggaaaagttttgtgcaaagggtcctgaaagcagtgaaaggaaagcaagctgaggctctacacacttcagcagaacaggtgaaacatacatgttgaagagacagagtctcactatgttgcccaggctggagcgcagtggtttttcacaggcgtgaacatagcgcactacagcctcaaactcctgggcacaagcgaccctcctgccgcagcctccgcatagctgggagtacagccgttgtgcccagcttgaaaaaccgttttgaggattatttattaatatgatctgcaaaggctgaggaggtttagaaaaagctactggttttgaaatattaggaaatgaaagcttcatgattttaaaagacacatgtctggagaaaatcttctccatctgtacaattttgtcatttcaagaatgtcacataggctggcacagtggctcatgcttgtaatcccagcagtttgggaggccaaggcaggtgaatcacctgaggtcaggagttcaagaccagcctggccaacatggcaaaaccccatctccactaaaaatacaaaaattagccaggtgtggtggtgggcgcctgtaatcccagctacttgggaggctgaggcaggagaatcacttgaacctgggaggtggatgctgcagtgagacgagatccactgcagcctgggcaacattgtctcaaaaaaaaaaaaaaaaagaatgtcatataaatgaaatcagacagcctgtgacctttgagattggctttttctaactgaaataatgcccttgagatccctccaggatgttgcctctatcaaaagctcattcctttatattgctgaataatattccatgattcgagtgcattaccgtttgtttagcaattcactcactcatggaaggacacttgcaatttttcccacacggggctgttacaaataaagctgttaggagcaatcgtgtacaggtttttttgtacatacgttttcatttctctgaggtaaatgcccaggagtgcaatgactgggtcatctgttaggaggatgtttcgtttttgaataaactgacaggctgttttccagagaggctgcagcactttgcacctcccaccagagacacaggagagatccagtttctcggcggcctcaccagcatctggtgggtcactattttttattttagtcattctggcagatgtgaagtggtgtctccttgtggttttaatttgcatttccctagtggctaaagacgctgaacatcttttcacgtgcttgtaggccacatgtattaatattaataaatcctcttcagtaaaaggtctctgcatcttttgcccattttcctttttctttttcttttttttttttttttgagatggagtctccctgtcacccaggctggagtacagtggcatgatctcagctcactgcaacttccacctcccaggttcaagcaattctcctgcctcagcctccaagtaactgggagtacaggtgcccaccaccatgcccagctaatttttgtatttttagtagagatggggtttcaccatgttggccaggctggtctcgaactcctcacctcgtgatccacccgcctcggcctcccaaagtgctgggattccaggcatgagccactgcgcccggccctcttgcccgttttctagttggactgacagggttattttacggttgtgcttgagagttccttatctgtatatatagatgctttgtcgcatgtagtttgcaagtattttctccctgtctggggcttgtctttccattcctcccactcccagtttaagggtcttctgcagagcaatggtttttaatgttgttgaagtcaaatggatggaccttccctttcacagactatgcttgtgattaccacatctaagacctctcttcaccaagcccaaggttccaaagactttctcctacgtttcttagaaaaggctttaagagggagtctcactctgtcgcccaggctagagtgcagtggcgcgatctcggctcactgcaacctccacctccagggctcaagcgatcttcctgcctcagccttccgagttgttagactacaggcacacatcaccggctatttttttttttttttttttgagacatggtggagtttcactgttattgcccaggctggggtccaatggtgcgatctcggctcaccacaacctccgcctcccaggttcaagtgattctcctgcctcagcctctggagtagctgggattacaggcatgcaccaccacgcctggctaattttgcatttttagtagagacggggtttctccatgttgccaaagctggtcttgaactcctaggctcaagccatttatccacctcggcctcccaagtgctgggattacaggcgtgagccaccaggcccagctagaaaagtcttataagtatacatcttacatttaaatctgttatccaatctgaattaatttttgtataagctgagaggctgaggctgaggtccacctttttgtctacaacgccccatggcctcggcactgctgactggcttctgcgcctctgtcaaagccggatgcccacacttacgtgcatctatgcctgggtctcccttctagtccactgatctctccagcagcaccacgctcggcggagcccagtcaatgcagtcttgatgactgcagctttaatcaagtctcagagctgggcagaatggttcctcccactttattcttcttttgcaacgttgttccagccattctattctagttcctttgcctttccatataaacttgagaacaatcttggtttaagccataaaaattcttgctcagattcacatatgtaattttagtaacattttattaatccagtacacccaaaatattatgtcaacatctattaatataaacaaagaaaagatacaatataaaaaaagtattaaggaatttttttcatactaagccttagcaatccagtgtgtattttaccctttcagcttcttaatttggaccaggcacatctcaagtgctcagaagccagccctggtctggaggctcagggagtttttgttgaagcaggaggagcatctttcccgctgggcacacggcctcgtgacaatattaaaagcactcagggaaaacccactaacggaaaaagcaaacgtattttcaaaaatatgcgccgcagaaccatcctgaaaaatgctgtgggtgggcttcagggggctagcgggtgggtggagacggactctgactaagtcagtttgtgacaccctgcagattcccactctggagtcacgacacacacaggcacggcagaggccccgaaaagtccttcaacaaaaatctctgctgagatgtgttctgtccagcaggtgcccgaatttatttgggcaaagagcaccttttgcacacgctgatgaacgtgctcaagaaggatggtccacactgcagactcccggggtcagcaaaggggcagggcctggctttgctacaagatagaggactagacaccaggcccagggtgtgagtctgcctctgctgtttaccagatgagagagacctcaggtgagttatggcccctccaagggcctcagtttccttcccttacagtaagaggggtggcctggtactcaccaagtccctttcagttggcacaacttccaaatttcagttcattgttactgtctcataaagtagtgttaaaacacagatacagacatacagataaaacacagatacagacatgtagataaaacacagatacagatgggtagacagaggttttttacccagcttccaaggctgtgatgaaatggcacaatacagcaaccactcctcactgcctgctgcccagcagttaaaaggcatgtgttctacaggccggcagtaactccctttctttctcatttcccattaaatacaatgctttcttccagcctcgtccaggggttctgcatgccccaggagtgtttgggggactctctttggccctccattccccccacccccaccccccaacctcctgcaccaccacctctgcctctgcctggggtcaccctctctgtcactgtccctcttaagcagcagctgccattgttaaagccacaggctgtccctgtctgggcccatatccttcctcccctactggagtgagcccaccaggaggtagggcaggattgcgtcgcaggcctgcactcgcagggctcagtggctcagtgtcggacacctcattccctagagatgtttccaagagctgctcactgaccctctggttcccaatctgggacctgtaggccaacagtgggtcacgaaagtagacatgagaagcccactgtccctctccacgtgtcttgaaacatgacagaaactaacagtggtcctctgttgttaccactgacagccaatcagcagcctccttcctggatggttgctgctcctccagacctgctgcgtttcatcacctctccagcacccaggctcaggacgtgcagacacaggggtgctctgaccggccctgccgagtacagtctctcctgtagcatgccggcctccacctgcgcacacctacgtgacatgaccagaaccctccttggcccagccccgcccatctgcaaggaaggccccaggatacaatggaacatcgggcccttttatttccaagtctttctttttgtcttctctaaaataaagcaaatagctattatatagctagaaatagtacaaggttttcttaagagtatttcttttatgatttcttctcttttgtcactttctgaacctcttggtttcatccaaatggtatctatataaacagctttaaaaaacaaaaagtgcccctttccccttccccatttgctatcccattccccagggcggccattcaagcctctttctgctgtatctgattctacatctcaaaataacatgcttctctgagatccctcatttctcaaacttggatcttgcatttttacttcttatggcagatgaagggctagctttcttacattctcttcccctcccctcatttcccagtatgattatagttaaatcgatgtatatattatgactctgaaaatattggctgccctaacaagttcattattaaaacatttttttcttcaaaagaaataatgaacttaaacaacttcattatcaataactttaattgattttttatatttgcttaggccttattttttacacttttgacacataatcagttgtacctatttatggggtacaaactgatgcttctaatggatagtgatcagatcaggggaataagcgtatccatcatctcaaacatgtatcatctctttgtgtcggaaacattcaacatgctgtgcacacattttgtttgctaccattgtgcgggccagaggtggtggttcaggaggtcgggggatggtgagggccaaagagagcacaaaacgcacactcctgggcacgcagaaccactggattcggctggaagaaagcactgtatttagtgagaaataagatgagaaagaaaggggtttatagccagtttatagaactgtgctaggtggcttcacgtgcatgtggcttgtttttgctgcctgtgtgcaggttttgtgtgctgcacgtgcacgggttctgttgctggtggtggtaggagggaaagacacccatagctataacttcccgcaccctgcgattgcgtctccttacagtttttcaccgggtcagaccaacaagatggaccaggggttccactgtgtttcctagcacctctcctccttgtcccatgccctcaaggtctgacagcagctgcatcctgggcctccccttccacatcagcctgggggcgcctggttccttctcctgcatgtgaagctgtttcctgagcctcgttgctcccctttccttagtctactccccggatctggaaagcacattttcccgtagtttccgtaggagggcgcatgggggtatatcttgtgggaggatttgtcatgtctgtgaatgtccttattctaccctcacacctcggttaggctgcctgggtacacggccactggtcactttcactccgaacgcccaatgtccaaggaaggactccatggtccgtcagcttccagcgtcgtggctgatgcatctggtatctttcctgccagcaaatctcctctgtgcagctctctacctccagaatctttcagaatttttgttatagctcccgtgacctgaaattctgtgacctgctttgatgctgtgcactgactgggccttcaaccatgcccttcagccctactgttttcttgtactgtttatgatttcttctccgttctcactttctgaacctcttagtttcatcaaagatgacatctatatttctcattttcacatctggttctttaagagggagagaaaggtgtgccctctaccatcttaaaaatggaaactctgctgggcacggtggcttatacctgtcatcccagcactttggggggccaaggtgggaggattgctgaagcccaggaattttgagaccaccttgagtaacacggagaaaccccatctctacagaaaacacaaaagttagccaggcatggtggcacatgcctgtagtcatagctactcgggaggctgaggtgggaagattgcttgaacccaggaggtagaggctgcagtgagccgaggttgcagtgagacgagatggagatcgcaccactgccctccagcctaggtgacgaagcaagactctgtctcgggaaaaaaaaaaaaaaaaaagcaaactgaggtagtgtagactctaccacactgatggctgctctaactggctgtcctgtgtttgcttaatttaaaaaaaaaagggcgggaggactgactcctacttaacgatgaggcttgtgcgaccctagagggcttggatggtggagaggctgtgagtgctggtttagcgtatttcaaaaagcagacagaatgagaataggcagagagcaaagcctgcaggtcagatgtgctgggggatagggacccagggagacaagaggcatccagatgacaggaccagctaacagtcagagttgaggcggcctgctcagaacaaggaccctgttgacctcttgcctaacgtggtgctaaaataacatttatgtttttggtcacaataaaagacaaacctactataactaagcagcatgcatatatatatatatatatatatatttttttttttttttgaaacttacaaaaggccagaggccagagggttacgagacacctgaaacaccccttctcaaaagcagactctggtccagtgagtggacagttaaaagtccaaccgcatttgcatcctgcaggccccacccacatcaagaattaaggaccctgaactcacagtgagtttgccgtgagccgcatcacttagtcaaggtttactgatgacgcctgcagtaggtcagcactcagagctgtcaggtgcagacctggaccacgatgaacaaggagatcggtcaaacggagccagtaacagatggtgcatctcaggcaaataaaagcatcctctctgagaaagccgagctccagttttatgtaagggtatggaagcaaggaagagctgagccgtctgtgctcatcagaccccacgggcttggaggactccaggacaggctgacacctgtcatcccagcactttggggggccaagacgggaggatcgctgatcttggcttctcctgctctgagtaggattcatgtaggacgagtggcttcagcagggtccctgcccaatcccaggtcctctccacccgaagccatccttactgcctcctctggaaatcccttctgccctggagggtccctctcactgcgtgctccctcctaagcccctttgctgtctgcacctcccctccagagcctccacagggggtaccccaagctggctacctagacctccgtccctctacatgcagcacttacctgccacccccaactcccaagccggcatcctggcggcccctcgccctgccaggccccggacggcagctccacctgatgcctggaaccaggagcagccaggctctttgagttttgccagtatccccatgaaaatatttcctaaaatgccactccctgcatctcagctgacagtataaactgttcatccctgttttaaacagctgcaagggacatcatttccagcatactgtaaatactgagttaaaataaaactgccatgtcactcttgtaaatatatctattagaatctaggcacggtgacgtgacagccatggccatctatttacaacgcacacgaacaagctcttcttaaggccagaaagtatacacttcttcctctaggaactcctatttctgttactacaaaatgtaaacccaacgttatatattcatgcttgaaatcactctattgattcaccctactgtaactttttgcaacacaaacatgcatataaattgaattcgtcttgatttcctacaaccatagggctgtgctaacgtctcccgaatcatcaccgcagtacactcgtgtgtagcttcctgacaggattctgagaaatgcattgctatgggattttgtagttgtgcaaacatgatagagtgtacatacacaaccctagatggtatagcctactacacacctaggctatacggcccagcctacgactcctaggctgcaaacctgtacagcacttaactaacggaatactgtaggtacctgtaacacaatagtaagtatttgcttatctaaacatagaaaaggtaacgtaaaaaatgcggtcctatcatcttacaggaccagcatggtatatgcggtccaccattgaaccatatctccttttcacagtgtgactacaattggaacaccactgatcaaaacagaaatagtctccacttcgataaatcatcatctgatataaaagctgtgtttaatagaagagaaagagcttttttcccctaatcagttcacatagcatggacaaatgctcgcctctgtccctattcctctttctagaaatgcgagcacagagaagctggttccagaaataaggagacgggagcagaaggggcttggtcacagcagagtcccccaatgccacatcctcttgagttctgagcctgaattcatcaaagatcaacttgtcatcaacgatcaccatgaacaccgctggtgtagaggctcccgcagctgctgcagacctgtggcccacgggggagccactccccaacacccttacatctgctgggaccccgcagtttccacaccccagggccatgactgcaagaggagggacctttccttaggaggagccttttgaggagcggacgtggccccggggcagggtcttctcccactctgagggagagtttgaagatgtctgctctacagggcccctgaatgcctcaggtcacctgcacctcagtaaatagtagctccagtcacccaccatgcatttccaaccaaaccagcagcaggcctgcctggctctggaactaggctctgtcctgccccatctccccttctgcctccgagttctgtggagtggaatcatgcagggcctggattccagtgatgccagctccattccccacacacagccaaaagatgcagactctgccccgccactgctcaaagcccctcagtggcatccacaaggcagtcagaagaaaatctctgcctggtgcatggcccctgctgccccacctccatggccacactggcctgtcccatcctgggctcatcccaccccagggcctttgcatttgccaccatctgcctggtgggggcaggcaccaccgcacccacctccaccagaggctccctcacagcactggtctccactgtggcccctcctcagacagccccttctagtcccagcccccaagtgccccatcccctgcccgccacctgcctgccctccttcctttcttcatgctcttcccatcgtcttacctgagagttttatgattttctgtctacaccacctccactcccctgcccagaacattaggtccaccaggtgcagccctctctccattcactacagcgtgggggcacataacaggtgttcagtaaacattggtggaaagaatgcatgaatggccgaatgaatgaatatctgcccacaccagcactgtgaggggagctgagcagggccatccacactttgcaaatgaggaacggagtctgaaaaatcatttaagtcaccgctcaccatcccaacctcttgagcgcacgggtggaagacacagttgccttaaatctcccttcaatctgcaaaatggcaggactgttctttcctggccttctgtacagataatgacatcgaaaatgatatgagagccacatcctaagtgaaaagagttctttgtcaaatataattattctaagacaagctagcagccttccaactacagttgatttttaaatttatttatttgtcttctggagaaataaccgtcccgcctgcttccaaaatggaacatttagcttgttctttgctggctactttgcggcaaaaagtatgaatcacagatagaagaaaaacaaactataaaaaaaatggtgtttttgctcttgaaagtctaaattatagagctactatttcttaatcgttcaccgtgaggcagcgatgtcaggaaatctggggaaggagtgaagcagtgaaaacgtggaacacgtgaaaatgtccgagcttgaaacaaaatacggtagtggtgtgtgcaccggggtgggatcaccacccttatcgagtgttgacatcattgcattctccaaggagaactgtcactgctaccttttaaggtacatcacaaagccagtggctccttcacatgtcaccacccttcaggaaccaagctaggttctccaaattcacttgagtctggcttaagccaatgtggtttttttaaaacgagtgttggtagctttaaatacacacacaggtccacgtgtctctgatcacacacttgtttctaccgttttaaactccctttggggacttgggggtgaggggcaatttctgagcatttgtgggggaaaaaaccatccactacattagggggttaagaaaggtaaatgggtgataactctaaccaccagataggagtgtttatttccatgagttttcatttctattttctcaaggctaacccctgcgtgaacacctcccctctagcaggacgctgcgcgtggcccccgtccccacctgtccacgcgaggcgggcctcacctgagcggccgggcacgccccgtccccgaacggccacccaccccgggtaggcacgcgtcacctgtccatccacctcgctaccttctctctgccaccaaaaggcttacgaaaataaggcgcagggggtctgggagaccccatcaccaggactcagcttctctaaacgcggggttgggggtccagggacccccccgtgcgacccgcatgggctgtacccgagggcgggggataacgacatcccctggggcctcggcgacgacgccgcccggcggcgggggccgcggggccgcgggccggggcggcgaagaccctgcgccgcgcccacgggcgagcgcggcccggcagccccgcggccccgcgctgggcctggccgcgggcgggcggggggcgcgaggcaggggacgggggcgcggagcccggccaggagcgcccgcggcggcgggacccggcgggcgggcggcgcgcagggcgatcccggagcggctccgggaaatccagccgggttttgactccgatcgccaacggtgcccgcagccggcgaatgtaacaaagaacagtcggcatggcggctggaccggggcggcgcgcggctgccgggcgcggggggcggggggcagcgggcccagggcgcgccggggctcgcgggggcagcgggtgcggcccggggccggcggggcgcacgccggggcgggcggcgggcgcagggcccggagctttacctgcctttggaatgtgcagagcgggatcggatccggactccgggttgcgatccgctccggaaactgcgcagcaccggaagccggggggcggcggcggggcatggcgggacttgtagtccgcgggcgggcgcggggggcgcaggcgagaccctggcgcggccgggggtcctgcgggtgggactgcggggcgcgggcggcgtggacggggcagcgggcgcgcgcggggcgggtctggccggagggaattccgcgcgcggcccccctcccacgtggcacggccctgccgcccacgcgcgcgggcagctccctctccacctctcctcggacgcgtttcttgcggagttggggagtggtggcggtgggtgggtcgagtttttctctagaacaggcctgggacttgcccccactcacggtgacctctggatttggccggcggggccctgggacacgagctctgtgcccgcgaggggagtctggcctggcgggctccgccacgctaccggtgagcaccgggccagccgcggacctggctctccattcttccccgggggcctgtgtggcctctcttgaccccctccaccaagtgtgtgtgccatcacaaaacgtgagacggagaagggacagacttttcaccttagtcctggccgcccatattcagagaggccgactgtcttgttcattgctgcctggcaaaaacctacattcataaagagaagtgatgaaccggggaaaatgattttaaattgatgccacaaaagggctcgtttccctcatgtacgtgaaactcttgtgaaccaataaaaatatatatgtatatagaaaaatgagcaaagtgtgtggatggacagttcgtaggaaattcaatggttcttaagcatatgagaagctattcaactacgctgcaataagagaaaaaaagtcgcagtgggatcatttttattagattagcaaagattttttaaaacgtttaatacaacctgggcaacatagccagaccttgtctctaaaaaacttagctgggctcggtggcacgtgcccgtagtctcagctactcaggaggctgaggcaggagggtcacttgagtcccacagtttgaggctgcagtgagctgtgatcgtgtcactgcactccagcctgggcaacagagtgagaccctgtctcaaacaaaaacaaacaaaaaaaagttttaatagcataattttgaagaaactagagaaacaagctcctttacgggtaggagaataaattagcgtagtttccattcagatatttgtggatatccataaaaattctaaatgcacatagcctttgacccacatgcaggaatggtgccagagacggactcgcttgtatgaatggcatatgtgatcatcacatttgcttacatactacgtgccatcccatgggaagtgttggatgcacctgggcacatccataggctgcaacgccgggcagccggagacagattaggcaagtgttgatctgtgaaggctggtttctctgcctggcccagcattctacagtggcttccatgttgcactatagtaggccatcccatggccccccagacctttctggagcatccccggcgtccactgtctccctgcttgtccccacctgcgacttcatgcctccctccagcctcctgtccctgaagcctgttcccaaggccttctgtactctatcttcaaacacttcccaggttttccacaaccttctctgtattcaggtctccgcccaaccccactcccaccaccaccactacagctaatggacattccctctatacacgcacctccagtgacatcactcacagttccaaaatggccagatgactggttctgtgggcctcaggacatgaaacagtcctcggcatatgtgaataaaaggttgtttacactaaaaaagtgacaggtccacagcaagtgcgaataactgaaagtaaaccaaagacttcaacctcccccaggccatttctcctattactacatacagcccacggctggaattcacttacacaataatcgtcatatctcgtcttcaagaggattgtcaatgtgtccactataatccttcagaacaatctagaaataatacctcttaaggcagattcatctccaaaatgttaaaagaaaaaaaaaagttttatcttaaagtgtcaaattttcattattaacaattaatgcaatatacaactttgaaaaatgggcagaaagaaagaaaaaacaactataaaggttgttattgaggaaaatggaaaatctgaacgtgaacagtgataccggataatagtattggatcaatgttaaatttcccaagggtgatcattgtattgaaagtatggtagcccgtgccattcattgttctcaccaaattgttctgaaggatttagggtgaaatattgtgatatctgcaaacgtgacagagaccgagagagagcagatgtggcaaaactggtgaatctaggtgaaggctatatgggttgttccgtaggtttgaaattaaaaataaatgagttgaaaatttaaaaaacaacagacaagagcttccatggctatcagtgaatttccttgtgaacacttaattcttcctgaaagatactagatgggattaagatgtaattaatcactgagggctatgcccgcagccctgtggaccgcccgcccgcccgccttagatcagtacttttccaattagcacgtctcctgggctctggttttgttataattcaaatacaaacctactgctgtgcaaagcatgatagacatcctcaaccacctctccagccacctccagcttttaagaaaaaaaaaattggctaatttttctcataaagagggaagtctgatcatcagcgaataagttaattcctactaaatatgaaacattgactctcacttcatgttattctcacccaaaacaggcagcattaaagttcaaaaaagaccatatatccttgaagagtaactgctgaacttattcactggcagtgggccttatagcacagtgaatgaccaggttagagacatgcttcacatttgcttacatacccacaaattaggggatgatgtatctggactgtctagtagaactttatcataggagtatgtagattttccatggagtgctgttgtgtgacttgaattttagtcttggccctgcctctgacttcctcagtgatttatcctggttccagggaaggagaccagccttttcctcatgctagtctttggtggtttttaaacatttgtttaactcaacaaatgaaatgtatcatatgcctgacaccgctacaccagtttttttacatataaaattgttaaaaatttttggccaggtgcggtggctcacgcctgtaattccagcactttgagaggccaaggctggtggatcatttgaggtcaggagtttgagaccagcctggccaatgtggtgaaaccccatctctactaaaaatacaaaaattagccgggcatggtggcgggtgcctgtaatcccagctactcgggaggctgaggcaggagaatcacttgaacctgggaggcggaggttgcagtgagtcgagatcacgccattacactccagcctggatgacgagagcgagactccttctcaaaacaaaacaaaacaaaaaaacatataggaccatagtccttaatctctccaatcgacacaggcagagccagagactcacggctgtgagcagaggttctccaggcaaacagccagtgctcaaattctggtctagccagctgtcagcttgggcaagttacttaacctctctgtgcctcagtttcttaacctgtaaagctgaaatagatcatgccccatggagttgtttcagagagtatatgagtcactacatataaaactatttgaaaaattcttggcacatattgagtgtgcaattattattagctattgttgtgatctcaagtctttctctaactttatttattttattgagatggagtctcactctgttgtccaggctggagtgtgtgatctcagctcactgcaacctccgcctcccaggttcaagcgattctcctgcctcagcctcccaagtagctgggattacaggcatgcgccaccaggcccagctaatttttgtatttttggtagagacagggtttcaccgtgttggccagactggtcttgaactcctgacctcaggtgttccgcccgccttggcctcccaaagtgctggaattacaggcgtgagccaccgcgcccggcctattatataaaagctatgcttgctaccgagctagactataaattaatacatcccctgggcttagtccagtgcttcacctggtacagcaatgatgatcaccagctgataacccttctattaaggtgcccaacgtacctgcacgtccaactttataaatatcgatgacattaatatagacctataaatacataggcaactagttttgaatgcctgttacagcagggcgtgactcgcagtttccactgtggacagtcacagtgtggagctggggaaggccagtggaggaaagctgtttctaggtcatgattgggaaggagggcctggccttggcagctttctctctagggggatcactgtgctatgtcagccatcctggtgtctagccccctttggtgagtgatctgcattttaaaaataaactttattgacatatacacacatcaccctgtctttgtaggggtgctaaggtcaaaacagcatgtggtcatcccctccagtgtcctgctcagtccccagcaccaggtcctgggcgatggagggtgaggtgggtggaagcaaagctgctgtctgtgctcacgtaagggtcatcagctgacctttgtccttgctctgctaggtgggcagtgactgtacgaagccccgggggatacaggaaatgagagcaatgcaggacagtgaagcctgagagccggaggcctggaccgtgccgctgcaagcacgccaattccgcagcctgcagagaagctccttcgtggggaaggcagggcttgagttgggttagaccattcgaagagtgagtgtgaactgctgggcacgaggatgcacactccagaatgaccgagggtggttgagttggattaatttgggcagtggagacgcattggcaaacagtgctcatctggaggtgatcagcttaggaaagttggtaaattaggacaagcttggcctccagcaactcaatccagcctcctcctggagcatcagcacaaagtgggtccctctggccacacagaggaagcaacagttcaatcactgggtcctgaaccacttctaactccaaacaagaggcactgccatcaccaccttgtggtgcccaggaaatggagcagaaaacctggaacccagctgggaagcatcgggctccctctaagggtctacacggtgtctagcgagcgggcgggacagctgagaggaggggtgggcagtgtggggacaggaggctgggcctgtccagtagctttctccaggacaccagctctccacgtgctctgctgtctgggcaccgcagggggaatgaagactgagggagaccacgggaactgatgactagaaagaaggcacgatgcctgcatggggcccgcaggacacgtctgtgacccgactcgaccgcctccctcccagaaccaccgtgagccccaggcaagtgccgacgctgttccacctgtggctgagccaggtacctgtcccctctgcatgcacccgggccacccaccggggtggggaatggacagtgaagtccaaggatgacctgatgaaaggggcgctcagagaagaccctgggacttccaggacagaacaggactcgggaaaaacaactcagtgtagtgttctgtgtgcacatttatttctttcaaagattgtttgtgttccagccacatcttctccaaaggaacccacccaagcccgtgtgcaggcttgctgcagggctgtcttcggcgtttaaagtgctactgaggaatacaatcattgtcacgtaagttcatcaccgcactccagcgtcaggccaaacctttccgtggacctggaaaacctgccactttcttctctttttacaatgcagtttcgacataacattggtagagtaaacaacaaaccacaagcctaaatgatgaatggtgcgctgctgcccagctgctaactgagagaacgaggcagtgtattgtgtttcgaatgcaaacggtcatggacccaagttaacctgagtttgctctgcaggattccgcgggggccttgccctgtgcaggctgctttggtcttcgtgtctaggccggtttggggcagtggggagagggcctggcagcagggtttacgccagccccgaggtctgttttccgtcagacagagatacgtgtcctgccttccaccatccaccaatttgtactctgaagtttccagatcaagagccgtgagattactacccaggaaacacctgccttcggtggccagcagtgtaaattaatctttccctctctgctcaaagcaactttgcaactctcgtctatagaggtggccagtaaaacccaagcaaaaatctaaacgggcaccaggtggccactgagtggcgactggtcgagtagcagttggtcataagggatcagggctggttttgaactcagacttgaaacttgacgaaaataaagtgctctgtcaaaactctcacagcaggttttcagctggaacaaggagatggctactttttgttattgctacaataacacacgcgtgtgtgcaaacacacataacacacacacacacttaaagctccatttcactcctccacaaagaacagaggcacctccttaaacaaagcaaacggggaagggttgcaagctcattaaaaccaacatgagcacccagttccagagatacagacacaattaatcttagtgttcatgaggaattgtttttaaaacacaactgggcaaaactttcatccagacaaaagccaaaaacaaaagccctcaagccacaaaagcttgtagaagaggtgaggcgataaaggtgatttacacatcagtatttttagcatttggtggataatcttaatttatctttaaccttcacaacatttactttgtcataaataccctacaccatgaaaaaacaaacctgtataaaacagcttggaaaacaaacattcacagtatcaatacagcccatttctcacggtgctaccctgaagctagccgacgtgttgcctttgcctttgcttcataaactccctcccatgttggtgttttctgtaacttcagaaaaggccattggatggagacaacgtgtgcgtgtctacaggaagcagagccctagaccttggtattcaacagtaagcagcgctcatgggattcatctggaaatggaatagttaaaacctttttttttttttgagagcaagaaggcttaatataaaatcctggggccggcctggtggctcatgcctataatcccagcacgctgggaggccaaggtgggtggatcacctgaggtcaggagttcgagaccagcctgaccaacatggtgagactccatttctactaaatagaattagccaggtgtggtggcgcgtgcctgtaatcccagctacttgggaggctgaggcaggagaatcgcttgaaccaggaggtggaggttgcagtaagctgccattgcactccagcctgggcaacagagtgaaactccatctcgaaaaaaaaattttttaaataaaaaaaaacttctgatatccttgcacttgaatagagtgcacctgaattccaaaatcaaataaaaaagaacaattaaaaacttctcatcagtgtctgaaattctgacacataatatcctcttggaattcttaaatatgtctcagcctctttttaccacatggcaaagagcagtaaaacttcaagtaaaacattaaagtgaacatctgtcccatctgtcccaaaagactaacagtgatgcctgactttggggacagaaacttggtagtattcacatgttttgaaactccaggtgctttttttacaatgattaaaactggaatataatttttaaaaacaaagcaggttggaaaagtcattttaaagtcacttgataattcctggaacacctaagaagtttgtaatgcgcattttaaagtgaaattcctaatgtcgttttctaatctctctctctaaaaaagaagaaaaaaaaatcctataattttggtttttatacaggtttttactaaaaaagaaaaaaatcctataattttggttttcatataggtttttactaaaaaagaaaaaatcctataattttggtttttatataggtttttactaaaaaagaaaaaaatcctataattttggttttgataccggtttttactaaaaaagaaaaaatcctataattttggtttttatataggtttttactcaccagtggctctattacccccgaaatatttaatgtttaaggattaacaagaggctacggaaggaagcttgcccatttccgtctccatgacagaagccaagctttcgtaacagccttttacatgtctttggagaaaagtgaatcatattaaactgtcaagaacacttcaccccaatgatgactgctctttgaccagcatgtctactggaagtggcacattcagaagtgagatctgtgaatgaactgaaatagaaaggcaactgatgaggaaagcgactggaatgatattagggatattcaaatggtgtgccaggtttgtgatgttttccaccaaaacaaacccaaacaagggcaccccaacctgtgtccaagaggactgttcacagcaaaattctgaagcgctcatagaaggaatgtcctgcgagtttggcccatttgttattaaacttccattcctaagactgacacctgagacacaaaataatttcctctattgccctaaaaagactttgttttggctactggcagcacttggcaaaatccatgtatgtgtttggttactgtgttctacgagcggtcacgtatggctcctgacttcatctgacaggcccgctgtgctcttgtttagcaagtatgacaggcaggaaaaaaaaccctggatgtcaactgctccactagcattattagagcttttaacacgatagagaaaaatgtaaaaaccatgtgagaatatatatatcttccacttgcaagtaggctcaaagtaaacttagaaaagtgttctgcatactatgcataggatatagttagtgttcaagttctatggctaatatcaaaggtagatgacttcctacatctgtcgtagcgtctccattcttatcaaaatttctctattaatccaaaatcctgcctatgttccacttccctgtactcagggccagctgcattttttattccaagcagcagatgaagagaggtgacccatcctttccattcacagtgacagcacaggggggcacctcctttttgtgacatggtccaggcatggacccaaaacaacacttgttagtgtagaataggtaaactaagtccctcaaacctgccctccacaatctattagagcatattatttcacttataatgttaatctccttctaatattgaaccctaacccttagctatgagcacagcccaagctctgcagctgtcaagtctcatttagcatctggtggcaagttgggcttttttgtcctctctgggagaagcctcctggctggagactcagattttgttttccctttaaatgacgagatggttggaagaaacccagcaagacaagcggggcatctggacatccggcggacacactggctgcgtcctggtgagggtagttaacatgggtgcacgtcttctggcttggaggtgatgacctcaggccctacgtgcagggctccacgggggcaccgttcatggtgttcttgtttctgtgcctggagagcagcttcttgttcaggatcctggtgagggtgatgcctttcctccgggaaccctctggctgctccaggaacacaaggtcattgtgtgactgactcatgcctgggtctttctgttgatgccgccggcggaagaacagctttgcacctttccttagaattcctcctggaagagggaggcacaagggctggtcaagtgggcagggaatgaggggctgaatgactggtccaatcggacaaagggaaaaggaggctcgaatgcctctaacgaagggccagtttactacttcaatatgctgtcactacctgcatgagaaaaataactggaatctggcttgtacaaaacgagagttttcaagatgaaaaggaaacgagattataacagtagaagcagtaagcctgaactatcgcttgatatccctttctaaggccgatatttatattcctgaattttttttcttttttttttttgagacagagtcttgctgtctgtcgcccaggctggactgcagtggcgcgatcttggctcactgcaacctccacctccaggttcaagcgattctcctgcctcagcctcccaaatagctgggattacaggtgtgtgccaccatgcctagctaatttttttgtatttctagtagagacagggtttcaccatgttggtcaggctggtctcgaactcctgacctcaggtgatccacccctccctcagcctcccaaagtgctgggagctgggattacaggcatgagccaccacacctggcttatatccctgattttctatcagaccaaatggaggcagacagctattgcctcggttgggatacctgggtcccctctgtgccacccacttcccctcattaggaagggtgtagctggcaaagcagtactatgtcccagaaaggatggtcacactcataaaacccaattaagaccctgagaacaatggtattcactttcttaggaatgttaaataatatttgctcttttgggaataagattttattaaaaaataattccagatcctatcatattaggctatgccatctgaagtttgttacttgggcatatttggcctacaaaacgtcaattttgtgtggttcgatgtatctgcttacagatagatacagatctctatatacagatatttacctggctatagatatccatcaggtagtagaatacggaatagaaaaaaattagcagcagcagcaacaataatttcaacagcaatgattccttaaagatcaagtacaagctaatgtagtgggtgcaagagcccactaatttgctttttcacagattagtttaacatcctattaaccaaggctggcaaggtcgagggagtaagcatttcaggccagcctgtgaaattcattaccgctggcatgtaggtggtaatgactttgaaagaagacaggtctgatcatcatgaagaggagctttatacctaatgtgataatttattccctttgtgataggcatatccaataaacatttcaatagccacgacatatgcaaatcgccacccatgttgaggaggttgaaggagggcacgaagaatatcaattccctcttctaaatgaaatgcacaccaacaattgtggcatctgagggcagtcggagaaacctgacctagacctgcctatgaatctttgtataatcaaagcctactatggggaaagaagcatgtgcccctgagcctgacttcaagcaggaactactgtgtcccatctgctctgcccaggttacaggacagaaactgagaagatgaaaggccgcaatggactgaatttaatttgatcaaagcggccataattttttaaaaacttgactctctcaacacaaccaaatcactttttatgacgtgtcatttggacattttttacagtgatctaaagttaggagcctgtgtgcaggggcttcggggactgctggaaaaggaatgaaaaaggtgggtaagtagtgacattttttacagtgatctaaagttaggagcctgtgtgcaggagcttcggagactgctggaaaaggaatgaaaaaggcgggtaagtagtatcaacgtgtaaatgatgtccctgttgtccacaggcctaatggcacacctgtgggacatcagtgtcagttcctggagtgagtcacgtccctgaaaaatgcagcacatcgtgaaaaaccagccatcagcagggtgtgttctgacaggtggataatgacccccaactggacatgactttggagtttggccagtggggcagatacagtggtgctgatgtggctaactgcctggtgtatcagagggcacctgctggggaaatgccctgggcatggtgataggggctcccaggcagaggaacccccagctgtcagggggctctgagctgaccaggtgacctgaggctgggggatgagggggacctcagtggtgtttctgatctataggcacctgcacctgccttgaagctctgctttaggctgatcttggaggccctgaagggcctatggacaagggctcccaggtggaacaggggagaggaaggggtggatccatcagcttcacctggactgctccaacgtcacccccttcacttctaggggaaatggaggcctagggggagggaacgccaacccaccccctggggtcaaccacagacccaaggactcagaacccccagcagtgagaggttccctcctgctccacctccaaagtccatttcataggcgtccctgcactgaagctggcctggcgtctgtatccaggcctgaggtatgagcagggacaatgttatgggctgaacttggctcccccacccccacccaaattcatatgttacagtcctaatccccagtacttcacagaatgtgaccttatttggagatggggtccttgcagaagtcatcaacttaaaattagatcattggggtggcccgtgatccaatatgcctgctgtccttatcaaaaggggaaatttagacacagagacagacacgcaagggaagacattgtgaagggtcacaggaaggatgccacgtgaagatgaaggcagagcacagggtgatgcttctacaagccaaggaacaccaaaggttgtcagcagctgtcaggagctggagaggcgggagcaggctctcccacagggcctcagaaagggtggccctgctagcaccagcagctcagacttccagcctccagaacagggaaagaattggctcctggtgttgcaaacacccagtttgtggtactttgatacagccctgggaggggagggggcgcatttggcttaaggatccaggaacgtccaccatgtcttcctgttcagtccttagaacccaggcagcaacatggaggagtggaggcggagaggacagtgaagcagcatcctcagccccgagccctccaaacaacaggcctctaaggacaacaggcgtgcaggcccttcctggagaatctggcatgatgggggtctggggacactgggcatgagcatttttcaaaagttcccaggtcttttgaacatgcagctggggttatccactgctagcccgggtctggccaaaatgccactagtgcttagagcactcggaggccacagccgacaacgcaggagcaggccagggccaaggacacaggcaccatacctgctctcctgcatgtcgctgctcatgctccttcgcacttcactctgggggccggcagaccacagggctgtgtgggtagaagctgacgcagcccacccgcagggcccggtgccacgccagagacgcgcggtgcgcccaggttaagagggaaatgggtgtggagacaggcaaggcacggctgtgttcaaaagaccttagaacaggaacaggagccaggcacggtggctcaggcctgtaatcccagcactttgggaggctgaggtttggagaatcccttgagcccaggaattggagactagcctaggcaacacagcaagaccccatctctatttttaaaaaataaaaaaattaaactttttttaaaagaaataaaatgggatatgcacattttcaagcagttatgataatttatgcaagtgaaattgtactacaagtgcctaaacctgggaggctgaggtaagtgttttgcttgagcacaagaattcgagactacaatgagctatgatcttgccactgcactccagcctgggtgacagaacaagaccctgtctctcaaaataaaataaaataataaaaataaaaactgcctaaaattctaattcttggcatattaagatgaaatagcaaggattgcagcctgcatgtaaaaagatggtagacaagaaagattcgcacggcatgtttgttttaacctcactccgggctccagtctgttgtctgtccataccctgagggactaacttgtttcagtggcagacctctgccccagggagctctgtgcctcttcttacaccctaccgagaggggctggtaacaaggttattttctgttcttccatcttcactcacgctctccagagcatgtctgctgttttgttaaatttctttttttttttttttttttttgagacggagtctcgctctgtcgcccaggctggagtgcagtggtgctatctcagctcactgcaacctccgcctcccaggctcaagcgactcttctgcctcagcctcccaagcagctgggattacaggtgcacatcaccatgcctcgataattttgtatttttagtagagacagggtttcaccatattggtcaggctggtctcgaactcctgacctcgtgatccgcccacctcggcctcccaaagtgctgggattacaggtgtgagccacggctcctggcctgttttgttgaatttcatagttcaacatcaatgccagaaaccagattatggtcatatgtgcccgtgtgcaaatcttcctgaaatcgtttgtgtgacttgcacactttcccctaacctgataatttgtcacagcttctagggggatggcatcaacttctcgaacagggcacagtcatgtgcgggtggggactgaggtttgcagttctgtagactggaccctcaattatattccccagccgcctctgaggaaggaggcctgatccctaccatttttagggttgcttttggtcactgttttcctacctataggattttaagacagattcctcaattagctatttatgtttgctagactctgtagggacaaatgaggaagctaaggtttggagaggtggctggctggggtcgcacactaatgggacgggtgtgtgacattgcgctttctggctctgaagtccatgttcccaggccctgctcttccatgctgctaaggacagcgtctgagaagtggccagccaggtgtctagaaaaatgggcaagtctgtggcccctggggaggagactccggagagtgtggatacatcaaagcccgtggggtctcatggagcaaagccccctaatcctgcaaggactcgggcgggattcccagaatgagttgcgtctccagagaggcatgcagggggcaggggaggaggattccagccatgcggacagaggccattccattccctttctcaatagcaatgggaaagcctgtttcgacttggaagcagattgttcactatcacctttggggtaaacgatgcagggagaacagggcccccagatttgccagtgcacactaaatagccgccccatggtggttgtgagggtcaaggctgagacaggagcacactcttgtctgctgggcagtaaccccatatggaatgtaccggtctgcccacctccacgagcaacacctgtgaggtgtcgctgtgtcaacctggctgcagcacccggagattcaacagaacacgcactgaggtgcggctgggaaggcattgtgtagatgtggataacaactccagccagtggactttaaggaaaggagattatcctggagaatgtgggtaggcctcatccaatcagctgaaggccctaagagcaaacactggttttccagggaggaggaaattctgcctcaagaatgaagcatcagctcttgccggggtctctggcctgctgcctgccctgcggatttcagacctgtcaatctcatgagtcagttccttaaatatgtaacctatgggttctgcttctctggaggactgtgactgatccagtaactgatggtctggatcaagcagatcatctgcttgactttgagcccgcagaatgtgttgccctttgctgatagtgaagttcacactacggtcaacaatagccggggccatgttgattgcatgaagcctgactacttgactccaggctaccttctctacgccaacagcaagaagcgagatttagacctcacccacaaccttcaagattcctgaagataatttggggagtggttatgtgaaattggaggcaagtaaccaagattttaaatgggagacagggagaagaagaaaagtctttccctggttctaacaaggtttaaaaaacaaatcacaagaaggctgaagtataaacaaatacgtgaaagaatttaaacataattaatctaaattatagctctaatgtcataaatatttccaaatgtattcctatttgtctctacagagtctaacagacataaatagcgaattgaaggttctgtcttaaaacccagcagaaagaaaaacaatgaccagaaaaaaaaaacaattgtctttggcttcccaagaacagcatcggatttcaactggaaccacagatggtccgttgatagaagcgactactttttagctctggaggacgacaaaaggaaccagcttcttcctgtgggtgtcacagcgaggtcgcctggccacatcaggtaccagagcgagcgccctcacctgataggccctgtacaacctcagccacagcactgtcaggaggaacacgcggaactagcaacctaggagggtaaaggcggagttgggagggaacacgaggcaggcaggtcggctggctgctgagctacaggctgcactcctaggacgtctacgtgtaattgagaaaaataagacaaaaataacttactgtgcaggcaattaattctggttggcatagcgatcctcttaagttaaagggaatgagcatgagatgaagagaagtaagaggcagaaagaattatgcaagagcaacatcagagtggacgtgggtaagggttctgagccatctacagacaccacacgcacacaggacgccactgtgcaggatatttggcaaggtttcttactgttccaagttttttttccgaaaacctcccttgaaacttttgtgcttacttgtggtaacatacccataatataccctcttaaccatttctaccggcacagctcagtggtgctgagtatatccacgaccaacttcactgatctttttttaaactaaaagtaaataaaaatttggggaatacatttcctgtgcgggctggtttccaaccagcagaacctcaggaggattcgaaatacacaggcactctcagaaaccgaatacaaactccttagcaggacaaaagatacaggtggttcttaaaccaaaaaaaaaaaaaaaaaaaaaacaagctttagtttttaaaaaaagacatcctctatcaccagttttgaaaaatgtttggttgaaaaatgaaaatgacttggcacccataacacagaatcgtctcagattgtgacagcatctcacagagatgctaattacaagtctctttaaaagcactggaaggaaacatttaaaactgctgccaagtatgtcctgttcaaaaacctggggtcaatgaggtaggggcgcaggagtgaaacgcacggcacggctgagcctctctgctgcattcccaaatgccgagcctccggcaagttctgagcctgcgttgcaggtggccagccccagcccccaacacacctgcccgacacccagtccccaaagggtggacccctcatccacctggcccgtgaagggagaggagcagggtgggtgacacagcaaggatggaaacccagggaaagacctcccggaagggaaaccagacagggggaaggaggaggggctgtgtgaaggaacacagatctttacatgaacagagtgagcgaggcttggcatttcagaaggaatgaggagggcggacggggggttgggttctgccaggacaagaggaaacgggccatccagtcaggtaagggagaggaagagctaccccaccctgcacccatgtttgtcccgcttcgcccagcactcactgtctacaagacaaagaataggccacaggtgtgtgtgtcaggtgaccaggtcacctttgacataacccaagccaaggcctcttaacaggagcacaggagcctgccacagaggtcagcgtgcagcttacagccctcaagtgctctgtggaggggggtccatgcatcaagcaccccaaggccaggcagtgggcaaacagagtccaacgggtctgaaatcttatccaggaaatttcctccttctccctttcctcttctaactttccatttcccccaacacctatcacgactctgcactggcaaggaggggggcatgggagagggaggccgccgtgccatggctgagggacacaaagcaaagacagggagagaggggaagaggacagactcagacagtccagcccatggcaggctgtgggctttggcaccagggacatttgggaccagagcatgctgcactgtgaggctgccttgtgggggcgtgtcctgtgcacggcagggcgctgagtggcatccctggcctctattcactagatgccgactgcaccccagactcccagctgtgacaactaaagtgtctccagacactgccatattccctggagggaaaaagtgctgggcttgagaatcactggtctatggcatcaagaacagaggacaaaaggcagcgacagcagcgcttaacaaagctcccccaaggagccccttcgatttcccgacacagatggtctcaggacatcctgagatttccgctgaaagccttggagccccacacaagagccagagccaggagttaatgctgagcttcacctgagctcacggcttggcctgccttgcccccagtcctgtcttctgcaccaagatgtccttttgtcccccgaatggtggagtcaggtgggcgcaggcagcggccatgctcctcatcttatggaggaggatgctgaggctcggtgagtctcacatctggaacggaccccaagcccctagactatatgtccttagcaaatacattcaggttactcatgccaaggcactgtctcggcaaatctgcacacgcttaaggaatttatagttttaaagcacggacttagggctaatggaagcaatcagtactaatgaaatgatcacctcctcagcacccacatattaagttaaccgattcattattcccaggagcttttctccctgtagagcctcctagggtcaggtggtgaggtctggttttgtttcaggtgcagggagactcttgacaggcacaaaggagcaaagatgtccatatcggcagtggaaggagccccaggctctgcctggctttgctctgagtctctgcagcccatcattgtgtacagctcttggtaacccgtcgggaagccaggtggagcaagcccagactgaggaaggggcctctatgcatggacacacactgaccccaaatgcagagatgacgccaaccctcccacagaaggaccggcagatgccccaccacgggttcaaacattcagcacagggcatttctggaggggcaggggtgaggctgggagggagtttgtaggggacaaagggaaggaaggcagatgacttcagcttggaagccagcatgagcgcaaagccaccaagtggggggcccgggatggggggctcgggagcaggtacctttatgctttttggcagtgcccggctccaagacactcatggagctctctgacagctcatcaccgtcggggtccagcaggacctggctgctccatgccgcggcctgtggctccttctccaagtcccaggagtctagctcgtcctcctggggcttgggggcaagggatgcctgggctgactcggcttcctctggcggggcagaggctgccgccctctccggatgggatggggcgtcctcctggtgggtgctgtccacagaggccgtgtagccctgcatcagggcagcgtcgtggtcctgagatagtgaggtctgtcaggggcagtggggaagatgacaagggatacatgaaaggaagggagggtttgaaaagaactgaaaagcactctccaaaacattctgacagctgatttcaaagtctcagaagatgcagccgtgggcctcatagaaggcgcttatacatcacggccgttgctcatgcttgggttaaaaaaggtctcccttacagccagggctcaggatccctaggcagctgggggttggcccccggggctcagaggttaaccctcttcctctcacagatgggcctagcggtgggagcgtttgtggcaagctgcagaaatgagatgcgagagagagagcccgtccttcagagtccacgacagcacaaaggaaatggccgtgggtgtttcgggtttagctgtctttgttcctacacgtttatgttacctgcaagtggaaattcaccggcacatcctctcaaaaattatattttgtgtaaaaatatttaagcactaaatgaacctctgagagtcgggatagcgcttccttggaggggggaaagtttggggaggagggcacgggggctcccttccttggaggggagaaagtttggggaggagggcatgggggctccctgagggccagtcatgctgttcttggtgtgggtggcagtgacacaggcgtttgcttagggacaactgtgctgttctgacttaagtgccagcctgtggaagcgcccactgactcaagattagataatctccccgtctctacttaaaaaagtacaaaaaattagctggtcgtagtggcgggcgcctgtactcccagctactcaggaggccgaggcaggagaatggcgtgaacctgggaggcggagcttgcagtgagccgagattacgccactgcactccagcctgggtgacagagcgagactccgtctcaaaaaaataaaataaaataaaataaagattagataatctgagcaccaataaaaataatcactgcggtgaattcagaacattaaatactaagatccaggagttctttgtgatttttaaatatgatcttagagaaagtataggggagatgaccacgagtcttgtccttattttgctcattcattcacccaagagcgaagaaaacccaactactgggccccggacttccagagaggtcatggatccctgctgagggcccctggaggggctcaggaagcccccaaaacaccacccgcctgcctctgggacgtggggcaaggccaccctctgggtacaatggcaaggttgatgactcatctctggcacctccaaggtcctgttctggcctgtctcccagccactgaggaatccatcttctgcgtgccctctgcccacccacccactcttttgtccagaattcttcctcatccccctcctactccaaatcaaaatcttcccaactctccctccacctgttcatttggaaatgtcaaaaaaaagtaagggccgggagcagtggctgacgcccgtaatcccaacattttggaaggccaaggtggatggatcgcttgagcccaggagttcaagaccagcctgagcaatgtggtgaaaccccatctctaccaaaaatacaaaaattagccagtctcataacaaattagctggtctcaaaataaataaatagatagataaaaattttaaaatcaattttaaaaaatgtaataaaaagagtaaggatctgtaacatggcccttcacctgaggggctggcctctccacagctgaaaccacacacttgccaccacctgctctgagcggacgtcccagagcgggagaagggggagaaagggagtgcggtgtccacgggggacactacaatgttcatttctctctgattacaaaaggaataaacattcactgcaaaaaagtaaaaggctttggaaacgtgtcacgtggaaagtgaaagttccccgtgactgggtggtgacgagagcagaggttctgtaccaaaggggagtcttacatcatgttcctctctttcgataatttttcttgaaatgatttgccaacctctcaacgtgtaaagcgtccctgattagaaagtctcccatgtccttggtgaataggataaactgtgtaaacacaacaccacacatgactcctttgtggggtgaggaacataatttgacatttgtaaatggaactctctggacgttaaccaagtgcttgggctaacttcttcaaagggcagaggagcagcaggtcactgacagatgaccagatgaacacctccccagccaccacgatggtaccttggagatccctgatatgataatagtgcttttcttccgtggcgacttgagtttcagctttgaagattcactgagctgtcgaatggccacttcagccactggatccgaaccattcaacaccaacaattctaccagaaggaaggcagtgttaagttcatcagcaaaaattaaagacttccatgggaacttccagggataatggaaatggtcgataagcaatggttagcagatattttctaaaaggggccaaagggtcaattgtttaggctttgttggtggtctctgcaacaacttctcaatgcagcttttatagagtgaaaccagctagagaccacaggtaaataaatgagcatggctgggtttcagtaaaactttatttacaaaaacaagtgacgggccagatttttcctatgggccatagtttgctgtttgctgacccctggtctacagcttgattccctgggtggttacaagatactcactgaagtgtctgcttaagattcaccgattttatttatttaagttatacctgaatagagttgatggaaaatggcaaaagcaagcaaacaacaaaaaaaaaatatctaaccctttggaagattttgaactttgaaaggcaaggtagtgactccttttccctcccaagagtgcctaaatacatagaatagtaactagagctatgaagggccagttaataaaagcacctccttccccaggttaataacaacacacaccagccaacatcaatagaatgcttacggcaaaccaggtgctgttcagagacagagctctgtgcacattctctcatttactcctattccacaccccatgagcaggtccttccttttatcccatttgaccattgaggagtatgtccagcagccaggaggccccagagctgagatgaccagcaggtctctctgactcagagctgatgcttgtaacttacactttcctgctcaggtaaagtcaaaatggcaaagctattaaagtagcaggatggtaaaaggaacttctgtctcggttttggccatggcctgaggcttacagatgctgcatttccaaagggagtcaagataagaccacagaggccaagaaccggtgacaacagtgacactggggaataataaatagatacttggtcttcctccctggttcctggcacagagaacaaaaaaaaaaatcctttgaattccagagccacggagctggggcatccttctcattcctaataagcccctgcaccccatccgagtgaatgctaatgaggacgggcactggatgtcagaggcaccaaccctgtggttagaaggctggaactttctgccctcctctcgcctgtggggaagggaaaggggctagagattgagctcaaatcaccaaaggccaataagtgaatcaatcatgcctacatacctacttatagaagcaccataaaccccctaaatgacagggctcagggagcgtccaggttgtgaaccaacgcatgcacgtactgggaaaggggcgactccacggagatcaaagctcccacactcaggaccctcccagactgtgccctgagccccttcatctggctgtgcatttgtgtgataataaactggtaaacccaagtaaagtgtttctctgagttctgtgagccattatagcaaattacggaacccgaggagtgtgtcatggaaaccccaatttgtagccaagtgggacaaaagtgtggtaacctggggacccactatttgcacctgacatctaaagtggaagggtggttttgtggggctgagcctttcacctgtgggatctgagctaactccaggtaatgccagaattgaattaaattgtaggacacccagttggtgtctgcagagaaacagaaaattgcttgccatagaaaatctacacatttggcgtcaggagtgttgtgagtagaggaacagatttttgtttagccactgacccacactgagaagagagaagtgctggagaaaggagttggggaggactccttaggagaaagctgtgctgtaattcccaaagccaccaagggagacgtgtcgggagcacgtcctcctcacgccaggcccagtgcttctgttcagtcccccgagagcccggtccaggtgccaggtgcagcctgcaccgtggcaggtgagcctgggggccggctccatggaccatgcatcagaacccacagtgggaacatcagcctaggtcttttaagagggatcctgcccacgtgacaggaccccgcagcatgggcagtgggggcactgccaggggaagaaactgaggaaggggcatcaggggcagcggcaaaagcatcagcggcattagtaccagagcggctccagctcaaataagggctgggcaaaatgaggctgggatcccctgggctgcactcccaggaggtgaggtgcccttactcacagggtgagctaggaggtcggcacaagacacaggtcacaaggaccctgctgataaaacaggatgtggtaaagaagccggccacaacctaccaaaaccaagacggcaatgagagtgacctctggctgtcctcactgccgatgatacactgaggataacgcattagcatgctaaaagacactcccaccagcaccatgacagtttgcaactgccatggcaaaggcaagaagttaccctacgtggtctgaaaaggggaggaatgctcagttctgagaaatcgccgcccctcgtagaaaactcgtgaataatccaccacttgtttaacatatgatcaagaaagaaccagaaaaagagccaaccagcagcccgtacgggttctctgcctacagagtagccattcttttattcctttactttcttaataacttgttttcaatttactctgtggactcgccccgaattctttcttgcaccagatccaagaaccctctcttggggtctagatcaagatccttttctggtaacgaaaggaggggcagggcctgcgtcccagaactgcaggtgggggacccagcggggtagtatccaaaaaaccataaaacctcccacaagaggaggaggcagttatgaactttcaccaggctgagaatccaacaccatgttaagacagtgcccctccagtgagaactttccactcccctgactgccccaccttgcccagttgttgacctgggcaaggtcagacacaggactcagcgaatgtgggagagctaagcaagaaggaagcatccattgcccctgagagcaggtcacgaggaggcaaagggagaaagttaatccccaaatttagattgcgcagtgatttaatgagtcagtaagacatctcttcaaaaagtctattacctgaaactgaccataaaatagggaatttgcatttcctattcgtagtgaccatttcctagtggaagggaaaactacttctactaagctggtgtaagcagaaagtggtgaataaaattaaagtgacggtgaggacgatgtcctgagtcctacttatttgctattaatgtagctagcgtgttgtgcaagagaaaaatgaacagaaaatttaaaatgtaaagtctcagttggctttttattttgttaaagcattccctaaaatgtagcaggaatatgaatgccgctcctggtctctgatcaatttggagttcccttttctccctctccttcactcatcactcattaacaaaacaaaagcaaatcaaaactttttttttttttttttttttttaagagacagggtctcgctctgtcacccaggttggagtgcagtggtgcaatctcggctcactgcaacctctgcctcccaggttcaagcgattctcctgcctaagcctcttgagtagctgggattactggcatgcgccaccacgcccagctaatttttgtatttttagtagagatggggttttgccatgttggccaggctggtctcaaattcctgacctcaagtgatccacccgcctcagcctcccaaagtgctgagattacgggtgtgagccaccacaccaggcccaaaacaactttttccaaattctgaaaggaaaatacttcatatcagaacagcccaaaaggcccaaaggtgctaagagggagagcgacgtgggcgtgtctcagttacctgtgtctgaagaagagagtgttttgctgacgggggcgctgcggcaggcgatggcctggacagagatgtccttctcgatcaccttcaccttgatgggagtcttcaccggagaatctgccagaggaagatcctgattacaaaagcggccccgtggctgactggatcaacagttaccgaaaagtgaaaggacagccctcactgcaactctggtgtgtgcagttggtaaaggcaaagcttaacgaaagctgttttgaggggaggaggggcaagagtggtgtctggagtccaggttgaaataaaatttcagaaacattttaactaagccagaatttcccattctattttgcatccctgaactgtgccaactcatgcactctgggaggataatgcttttgcccaagcagagatgcagtatgaattttgagaaataaagcatacgcttatacagaaacttctgtctccaaggcagtgcctgtggagacaggtacagaattcagctggatctcaaatgacagtccgtcaagccttctagcaaacgatttttcacagaagaaagtctacaaggaccactcactttgaatttttcaagaaaaaagcgtgtgctgtccccacatacaggtaatagagttcgtgttttgttttgttttgtttttgcttttttctttgaaatttgctcttgttgtccaggctgtagtgcaatggtgtgatctcagctcactgcaacctctgcctcctgggttcaagcaattctcctgcctcggcctccagagtggctaggactccacgcacgtgccaccacgcccagttaattttgtatttttagtagagatggggtttcaccacgttggtcaggctggtctcagactcctgacctcaggtgatctgcccgcctcggcttcccaaagtgctgggattacaggagtgagacactgcacccagccctatcattgagttcttaatttaacttagttggagttacacctaagggcaactatttacactatctagattttagcttcagaatataccatgggaattgaaccttgtttcagtttattgcatatgtgtttggcagaagagaaagataactgtcatccgataacaacaacaaactaagcacaagtgtggccaattagcacccttcctgtgctgtgagaatttcctaacactcggcgctgcaggctccagaactctgcagttgtgggggcaaggtggttacaggcaggcgtcatgcagaaagttcctcgactgcgttcctgttgtctcaccagagctcagcggggacgccctccccacgtcgacgcgaggcttggtcttcacagcagtgacagtagtgaccacagtcccacagggcatcaccgtgcggtccttttctatttttgcagcaggaacagggggagggatgggccaggatttcaattcaccaggttccatgtaagagaactgcagagaagacgcgttacttgtttctggttttgtggaagttgcccaggctgatcagccaggtaacactgccttcttgtgaaataaccataattcataattccttcccttaaggtcacttagcatctccaattaacctggatattcccagaatggacacagacccaaccttacgcacagccagctcaacacgtaatgatggcaacagaatagaagctggggaaccaagcaaaactttcaaaggcctttttggggtaggtccataaaatggcatcctgaacagttatctcctccagcagacaactcaattgtacagtggacagaacgtgctctattcgagtctggtcctgcgtacgatgaaacagcatctcctcttggaggaggtcttatttcacacagaggcaggagtgagactctgcagacataagtgaagacgctccttgggtaagtgccccaagccggaacccggccgcggcggacagcctcgccctacctctgccgtgaccgagcccagcaccgagctgccgcaggcagacccgctggtcagcgtgaagctctgtggcccagaaggctgcttcttaaataagtccagaggaactgtcgccgtcgccagcagacctgaaaagataggagacaggcaaggggtgccgctgatgtttcccgggcttccgtgaggacggaaaggcccacacgcccagcagccggaacacgctcctcccgtgcatccagcccacggggaagtgctcacgtttcagaatgtttgaaaaatgtcgatgccataaaagacaaagaaaggctgtggaaacgctgcaggacagaggatgctaaagcaataagacaggcaggcaatgtccggccctgtgccggagtggaaaggtcactgctctgaaggacatcacggggtcgtccagtgacaaaaactggaagatgggcataagctaaggaattgcagcaatgtaaattcagggagctgacaactgtaccgtggacacagcagagagtatctccattcctgggaaaatacacactaaagaattgaggataaagggccaagatgcatacaatttaccctcaagttgtgtgtgtgtgtgtgtgtaaaagaaaatgagtaaggggagggagagagagaccaagcatgagcacaaatagtagaggaaactgggcaaatgttaaggatacgtgagtttgagtaaaggttatgtggctgttctttgcattgtttttgtaaagttcgaaatttcatggattccatcaggctgggctggaacgaaatttgagtgaggccagaaggagtggggacccaggaatgggatcagaagttgacttctctccaggtaaacagcacccccatgctgtgcaggtccccgacctgcgttaggcttctctctcaggactcttatctcacgggcatcccagttttctcgggactccaaaatcaaggaagtcgcctcaggattcttgctaacaactaggatataaaactagttaactgggagaaataacaactttctcactttaggaggtaaccaaatggcttgattttattgctggataggctgggcaagggcttcccaattttggtatgtttatggggagagttttacaatctaagaaaatatttgtatctttaaaaacctaacaaatattgaaactactgatgtgtacacacacacacatacaggcccacgttcattttagtgttttagtgactttacctctaattgttgctttcttgtgtataaatcctgagttcaatgtaaacctctgtagtttattttacaaggaaaaacccagtgaaattcatacaggcagtagagtagggatgaaaaaagctctggagatagatgggggtgatggttgcacaaccgtgtgaatgtacttactgcccctgaactatgtacttagaaatggttaagacgatacattttatgttgtttatcttactacagttaaaaggttttgtttttgtttttgttttccaaaaaaaggaggtctcttggagctaagagggttcagaactacttctctatgccaagaattgttgcataaaagattttggatttttttaaaaaaacaaacaaaaaatccagttgaacatttccccaaaatgtatgaccttgttaataactcaaattgcctttcgaccaaacattcccatgggaaaaccaaagtcatttagaggaggggtcagcttcctctgctggatctcccaccgcccttttcctgaggccgaggtcatgcagcggaggacctttccagagggcgaggcctctgtcctcctgctcaacccaccttctgaggatcgcccagcctctgaaatctgcaggtgtaactccttcgacttggcattcaactcgctttggaagagaaacaagttatgagtcctaaaaaatgcaatgcttgattctttttatgaaatagagtgttttttctgattatagaaaggaagacaaagatgtcaatatttaacaaactaccaagacatataagcaaaaaaagggaaagagttatctgcaacctccccattcggaaacagttactgttaatattcggtgactagccttccagagtagtcaacaggatgttctgtgatggcagtgacagagaagctgtcaaatgcggtaggcacggagcactggagaggtggccagtgcaagctgaggaactgaacgtcattttaaaaaatttccattaatttaatttaaagagacacatgtggccagtcgctgccatattgaaagcacagctatataatgacctaaagacaaaatacggaacatgatatacctccctcctccttcgtaacctatttattttcattacaaaggcattaaaaaaaaaaaaaaaagtagagatgaagtcttgctacgttgcccaggctggtgtcgaactcctgagctcaagccatcctcccacctcggccccccaacgtgctgggattacaggtgtgagccgccgcgcccagcctgtaacctattcttttaactgaaaattttgtggatgtctttctgtataactacagagcaacatcatgttggatgggcctctagtattctgctctttgcccttaggagattttatttagccaactctttactaaacaacccttcttaatgtgttggtggtccccactatttcataactatacacaagctgagaggcacattcttacccatatatctttgcacgccgtgtgattatttccttaggaaaactctaattgcctgtcaaatggcatgtgcatttgagaggtgtttttcatttaggtcgacggatggcatccagaatgcttattcccagtgacacctccaatgccattatcactctcttattctttaccaagctgtgaggtggaaagatgacctctcccttttgctgaagtttgcatgactttacttatttctgaacatcttttcagaagtttatggccattggtagctctggcttttgtatttccagttcaggaattttgttcagttttctaaggcagctgtcatcttttcattcatgatttataaaagctatacacacacacacacacgggaaattttcttccattactttttctaattgttcattttttaaggattagattatgattaattttaatactttggtactcagctaattcattaaatgattatgtctattagtttttaaaatattcatttctaccttatatcaattattctttctaatagcttgggttgattttcttgcatagtcctgatacgcagtcatatcatctccaagcaatgattggtcttgcctcttcctttccggtatttgtgtatagttttttcccttatctaatttgcattaaccaatacttctagaataaaataggcatccttctcttgattttagtgagtctgcttctggtatttaccatttatagtgatttttaaaatcttattaaagaagtatccataaattttgctctaattaagtttttaaaaattaagaatgggtattaaatgtcactgaatgtcttttggacatatgtagagaaaatacatttattttctcttttgatctagtaatacaatgaacaccattaacagatttccttatgagaaagcacacatacatccttacattcctggtatgaacacagctggttttatttttcatgtgctgctagattctgtttgataatattttatttatgattcttaccccattatttatgcatggcctacatttttccctatctcgattctttttttttttttttttttgagatggagtctcactttgttgcccaggctggagtgtgcagtggtacaatctcagctcactgcaacctctgaatcccaggatcaagtgattctcctgcctcggcttcctgagtagctgtgattacaggcacctgccaccatgtctggctaatttttgtacttttagtagagacagggtttcatttaccatgttggccaggttggtctcgaactcctgacctctacccacctcagcctcccaaagtactgggattacatgtgtgagctactgttcccagactttctttctttttttttttttgagacagggtatctctctgtcacccaggctggaatacagtggcacaatcacagctcactgaagcctcgctctcccagactcaagcaatcctcctgcgtcagcctcccaaatagctaggagtactacaggcaaggcaagggccaccatgcccggttaaattttttaaaacttttagtagagaagaggtctcgctatgttgctcaggctggtcttaaactcctgggctcaagcgattctcccgtctctgccacccaaacagctgggattacaggcatgagcctctgcacccagcgcctttttctattttcttcgttaggttctggattcagtcagaggctccctcccttttcaccctggatgatatgtgtgtctgtaagagaccccacgatggctccctctcatcatatcagggcaggaggagaaaactgactctaagagctgcctttacaacaaaacccatgtttgacctaaagctacctttaagatgcttaagacatcatttgttgttaactgttttggtttagtgttttagcctaaacggtgctgcagaatgatttcaggatttggcgctcctgaacagacacggccgtggacacacaggcccataacccggccagactcacaaggtgaattcctcttcccacatgaggtccggagtgtttttcgtcagggtgctggagaacctctgaacaggatcgttcagctgcacgacgcacactgcattaatgtggcctgtaattaaatagaagggcatcgtgttggcgtttatttttattatttatttatttttttttttttttgagacagagtctcgctctgtcgcccaggctggagtgcagtggcgcaatctcggctcactgcaacctccgcctcccaggttcaagcgattctcctgcctcagcttcccgagtatctgggattacaggcgcacgcctccacgctcagctaatttttgtatatttagtagagacggggtttcaccatgttggccaggctggtctcgaactcctgacctcgtgatccacccgcctcggcctcccaaagtgctgggattacaggcatgagctaccgcgcccagcattatttttattttttaaattgcatgaagacattgtatgcatagaaaaaaaaggctaaattaaatgactaaggtcgaggtttacccacttcagagagtgggaattcttgcatctgccattttcaaatgctcatagcaccagcctttattggagttaagtaattttttcccacatttgatatcaacagccaagggctgttgaccccaagtacctcgccccctccgtcagtgctggccacaagcgtgggctcccagggggaccctccccgagaggcagcaccattatatacacaggcatggtccccacttttagacaagactaacagtttgccaaagcctaaacatcagttcgtgttgactcctaaatttggaaatatacctcacagagttcccatttcccgacttacaccagacaggtgctgtacctgatactagccagggtatttgatccaggtagtaggacatgtcactagtgaacagctgtttctgctttgagacaatgcttctccctgcagcacaaagtccccaatacactgtggaatcagtaattgctggaatgtgtggacgctggaccacgcagcagcagggtgaagcagcctccacgcattcgctactgagctttcacagtcactcttcaagagaagactcagacccagacgtggggacatccagcagaggcaggaacggggcctggcctcaggacaggtacatgtgagagctgggaccccaaccctgaccgaccgagtccagggagctcacgtttagccactaagcagtacaggctgaaagggcaacatgtgggcacttttaccaaaaaacatcctcaacagctagctctgcacagtctcagttgctagatgtggcccatttgtgcttttggaactggaggaagccccttgcaaataaagataagtcacctttaacatactcgggcaatacaatttgctcctgttcttggcaaaatggagtcgcgctgtaaagaggtgccctgtcccgagtgactctgtgtctggggcctcaacagtgattcagaaccacccagaaggggttatccattctgtgttgcttgtcttggctccaacagcagccatggtctcccagcatcggagtcccgagtgtggccgaagccatctgatgcccatcaactccctacatcccccttcacccactttctaagaaagcagaatctccagcactttgggaggctgaggcgggcggatcacctgaggtagggagttcaagaccagcctgaccaacatggagaaaccctgtctgtactaaaaatacaaaatagccaggcgtggtggtgcacgcctgtaatcccagctactagggaggctgaggcaggagaatcgcttgaacccaggaggtggaggttgtagtgagccgagatcgtgccattgcacttcagcctgggcaacaagagcgaaactccatctcaaaaaaaagaaagcagaagctgcaccttggtcaaggatgcttaacacatacatacaggttcaacagttaaaaaaaaaaaaaaaaaggaaagaaaagataaaaaaggcaggacaattccagacaaatgaaaaaggccaaaccaattatactcctttccctccttggccttcccacgtgcagaaacaggattggattttttaccatctcttgttcccgttacattttcaggtgctttctgcaaccgtggcagggctcccgctgcacccccacgggaggatgccaccagagaatccaaggccccccggagcccccgactctgctcaggggctggaagagcccctccaggcaggcaggctcccatcgtcacccacctgaggcaccgggctcgctgagcagcaagacgtggatgttcctcaccagtagcttcagctcgtgagcccttggaggtttaggaggacaggattcctgagcagtagatgcagcacactgtaagttctgaaaaaataaagagcactttatttttggtcttcatggggagattgagggccaaggaagtagccactggactcctgttatggggggtggtggcagtggggtgtctacaggaaaacctgcacagggagcccgagctctgggatctgctctgaaacaatttcccttctcacatgaagggagggagccaatgagccatcgccatcctcctgcctgggagcattttctaccccaaatacagcaagtacaagtagcagtgcattcatccacagacagggttcccacaacttacttaccacgggggaagatggagctcactttgccatgggtctaaactatctgacccgggcaggtgcttaagagcatgaggacctcttccgctggctgcgggcactcatggcctgctagtacagagcaggacaccagacagatgggaacagccagggctgtcagcccacacccatttcccacctccacacagagtccaacgtccacatgaggaaagtctatgcataccctagcactgcacaggtgaggggacagaggcaggggcagctgggaccagcttctaccacatcacatcctccaatagacaccacatcacatcctccaacagacaccagggcgtttccaacagaaagcacccccaaatctggaagagcccagcttcaaaccagcatttcccaaaccgggttccacctgtcactcactgccaagagtgttcttttttttttttgagacagagtctcgctctgttgtccgggctagagtgcagtggtgcgatctcagttcactgcaacctctgcctcctgggtgcaagcgattctcctgcctgagcctcctgagtagctgggattacaggtgcccgccaccacacccggctaattctttttgtatttttagtagagacagggtttcaccatgttggccaggctggtctcgaaatctccacttcaggtgatccgcacgcctcagcctcccaaagtgctgggattacaggcatgagccaccacgcctggccaagagtgttcttttattttatttattttgttcgtttgtttgttttaagttctttttctttccttttctaattatactttaagttttagggtacatgtgcacaacgtgcgggttaaagaggctctgttcgttgcaagcattcagggacccagacgggcttctcggaggtggcgccagcccccatgctgtgagaagttttcaggcagagctgaaaactgggtgctgatttgactgagcactgatttgactgagcacttcttcgggggaatgctcactaatgtctcaagagacacaggtgttctttcccacctagaaaacactgttctgagccaggcacttcccaaacgtgagctgagggtgctggagcccaagaaggaattgccgaaatccctgaaatccaaggacatgagcactggggacagagcaatctacttgtctgggacagagatgaaatcttttttttcaattgctgagggtgatggttaactgtatgtgtcgacttgactgggccatggggtgcccagatatctggtccaacatgattctgggtgtgactgactgtgtttctggatgagattaacattgaacttggcacacccaatgatgcagattttcctccctctcgtgggtgggcctcatccagtccgttggaggcgcaatggaacagaaaggctgagtaaaaggaaactccttcactgcttgagccgggaaaggggccttttcctgccttcagacttggactgaaacagtgactcttcatgggtcttgagcccagtggcctttggactggaatgtacgtcacgggctcttttaggtctcagggcttcagactcgaactagaattaccccacagactctcccggggctgcagcttaccaaatgcagatctcaggacgtaccagccttcataactgtgtgagctgattacacacacacacacacacacacacacacacacacacacacactcccattggttctgtttctctggaaaatcctgaccaatataatatacatatatgctattttgattaaataaactgtacaaatttatggaaaagcatgattgaagttatgatcgtctgggtcctattaaattcatggattccaaaaatatacgactgttttatgaagccgcatacattttgacattaaaagttgattgtcacattcagaacagtcacctctgatgtgaaataagctactgtgacagaaatactgaaagggacagcgctgggactctcctctcacctcccaagaggcatggcctggtcccctccatttggagaggctgagtgcccccaggcctcaggcccctgggaagccccccagacatccacacccctcctgctctgctctgctggcccggtgccccttctgcatactgcaggcttcgggagggtgatggtgcttccttatactcttgtgacccccatagccagggcttagcagcaaacactgccatcaactgatatctgtccagtgaaacaaagtcttcagactctacctactgacagctggtgacatctgcagaccaaggacagacatcacacaggaatttgtattttcaaactgacttcaccaagagctagataataaagatggacattataataaagatgtattttatcatgctacataaaaccactgccaaaaaaatatattttttaaacttcagggactataagtgcctgttgtacgtaatcatgataaaaagatcagcgtatgactgagagaactcaccttaaacaaaggattactgatgtgttatttaggcccatgaggttgaccagggcaaatgctctggttaagaatttaaccagaaaagtgagtagcgccctaatcagatggaataggggggctccagcatgaggagggaggcaggtgatatggaaaagggggtcgcacagatgagactagcctcctttatcgtgtgcctccaaaggacacagacctccaagaggcaggagctgttgcaggcaggaccagggcagcaggccggccctagcccaggctaaaccatctctgtctatcccacccacctggctctgcttgcttctggggcaatgttctcaacactggctgctttcccaggtaccttggtcctggaaagatgaggtctagggctctgaatggacagggaaatgtcaggttttccttccacttcatgaagctttgcagccccatgctccaaacccaaggctttatcccacatccaccatcatgatctccagcaagcacccgagccatcttggctctaccatgggaggtggaggaacgctggaacgcacacagattctccaagagaggtgggccatggtgcctaacggggttcagatgcacccacagcacccagatgagtttacctgagcttcctttacagtcgtgggcttggtaatcagaaccactgatggagaggcagaaccagccaaatgcttcaagatgtccttgagaacgtcagacatcgcacttgtctcagccacctggtcctggtgaaagaggagaaagttgacaaatcgcctttgcaagcccactccctgctcccaatctcacgtcttcaggtgactaaaaccatgcaaagtaggaaggaaggaaattaccttcagattttagctctgtctttgcaaaaactgtggaaagaaaggacgccctgcccttggaagcagccttcggactcagcccaagttacgagtgcagcaccctcaccgtgggagagagggcctgatcgtcagacatggtggagcgtcaagcaggtacctacggtgtcattagccttggctgcatatgagtgctaaaatcatccccagccaattaaacctgcatcttgggtggggcagggaaggcttcagggttttttttttaaatggccaggtgactgcaggtgcagctcaggtgggagccctgcatccaatccatcaaagccatcccccagcaggccctgccaagccaaagggcccatccacatcctgagaggcccaagccagccccaggaggagtggctgggacagggaaggaggccagcaacaccagccatgcactcagttccccaccgcagactgtcctaacacacgtgcgttctcacgccaatggaagaatcataaaaacttacggactgacctcccccagtgctttgggctggatattaacggccatttccggcacactgatgaaagaccagctaatctggaggtcctctctcttctccttcatgtggaactccagctattaaaaaacaagttattagagggccactctttccaccaaagccttaatgtgcacgtgcgtgtgcatgtgactgtgtgagcatgtgtgtgtgcatatatgcatgtgagcatgtgtctatgtgagcatatatgagtgcatgtgagtgtgcgtgtatgcgcatgtgtgcatatgagcatgtgtgctcatgtgtgcatgtatgagcatgtgtgtgcatgtgagtgtgaatgtgtgcatgtgcatgtgtatttgagcgtgtgcggaagtgtgcatgtgagcacgtgtgcctgtgtgtatgtgtgcgcatgtctgcatcagtgtgcatgtgtgtatgtatgtgtgtacctgctcatttattcacatattttcacagaaaactgcttagctttccacttggcatacaatgtgctttcaaaatggagagcaggaccccaaactctctttaccccctgcccttcctgccccttctctggcctcaacctacccctcaaagaggaacctcagcattggtggtcgacaaccagatgccatcaaaccttgcagtctatttaacataaatagtttgctgtgctttgcatttctccttctgggagtatccgcaaggcataaaggaaagaggagtgagagaagggcccagggcgcctcattctaatcctgggcgtgggctcccctgccccacactcaaacagccctgaagattgtgtgcagcacaaagccatctttactgtctcttgctggggccgccacagcagcctctaactggactccatctctaaggatgcctcatcccaccctgtccatttgggagacagaacagcggcccccaaagatgttcaccccctaatccctggaacttgtgactgtgagaccctacagggcacaggagacttggcaggtgcgacagggagaggacctcaagatggggagatgaccctgggtccttccgaagagcccagtggaaacacctgagtcctgaagagtgggggagcacgggagaagaggggccagggcatgtgacgtgaggactgcaggcatccctgcgggtgtggacgtggaggaaggcaccctgagccaaaaaatggggtgcctcaaggagccggaaatggccctccactgacagccacaagaaaatggaactcagtcccgtaatcccatggaatgaaattctaccaacaaccccaaaagcaacgaacagactcccctgtgactgccgctaaggcaggcagccctgacagctcctggatttgggcctggccggacacctggcctccttcacgatggcatcaccaatctgtgctgttttaaactgttcagggtcatttgtttccacagccatagaaagctaatattgcatcctttattcttcagctagatgctccgtccaaagcaaaaatcttaactttgcagatctccattccttccccactcctaaacaaaagggaagaacgacttcagactatctgagtaagtggactctcacctcatgctagaagcagggtaagagaaaaacgatgacttctacttcataactgtctccaacctgccttccttgtctggtaattctaggaaaaaaattaggtaattctagtggaaaagtgcactttaattgttttgacacagacagctcagtcgatggagaccactcttgcatctctggttggaggaacatcagagaagcgggaacgcctcctgccgctagcatcaattatttacccatctctagcagctgcctctgcgctgagaggtaatccacatattggttcctaactgtgttaacagatcaaagatacaattgtgttccttctgtgtgagctgcttaaaatggcatgaatgctttgatataataaacacaatgtcagaaatgacatttcttcatttgtgtttgtgatcctctctggtctcattcagttccaaaacatgcatcaaatgttgggtaaatatgacccagactttgcaggttattttctcatcacattgtccaaaacatctgggggatgtaggagagcatgaacgcctcacaaatccacgatgccaactcttcacctcttcaattccctcaaagggggtgctgctggagtggggctgaggaactagcggggtggatttcagaaaaaagccacttaggtagccaggaaatcttgttagtgctggctatttaaaaccatgcctttgtaggaaaagcatacaggatgtcaccttcccttgtgattgggaattctgcatgacttgagctcatcccccaaattaggagtcaagtccaaggacacgggacacgggagatgaaacagggcattgaactggcagtgaccctcgaaacaagcccagacatctgcaatttttaaataccagctaaagaggaactccagtgaatatctggccggatgtgagagacgcacagctctctgatgatttgggcaaccaaagtctcactgggcttattgtaattattagagatccgtaagtctctctctataaaattatagagatgtgtaaaattatatatatgtctttattcttatgtctattatgaaaacatggaataatggtaatactaattttttaacttataaaaataataagggggttctttttaaatcaactttgtcaaaaactgaaaagaggaatgccccacggcagccactcagctgtgtttccaagctgcaaccagcgctggattcggaaccagaactacttttctcctctcagatgccacctgccttatcatatccgtcaacaacaccctgcctcattcaaatgcccgaaagaggcaacccctgagtttattataaatgtatgtgtgtgtgtgtagtgtgtgtgtgtaatgtgtagtgtgtgtgatcatttcctacatagaaaatcctatatgaaaggttacagtttgaaaattatgacatgaatgataattaataaaaacatgaacgttacagccctctgactcacaccatgctcactcttcacatttctgagaactgtgacgggtctcataacttgcaaagtctacacatctttacctgtaaatggaaaggggagagccgcatgtcgtacagccggcatccagcacccaaggcaggcgtctcgctgaccaagaactgaatagcctggcccaccacgtgacagaccaccacctggaggaggcacaggtaagggagaaaactgtatccaaaacaaaggacagcgcgtgcatacgcatcttcttcttcttctttttttttttttgagacaaggtctcactctgtcgcccaggctggagtgcagtggcgcgatctcagctcactgcaacctccacctccccagctcaggcgatcttcccacctcagcctcctgagtacatgaaactacaggggtgtgcccccacacccacctaatttttgtttttgtcttttttgtaaagatgggctctacctgtattactgaggctggttttgaactcctgagctcaaacaatcttcccaccttggcctcccaaagtgctgggattgcaggcatgagccactgtgctcagctgccataggcatcttttttttttttttttgagacggagtctcactctgtcacccaggctgaagtgcagtggagcaatctcggctcactgcaacctccgcctccctggttcaagtgattctcccacctcagcctcccaagtagctgggattacaggtgtgtgccaccatggccagcaaatttttgtatttttagtagagacaaagtttcaccatgttggccaggccagtctcgaactcctggcctcagctgatctacccacctcagcctcccaaagtgctgggattacaggtgtgagccaccacgcctggcctaggcatctttatatcaaaataatctggactttatatgttagcaaggatacaaatttagagtttcaaagttggataaatattcagattaaaaccttttctataatatagtttgaaaaccagaaacaatgtttcaaatctttgcttcctgatgactttcttagcagctaaagtcttgaccaaatctagttatcatgcgctttccacatgtaatacagtctttttcctttttttttttttggagatggagtttcactctgtcgcccaggttggagtgcagtggcacaatcttagctcactgcaacctccgcctcccgggttcacacgattctcctgcctcaaactcccgagtggctgggtttacaggcgtgtgctactactcccggctaattttttgtgtttttagtagagacggggtttcaccattagccaggagggtctcgatctcctcacctcgtgatccgcccacctcggccttccaaagtgctaggattacaggcatgagccaccgtgcccggccaacaaagtctttttctttaaatatcatcttgttctatttctccacaatagctgatttttaattccccaaatgtttccacattcatacacagtcaaagccattagccaagttcttttgctaaaaatgagtcttaaagagaaagtaagttatagatgttagaagtaaaaaaagttttcttaaattacccagaacacaatgggttgcttccacctaaataatttcgaggcgatcatggttttcaaaaaggtgggagtaattggaaaaacatacaaagtatcaaacaattataaaattatgcagccgtaccaaaaccagaattataaaatgagctcgttgaagaaactgtcagacagagaaagataataacctcaggaataaaccaaactgtggtttcctgacataaatcataatcatacagtattaagaggggtgcttttcacagctaccatggcacagagagagatctagtttctgccacagattcctctacagaagctgatgtagaatgagaggtcagacccctccccgctcccctcccgggggcagagggccaagcagacacgtgtgggataattaccaggccaggtgccaggtgtgtactggccaggaggaggagaggggaggccaggggcacagtgggctggaccacagggcaggcacaagggggttccgtaggtggccagtgtttggccaaaaagcaaagctaccaggagctgagggtaagtcagactgacctcctcattcccaaaagaaccactgactccactgcagggagtcacaggacaggaagagaaaattctttaattctctggtggatttatcagaatctaaaataccaaatggaaagattatcaaaataattactcagtcagggcctgctattcccccaagttcagggctaggacattcccctgtactttctcatctgctggctcctggccgcagccaagccctgggtccagctcttcccaccagtggcccatcccactctggaacaaaaacggaacctgggcactaaggcccgggcaggggtcaacatccaatatccacaaccaaatacctcaatgccacagagctagaaaaagaaaatcctgccttctctcaatattggcagaaagtcgtgcaactctttctaccggttcttataacgccacgttcagaagactgatacacatgagttaattacatatttccatcatctccagagttcacaaagggccagaacaaaaaaatgtttgtataagaaatgttgtctattcatgttaaaaataaatgatctataaacagtcctttacggaggaacatgctttgtggccagatgagttacacgcaccaatggcatgacactgagaaaattccctgtccttggtctcaacagcccactccttttactgcttaaagtaaaaaataaaaaataaaaataaatttaaaaacccaaccctgactctgagcactgcataattcctctggagccttctctactaagctaatcagcattgtaccaagaaaacagactcagagcctcaacccgagcaagaaagaatttcattttctttcgtatccagttctgcagaaagcttcccaccacgcactccctgatacacagagaaccaagcacttgattaaaagcaagcaaataaataagtaaatagataaaaagactttaaaacttctagaatgcgggactccaaagctcataagtaatcactgaagccccatcactaaggtaatgtaatctctacattctactctaggacagaatgtgtgatgtcttttcatagtaaccccctggcgtgtcttccccaaccctagggcttcgctaccctctaaataaaacctacagtgcagaccaagcctttcttagcctcccctcagaatttggctagaaaagttaattaaagaaacaatttaggccgagtgtggtggctcacgcctgtaatcccagtgctttgggaggctgaggcaggaggactgcttgagtccaggagttcaagactagcctgggcaacatagcaagactccatctcttaaaaaaaaaaaaattagccaagcatggtggtgtgcacctgtagtcccagctactcagaagggtaaagtgagaggatcacttgagcccaagggtttgaggctgcagtgagccgtgattgtgccactgcgttccagcagaaagaaacattctgaacctgcctcaaatttttacatggccaaacaaaatactgctcctgctccacttggagggataaacattagggccaagtcctcttccagcgccagcccctgcctctgccaccctaacaaataatgccccatttgccaaatggacggggacaaaatggagaggagattttaaaaacaagtaatcttcttttagtgtattaaggtgttatccacaatggggattaaattctcccaacccatgccaacagtggcagggcccccacgggctgaaaggggttcctcgcatcacagcagaagtcaggatcgcctgacacaggtaagcagctcctcctctctagttagccttcctaagtggccagatgtcaagggttaacatctacctaaatacccacgagtgggtagagaccctgattttgaccctagatcctccctcccacaatcagccatggtcatgagagcctcttcttagctttccaagtgagctcttcggggaattccagttctattcaattgacagactgggccctgagtgtttccctctgaaacagtctgctattaatacaggattttaaaaagttaaatagaagcaattatttggcataggcggcagtgacagtgaactcctcagaggacaggagtgaacccccagccccagggaagaactccacagagcccaggtctgcatctgcaggagcgagctccctcgacaacaaccaaccatcccccaacctgcatttttttgacattttttttccccaaaacaagcaaagattatttacataaagcatttgaaaatcaagcaacagaagggtgaactttgtattccaaataaacagcttcctctctgtataagtgacagagtgtttttcggagtggggggctattcacggtaagtcagggtctccacatggaaaggccaaggggggactcacggttggcaggtgagggtttgggtcggggagccctgggcagcagatggaagcaccacggggaggggaaaacaagactgaaggctgaagagcaggctgagcggggaggccttcattcaccttctcggtgctctctccagcctcaacaccttgacctcatgtagtcacatacctatgcaaacagcgcttatctggaaactattcctttgtttagacttggggccaaaaaattccaggcacagttactccagattttgctactgttcaccaacaagagagcccctgagtcttcagatctcactgtgccctttcactttccttttcaattaagcttcctgtacagctgcctcggctccttctcttagaacactctagagaactggaaatcatgtaattacttttgtctccaaagaaactagcaatgcagctgaggaaatgtatacaaaaggtttagatactcgaataattttcactttcatcacattctgtaacacccaaggaaagaactcccaaataaaaggaaggcaaagacccttcagtaatcatctggatttcctagtcagatgtctttccccactctgcaagcgagtctcacctctgtaaatatcctttaagacagtatgaactggatataaaatactatttctactctggaactgggactcaatttaaaaagtaaactccattagagctaaagattatcccaacatctacaacatttaatcctgtttgcccactaattcaaaataaacggctaaagatgtatttttatttatttatttttgagatggagtctcactctgtcccctaagctgaagtgcagtggcacaatcttggctcactgcagcctccgcctcctgggtttaagcaattctcctgccttagcctcctaagtagctgggaatacgagtgtgcagcaccatgcccagctaatttctgtatttttagtagagacagggtttcaccatgttggccaggctggtctcaaactcctgacctgagcctgcctcaggctctcaaagtgctgggattacaggcgggaaccaccgcaccgggcttaaaactgtatttatttattttttgttttttgagacagagtctcactctgttgcccaggctggagtgtggtggcaggatctcggctcaccaaaacctctgcttcctggattcaagcgattctcctgcctcagcctcccgagtagttgggactacaggcacgtgccaccacacctggctaacttttgtatttttagtagagacggggtttcactatgttggccaggctggtcccgaactcctgacctcatgatccacccaccttggcctcccaatttgctgggattataggtgtgagccactgtgcccggccaaagatgtatttttataagaaattctcgcaggggattgagatgaaaagggttggaaacaagatggtggccaaccccaagagctgctgtttatcctcttttgggggaagcctccaccacgtggggctcctgcgtcaacctgactccaaccccgcccccagcaacactctcctcccttttcttgttacatactttaaacaagaaagcctttcagtaatgctgcactgcaaggaggtgttgttaatgcatcacacggtttaatgtggccattctacacagaaagatctgtttgtgaatgtgttgtctttcatcaagtttacactaaaagacaaaatcaagacagttcctttaacatgaagagcagaagggaagtaggtcttctccaggctggcagctagtgcttcctgacagggccaggccacttggccacaccaacctcctacgccccatgctctgtattccgaccaaccgacgaaacctcggggccaccacaggtctttcactctgtttcctccaggccaaagtcgggctgcacctgcaggctggctcggcccagaattccatacaccatcatccagacgaacaggtggcctcgtgggagtcgcattcaggggcagtatctgccctggatctcagaggacggggtctccaatgaggaacctccaccacccgccctaggaaagaccctcattcaaaacaatttcacaacctgttagcattttagcataaattccaggttaatggaatacctggaatttcaaatcatgtaaagcaaagcaaaaaaaaaaaaaaaaaaaaaaaagacaactgagccgagcttcctgtttacagttagctagagtgacaaatgtggacaattttaaatcatggtgcccataccaaacaggcagccccctgagttatggacagagcaggggaccgccccccaccccccaatcccgcagctctcagggcgtatttcagcatcaggtagaacacacgtgcacacaacacaccacacacacccagggcgagttatgggtttcccctagagaggatatggaataaggttctgggggaaattccacacgatcgtccagttccgtctgtagctgtggttttacagatgcaaagcgtgatagtgctgaccagttctcctttccctatctctgttgtcttttttatggtgaggatgtggtgggggcacgagcttaagtgaaataataaaagtgataatatcatacctgtaatctcagcactttgggaggccaaggcaagaggatcacttgagtccatgagtttaaaatgagcctgggcaatatagtgagatcccacctctaaaaaatatttaaaaagtaaaaaaaaaaaaaagtaataaaaatgcaaaaagatcacactaatggcatggtttattttgtgctgtggttggagctagattctggaggccaaatgaggttcactctggcctctgctgcgtcagagctccataccttggccaagtgactgcacctctctgcctcagtttctccttctgtacagtgggatgatgcttctgacacaggagcatggtgagctctcatgagaagggatacaagctctatacccagggcctgggcacacctgatgccatcacatgccacaacgtgtgccatgcggggtactgcacgggcacaggcctgccctgcttcccacagccctgcacgggaggggcccctacacaacagacacagaccctgtggctcagagaaagaaggaagtgccctaaacgagcccagatccaatcagggtctccctggcttctgagatgggcctttccccagactaggtgggttataacttttatttaaaactttcagttccagctgatggttataccattgggagcctccatttacttagaaatgaaactgaaaacagacaactaaagcatgtccaggactcctggctccacaccatgccaggcgacatcactcaagtctccaaagatcaccaagtgtccagctcagctcctgccctcatcagcaagttttccaaatgaaagttacgttgaaagccacagttaccatactgtaaccagaattcaggcagtggctgctagcagagtatgatgaacaagagcaggtctggtataaagacagtgactttgcattccaaagcttagcttaggggaagaacaggcttctgccttaagggtacccctttgcttttggggcagaaagcaggcactttcaaaagggggcttggcatgaatgtcatgaaagggaggaagcgagcaggtgagggttcacctaacttgctttggcgccttatctattgagtgtccaagctggtgaccagtggtgccttagtggacaggactagattgtaacagccgaaactcttccggtgggagagagtttcatcatgggcacactctgggttataaatcgactgttctctctccaggcaacctcctggtgggtgagggtttcattctggagcacctgagcacatggttaggtaagctttcccggtaggcagtttctggtgaaagggaggtaagaggctataattgcatttctgaagggctaagtaaaaagtggggagcagggggaagtggagaaagaaaagagaaaaaaataataataaaccaacaataactcatactctttttcttagaaaatgggggtattcagggccaggcacagtagctcacacctgttatcctagcactttgggaagccgaggtgggcggatcaagaggtcaggagatcgagaccatcctggctaacatggtgaaactccatctctactaaaaatacaacaaattagccgggcgtggtgacacgtgcctgtagtcccagctactcaggaggctgaggcaggagagtcacttgaacccggcaggcggaggttgcagtaagccaagattgcgccactgcactccagcctgggcaagagagtgagattctgtctcaaaacaaaacaaaaaaaaaaagaaagaaagaaagaaaatgagggtattcggttacaatatttcctaaaagaaatgcaactctttttcagtgagtgacctgtcacagcacagttcctaagccctgattcacattcatctttttactgatgtgtggacctcagacccccagggaaggggtcatgaaaagcttctgaacccccacgtgccagggaagggctgtggctgaacctgcgggggaagggctggctctcaggtggcttgagatatggaaataggaatttcctccttctaggtcaaacattctggagcaaacctctcccaagacatgaggaaagacaacataggtagaaacttgttactcttgtgtaagaaggtaattgaagtctaggagaaataaatgcactcggtgcatgttgggactagaagagaatgcagagagagccccggagaaaagtttaaaggccatgctctgctgcctccaagccagccctcactggagcctgctcacagcagccgtgggcaggagcgtgcttccacacccggtctgagcagataccctgcaaggcaggcacccaggagaattcccttaggaaaatgccacagccctgcagggcctgctgcctgtgataaatatgtgtttggtctttgttcctgatgcctggcacaaagctctgaaaacccttggaatctcccgagagataagagcgtcttttgagaagagtgtctttttttttttttttgagacggagtcttgctctgtcgccaggctggagtgcagtggcgcaatctcggctcactgcaacctctgcttcccagattcaagcaattcccctgcctcagcctcccaagcagctgggactacaggcgcgtgccaccacgcccagctaattttttgtatgttagtagagacggggtttcaccatgttggccaggatggtcttgatcccctgacctcgtgatccacctgcctcagcctcccaaagtgctgggattacaagcgtgagccaccatgcctggccaagtgtcttttatatgctgacaaaagggctgttgggggggaccccagatagcaccaggatgggggctggtcacttgagaaactttgagccccacctccagcatcccactaccccacctccaacatcccaccactccacctccaacatcccaccaccccacctccagcatcccaccaccccacctccagcatcccaccaccccacctccagcatcccaccaccccacctccagcatcccaccaccccacctccagcatcccacctccccacctccagcatcccacctccccacctccagcatcccaccaccccacctcaagcatcccaccaccccacctccagcatcccaccactccacctccagggagggcagaggggctagaggtcgcattcaatcacctatggccaatgatgtaatccatcatgcctagcgaatgaatcctccataaaaaccctgaaaggatgggtttggggagcttccaaggtggtgaatacatcaaggtgccgggcgggtggctcgtccaggcagggcatgaagctgctggagtccctgccctccccctccgcccgcctaagcatcccttcgatgtggccgatcctgagtcatatccttcacaataaactagtaatagttagtaaactgttttcctgagttctgtgctatgagccgctctagtaaaatatgtgaacctcagtggggtgggttggggaagtctgccatctacagatagtcagaagaacgggggcaacccggagcttacgcctggtgtctgaagtgggggccgtcttgcgggacctagccctgggcctttgggatctgtgttaagtctgagtaatgtcagaatggagttgaactgtaggacacccagttggcaccagagttgaagaactgataatcggtgtgagaaaaacccccacacatttggtgtccaaagtgttgtgagtaaacatagttgagactgctcctggccgcagccgcggctgggccgggtgtggactctgcacttatctatcgttggtcctgtgggatgactcaagctgctccaagttctggaagaccgcactctgtgtagactatgcagagagggttttgcagatgaaccagatatttgcaaaggtgatgacttggacacaccgaggccttcagggtggcaggagaaagtccaagaaaaaggcatccagtgggcacggcagccagtttcattgggagagggacccacagggagactccagatggaacaccagtcaggggtttgtcggcggagaggaggtggggagctcaggccagccagtcctcggccttatccttccgatcagagatggcattacataacagacaggctgggttccggcggccttgtccctgtcttggctcaaatgccaaccacatgtcccttgtcaaggctgagttagaaagataggaagaggcaacctgacaccaaagtgtgagctttgaaagggaggggcgatgccctggaatgagaagttcctgtttcttttctacctcttatttgtcacaggtcctcaagttctgttacagtttttttttttccttctcaagaattatgcccagctgagggaacacgaggcggtgcagacacggaattaggtgtaaatttggagaccatgggggtgtgtggcttagataccagagaagaggaacaccactgtgaacccgctgccctacacggcagttctagggctgaactcaccgaacagtgttaacaaaaagaggccttgctgtcttatcatttttatttaacgcacgaacattaagcagtgtctcaccctggacattttacaagagattaagctggctggatgcctttgcaaaaacagtgccctaaaaatgtgtcatgtttggccaagatgctcatccaagaatggaaaaggccatgtacacaatccaagcacccgagggtgttctactcccaactgacccttcccaggagcccgggcagatcccaacaggacttcctccttgtgggtatgcataggatccaggctggcaagagcgaccaggctcctcctcccgcactcacagccccgtgaaaggggaggggaggggagggaacccgtctactcaactggtgggctcaccccacctcaaaggacagtgtgagccacagccacgacaaggcagtggcaagggctcctttcctcatttggccacaaaaacataaaagtcaagagctacgtggaaaattgttgcaaaacaaaacaagagtccgtgtgtgtgtgcttttcctccggcaggaaaaagcttccgagaacactgttaacagcagcctcatcccagcaggcggcagcaggagatagatggttaaaaaaaaaaaagtttggacatttttatttttaactttttaatgaccatgaactatttctgtaattatatcaaaacaaatacaatttaatcatccactttcaccaggtgaggtggctcacacctataatctcagcactttgggaggcagaagacgatggattacttgagcccaggagttcaagaccaacctgggctacaaagtgagaccccatttctacagaaaaaataaaaaaactagccgggcatgatgctgcatgtccgtagtcccagctaccggggaggctgaggcaggaggactgttgagcccaggaggtggaggctgcagtgagcagtgtctgtgccagtacactccagcctaggcgacagagtgaaaccctgtctcaaaaaataaaaaacagtccacttcctaaggctgcttttctgacactatgtatcaagatcctgaaacatgtgctagtccacttcctaaggttgcttttctgacaatatgtatcaacatccttcaaaatgcacgtactctttctcaagtacctctactcttctacttctaggaacagtgaggaaataaacacatgagcaaaaataacaacagaggtaggagaaaatattgagccccgcacaggcttggcattgctccatgtgctgtacctgtggtaactcactccatcctcatagcccgtctagggggtggacagtatcctctacctttacaggtgagaagccgagccacacagaggaagagaaagaacggagcaaggaaccatgctcctaaccaggacaacacggctgctgcttcacagccttgcctcgttttttttttttgcttgtttgtttgtctgtttgtttgttttttctgtttttcccgagtagagtctggctttgtcgctcaggctgaagtgcagtggcaccatcttggctcactgcaacctccacctcccaggttcaagcaattctcctgcctcagcctcccaagtagctgggattacaggcgtgcaccaccatgctcggctaatttttgtatttttagtagagacggggtttcaccatgttggccaggctggtctcgaactcctgacctcgtgatccacctgccctggccttccaaagtgctgggattacaggtatgagccaccgcgctggccagccttgactcttatgtgttcattcattagaattttaggggaattttagtaacatgggggaaagaatataaatggaatatagtgtaaattgtagcaaaaaataaatgcagaagcaaaagactggcaatgcacaccaacacatgaacagagctaatcaccagttcatgcaactactgtgtgtttttattaaatattcttctgtgtctttcaagttttcatcaatgaactcgtattgattttatgataatagcggaattcctatgtttgagacagaatggaaccatggcagcctgaggtctgaacttgccagagtgtgggagtatctgcaaactgcagcatgcccgtctgtgcttgctgaagcctgacccccacagccagaaaagttctgacactgagggccgggcgcggtagatcatgtctgtaatcccagcactttgggaggccgaggtgggtggatcaagtggatcagcctggccaacatggtgaaaccccgtctctactaaaaatacaaaaattcacagggcgtggtggtgcacacctgtaatcccagctactcgggaggctgaggcaggagaatcacttgaacctgggaggcagaggttgcagtaagccaaggtcgcgctccagcctgggtaacagagcaagactctgtctcaaaaaaaaagtcctgacaccttgaatggtgctgggaaaactggctatccacgtgcagaagaatgaaattagacccttatctcacacatatataaaaatcaactcaaaatgcatgaaaaacttaaatgtgagaccagaaactataaaactactagaaaaaaaaacatagaaggaaagctttaagacactggattgggcaatgatttttttttggtatgatccccaaaacacaggcaacaaaaacaaaaacagacaaatgggactgcaccaaaactaaaaactctgcacatccaaggaaccatcaacggagtgaagagacaacctacggaatggaatcccatatttacaagccatttatctgataagcggttaatatccaaaataaataaacaactcaagtaactcaacagcaggaaaacaaataacccaattaaaaaatgggcaaaggatctgaatagatgtttctcctttagatggccaacaggtctatgaaaaagggctcaacatcactaatcattagggaaatgcaaatcaaagccacaaggagatatcacgtcaaacctgtgagaatggctattagcaaaaatatgagcaataacaagtgctggtaaggatgtggagaaaagggaacccttgtatgctgttggtgacaatgtaaattattccggccattacagaaaacaatatggaagctcctttaaaaattaaacagagaactaccatatgatccagcagtcccactactgggtatactgttaacccttgaacaacgtgggtttcaactgcacaggtccactaatacatagattttttcccacctctgccacccctgctacagcatgaccaacccctcctctccctcctcctcagcctactcaacgtgaagacgatgaggatgaagacctttatgatgatccacttccacttaatgaatggtaaatagatttttttcttccatatgattttcttttccttttttttttttttttttttttgagacgcagtcttgctctgttgccaggctggagtgcaatggtgcggtctcggctcactgcaacatccacctcctgggttcaagcaattctcctgcctcagcctcctaagtagctgggattacaggcacacaccaccatgcctggctaatttttgtacttttagtagagatggggggtttcaccatgttagctgggctggtcttgaactcttgacctcgtgatccacctgcctcaccctctcaaagtgctgggattataggcgtgagccaccgcacccagcatttttttttctttttttgagacggcatctcactctgttacccaggctagagtgcagtggcttgatctcggctcactgcaacctccgcctcccaggttcaagcaattctctgcctcagcctcctgagtagctgggattacaggcacccatcaccacgctcggctaatttttctgtatttttagtagagacagggtttcaccaagttggccaggctggtctcgaactcctgacctcgtgatccacctgcctcagcctcccaaagtgctgggattacaggcataagccaccttcacaacatttttctctggcttacttcattgtaagaatagagtatataatacagataacatacaaaatatatgccaattgactacattatcagtaagacttctggtcaacagcaggctattaatagttaagtttctgtggagtcaaaagttatatacggatttttgatggcacaaggggtcagtgcccctaaccctcatgctgttcaagggtccattatagatccaaaggaaataaaatcagtatgttgaaaagatacccagagcattattcaaaacagccaagagatgggatcaacctaagtgtccatcaacagaagaatggataaagaaaatgtggcagatatacacaatggaatattagccttaaaaatgaagaaaatcctgtcatttgcaacaacatggataaacctggagaacattatgttaagggaaataaatcaagcacagaaagacaaattccacgtgatctcacttacaagtagaatcttaaaaagttaaactcaaagaaaccaagagcagaatggtggttaccagacgctggggagttggggacgtcggggaggtattggttaaaggataccaaatttcatttagaaggaacacgttcaagagacctattgcataccgtggtgactaaagttaataaaaatacattatatacctgaaaattgctaaaagagtagattttaaatttctaaccacacaaaatggtaagtatgtgacatcatctgtatgttagatttagccattccacacgtgtatatatatatatatataaacatcatgatgcataccataaatatgtacaattttcatcaattaaaaaaaataaattttaaaaacaaaataaagtcattgacacctggcaaggattgacaaatcatagctcaggtaaaggaagggtaaacaaattaaacaaagcttgtatgtgaaatagtgaaaccttaagaaatctctatacccttccatatttttaattattgtggtaaaatacacataaaactgaccatttaagccatttttgagtgcacagttcagtggcattaagtccattcactttgttgtatcaaccatcatcaccatccacctccagaacctgcatcttcccaaactgaaactctgtcctcactaagcactaactccccgctttcctcccccaagcacctggcacgcaccattccactttctgtctctctgaatcaggctactctagggaccactaagaagtggactcatacagcatttgtcctttcacatctggcttatttcactgaacataatgtcctcaaggttcatccacgttatagcctatgtcagaatgtccttgctttctctttttttttttttttttgagatggagtctcactttgtcacccaagctggagtgcactggcgtgatctcggctcactgcaacctccgcctcccaggttcaagcgattctcctgcctcagcctcctaagtagctgggattacaggtgcatgccaacacacctggccaatttttttgtatatttagtagagatggggtttcaccatgttggcaaggctggtctcgaactcctgacctcatgatccgcccaccttggcctcccaaagtgctgggattataagcgcgagccacggcacccggcctagaatgtcctcactttctatggctgaattctattccaccgcgtggacgagccacagtttattgatctattcgcccatcagtgggcccttgggttccttccacatttcagcagttatgaaaaatgttgctatggtcatggccatacaaatacgatgctgtttttcacttctaatttacatgtactatttctgtcatgtccatttctgaaattgtatttattaaaaggattacaattgaattacctaccgtgtaaggccacttttctggcaatatgaagtttttttaaagatggagtcttgctatttccacagccccgcttcctccactccctgtccagaccagccctgaacattccactcctctctgaactgggaaagtatcaaaaacaccatacagaaaccacccagccacaaagggatgaagtctctatttgccacaaatagagagggtgctcaccgcctgggaaggcacttccaaagcagcgggctccaggagggcaggcccacggctctctgcacctcagctcccaagagtataaaatgggcactggagcacctgccgcagggccctcccagctctccaggctgtgccagtctcagcatcccgcaccgctgccatgggcttcctcctgcaaccccagtactttccagtgacttcctcacactacttacaaggattatctaacagcgtggctccaggactgacgagggtatgcaggaaggagagctctcctatgctgctggggcagagaaaaccgggaacagcactttggtgactgactcaggaatacttggtcaagctgaagtatgcacaccagtgacccgccaggctcatgcctgcccttggggtcctccggtgcttgtctgaggagtcgggaggcggtgaacagacacaatcgctgcagcactgtctgtgcggactgagcatcccgaatccgaacatcccaaatctgaaacgctccaaaatctgaaactttttgagggccaatgtgatgctcgaaggaaatgctcactggagtattttggattcgagatgcttgactagtaaaaaaataatacaaatattcaaaaatccaaaaaaagatctgatacccgaaacactcctggccccaagaatttcaggtaagggatactcaacctgtactttcaaaaaagagaaaataatttcattatccagcaacaggagatgggtaagtgagctcgggttcatctggaatcctgaattatagttgaagcaaaatgaactacaaagaaaagaactacaaaaaccaacctggagaagtctcaaaattacggtgatctacatagagaaagcttgttgcaaaagtgtacataaaaaatggtaaaaatgttaaacacacaaataccccagctgtcacagggatacgtaagaggtggggtgaaggggctggcagcactctcctcagtctggggccacacaggcgtcccctccttgctgcctgctaaatggtacccacatacctaacttgataataaaatgcagacggagccataaagatcatacagcaacacaggtaacatataaacacaggttgaaaatgaaggaagagcagcccaactttacaagaacagtcatcactgtaggtaggaagaggaggaatggaggatggaacttcattatagatgatgctttccaaaatagattctttatatacacatatgggaaatgtacatgtgagttatggggaaggcgggaagcactgcttccttcttttccctcctaaagtgagaccataccatcatgtctaactgcaactctagactgtaagttacaaatcagtgcattcagcagccaacaagaatatactgtatttctccatgtggagctggcctttggatttgctagttatgctgaacataactggcaaataaaccatttttattaatggggaaaattcagagcccaagagtaagaaatatataatgataataataataataataataacaacagcaacaataatataataagtacaagggtaagatttgtattgaagagaaaatttcagctggtcatggagagtcacatctataatcccagcactttgggaggctgaggtgggaggatcacttgaaactaagaggaggtcaaaaccagcttaggcaacatagcaagaccccatctctgcaaaaaaaagaaattaaaaaattagccaggcacggtgacacgtgcctgtagtcccagctactcaggaggctaaggcaggaggatcatttgggcccagaagtttgagggtacagtaagctgatgcccctgcactccagcctgggcaacagagcgagatcccatccctaaaacaatacaaaacaaagccaaaaaagagagagagaaaatgtcttaggacttattacagaagcttttatgctttatgctatctgaccagtctagtaagtggagcacataaactgttagcaacaggaaaatgaattctacataacatctacatagttcatatacacataaatatatgtacataaatctagatatatcataaatatataaagtctacaacatgatgtgcatatttgagcaacagatatcagatgtcctgagatacaattcacctgttgaagctatacaaatcaatggttttaaatatattcgcagagttctacaactatcaccaccatcagttctagaacatttcatcaccccaacatgaaaccttcaacccatcagcagttactctccattttcccccaagagtccctcacccaggccttggcaacacgaatctcctttgtgtctctgcaggtttatctattctggatggttcatataaatggaaccacacaatatgaggtttttgtgtccagctttttctacttgacacggtattttcagggttcatccgcaccggagcgagtgtcagaatctcgctccttttgaaggcggaataacgtcccattatgtggacggatcacactttcttcatctacccatcagctgatgggccagatggttgttttgatttttttcctagtgtaagggttccgcattttcaatgattctaaacaaagcaaactccccgtccccggcatcaagttcacctcttcctgcagggaatgggctcctgggctcaccttctcctccgccgacctgagcacgctggagacctcctgcaccaccagctccagtgcctgctgccgcgggtcctcctcaaaggacaggaaaggtgggccctggaacagaggggcagcatgaggagggcatgcacaggaggggctgcatcttttaaattacatatctgtttaaagttctgaaaaattaagaaaatgtactaacacatctttctgtgaactctgtgcttctaatagcagcaatggctaaatatcaggagctctgcacatccaaggagcagctggtgatggattgtgctcagtgggcaggattcagttatgggagaaggctgggaaaggacaggaacccgggagtaaacctgaagatgctgcaggaaggcagcgaagggtgttttgaatcttcctgctgacagcataaggaaagaaacagactcttggggcagggctgcttcgtgcaaatcagaggatctgtgggtctagcggcgcacctcgcccagcacagagggctccaggctgtgtcctccctgttgctagggacagtcctctattctggtctaggagaggcacctctcctgttgcgtgtggttgctgtggtacgattacttagggtgccccccattctcctctcctaccccccaggggctggcctctccctgggatctgagagggtggccaagattccttggctggaaatgaacccgcctggtggctgcccacagagtagactcctcaacccctacttcacagccctctggagccacctggccccaaggttcacctgtgcccgtggctctgcatgttcccccagcatccttccaggaaactcggtcagctcatgtctgttctggttcttccagttaaaaatctccaagcaaagccaggcatggtggctcacaccggtaatcccagtactttgggaggccaaggtggaaggattgctcaaggccagcagttcgagaccagcctggccaacacggtgaaaccctgcctctaccaaaaatacaaatattagctgggtgtggtggcacacgtgtaatcccagctactcaggaagctgaggcatgacaatcacttgcacccaggaggtggaggttgtattcagctgagatcacactccagcctgggcgacagagtaaggccctgtctcaaaaagaaaaaaaaaattctccaaacgagagacgcacaattaaatgaacaggaccacaaggcaacaaggccaacgttttatgacgaagaacccagggcttatgtgaccaaccaagtcttgtccaagtcttgtctagctctcgagaggccaaacgtgtacatcaacaacacaatcccagatcgaaactctcctagaactctgttcctgacatgctgtagaaagcacaccgtgtttcaatgagctccgactgggtggttaaaaaacacacagccccacaagctcccatcgtatctcatctccaccgtggtgagctaggtccagctacaaggcgtgaccgagggtgggagaggggaagcggtgtaaaaccttgccgtggcgattccagcaagcatggtgcaagtgagcaagcgatgaggttacgctgtggctatttctcaagaatgcccaatgacccgcgtaaacctaaaggggacagaacattttgatttataggcttctaacctcacccttttcttacactgtctatctcatcccccaaaaatcagcagagaattaaatgtactgctcgagagggctgaaatcacagtttcagggctgctctgctggcattctctgtggtgggagcttgtttgagtgggacctgctggccagggccacgctctgagcttggtgatgagacggttctgtgcaccaggctctctggcctgagagaacagaacccagcacagaggccagtgccaggcagagaaccatgagcaggcaacatgccagccgctcggaggatgcagcggagaaacaatgtaccttctgtaggagcctaaagatacgctgttgccttataccagcctgggtgcagactcatgctcccctgaggcggcagatgcagtgtttaccctcttcccttgctaccttctgaattcaaaccttgaaaagagtttgcagccgggtgccacggctcacgcctgtaaccccagcactttgggaggccgaggcggacggatcacgaggtcaggcgatcgagaccatcctggctaacatggtgaaaccccgtccctattaaaaatacacacacacaaaaaaaattagccaggcgtggtggcaggtgcctgtaatcccagctactcgggaggctgaggcaggagaatggcatgaacccgggaggcagaccttgcagtgagccgagatcatgccactgcacttgagcctgggcgacagagcgagactctgcctcaaaaaaaaaaaaaaaaaaaaagaaaagaaaagagtttgctggaaaacttaaggtcaagggatggtctcacaaagaaaataagttattaagagagattgcttttccttttctgatctgcctagtccttgagtttcaggagcagggtgtgcctgcctgccacacacaaccacaaattcaggtatctctgcatctctgctgctgtgtcaatgctgacagaaccctcattccagaccccactccacttagactaaaggaagactttgtgtccacatagaaaaagaaacacacaagaattgccaggaaaacactgaaaaaggaagacaagggtgactagctccaccagatattaaaacagactatagaaaccccgtaattaaaactgtgtggctctggtgcaccaacaaacacatgcactacgaatgaacaatataaccacactgaaggggatgggaaaaacacggatataacctaagaagcttggaaaactgcatcttgactgcatataaatgctataatccagtaaatgtgtttcataggttgggaactcagaaactacttcatgcatatactagaactgaacacataagtagtaagtaaataagacagcaggtgtgcaatgtcttactcttggagaagggagttaagaataagaaagtgaaaaaactaaaatgaactctgtaccgttggactagaacccaaggtacaggatacaatcacggtttttcagataaacacagagagaaatacacagaaatatagacatgcgcacacacgttggtatacacacgtatgtttgctattgctgaacactgaaggggagcaatgagaaccaagaggtaatgaacacacttaatgcctaggtcttggtttctaaacacttctccaataaaaggaatcagggctgcttgaagaagtggctgaatccagggcctgtggggagccaaaaacaaatattttgtggaaacatgaagtaaggaaatgaaaaaaaaaaaaagtgggcttgatggaagaacacaagaggctactctcaaaggagcaccctgatggcccaaaggagaacaacctaagcaactgattcggtttggctctgtttgtaaccaccatgtgtcaagagagggacctgtaatcctcacctgcagagggagggaggtaactggatcatggggcagtctctcccatactgttctcatatagtgagttctcacaagatctgatgcttttctaagtgtttggaagttcctccttccttcttccctctcctgccgccttatgaagaaggtgacggctttccctaccatcatgattgtaagtttcctgaggcttccccagccatgtggaactgtgagtcattaaatgtctttcctttatcaattacccactctcagggaagtcctttagagcagtgtgaaaacagactgatacaacaatataataaatagtgatagtatgggattataacccacagaataaaatccatatccatgagtccatattgagctaaacaatcagataaatatctcattggaggagaaatgacagttctgtcttgcgggagagttccaaataataaagacagtaaggaagaggaaacagaaagtcaccatcaagagaactgcacctgcgccatcactgcacacaagatacaccaatggttgcgaaatcagtgaggaagagtttaaggagcaacgggctctgtacaggctcaaagcatctccccacactacctgttaactacagcaggaaagataaaggaggtgacatgatgtggatctgtgtccctgcccaaatctcatgtcgaattttaatctccagtgttaccagatgggcccggtgggaggtgactggatcacggtgcggggagttctcatgaatggcctagcaccatctccccttggtgctgtacagtgagtgagttctcatgagatctggttgtttaaaagtgtgtagcacctcccgcctctttctccccctcctgctctgggtcatagaagatgaccttcaccttccaccaggattgtaagtttcctgaggcctccgcagaagcagaacctgctatacttcctggacagcagaaccatcagccaattaaacctcatttcttataaaccaccagtctttctggcatttctttctggcaatgcaagaagggactaatacaggaggagacataaaatacaagaggatgaccccagcagaagtcaccttaaccaaggcaccaagctcagcatcctctacaacaagacacgctgacatcacaagccccagacacagtgcacaccacttctgtggtttgtgtaatctcgctccaaccatatgaaaatgccaggcaaatggaaagacagtcagcaaaataatgatcaacagtctttagttatcaaggtcataaaaaacaaagaaagactgagaaaccctgacagactgcaggtgatgaagaaggaacaactcaacgccacaggtacccttaatgggaccctagaacaatacaaggagacaggtggaaaactggtgaaattcaaagaaggccttcgcttttgttgttaggcattgtgacaatgttaatttctttttctttctttctttcctttctcttttctctctctctctctctctctctctctccctccctccctccctccctctctccttcttttttgagacggagtttcactcttgttgcccaggctggagtgcaatggcgcgatctcggctcactgcaacctctgcctcctgggttcaagcaattctcctgcctcagcatcccgagtagctgggattataggcatgcaccaccacgcccagctaattttgtaattttagtagagatggggtttctccatgttggtcaggctggtcttgaactcttgacctcaggtgatccgcccgcctcagtctcccaaagtgctgggattacaggcgtgagccactgcgcctggcctaatttcttgaactattacattgcattaatctccttgtgttatgaatcatagtaacatgccaccaatgttaatttcttggttctgatcattgagctgtggttatgcaaggttgagtgaggaatatatgaaagttgaattattttttcaacttttctgtgaaagcagttcaaaataaaaagtttaaaaaataagactttaaagagagcagcccacctttattgtctcactatgtcccaggcattttgctaaatgtctcacacagatctgatctcacctctaggagagtggattttgttttctggattgaatccagttttcccttctgcagatgatgcacagagactctcccaggatcgcacagctaggagggtagagctggagcacaaagcaaacccgcaaccagctccagagcttccccacgggcccttccacgggctgaagaagtgccttccctcctcagcaacctaccaggggcccgcgggagtggaagttagcgttgggggaattttagttgatgtgaacgctacacccacactttcctgaatccctgtcttgttgggagaatgggttagtgcaaagaacaaactgaactggcgcctattcctgggtttggcattgatgacttgcaaagtcatcagagcctcctttaatgttgatgctttagaagtgaaaaacaaagcacattaaacagcttgttttgcccaggcctggctggctcccaagacagaaggcctgagtccagatgggggaatgggcatcaccactgtttctcctcctccagaggcccatgattcaccccactgagaccagggcctgccccgagccggctttgtgctgggcactgggtctggctctgcccagacagcccctggctctgccccagctcacaatgccgggagctgaccagggcataagtgactccgggggggtcgggaggagggcagggcggggagcatcttggctgaaggggaggatcagggacctctgagctgagacccaaaagatttagagaagttaaataagcaggaaaaaagataagaattccaaacaaaaggaatgacccgtgggaaggcccacacaggaaaggtccctggacactggagcaacagaaggggtcacggtggagggtgcagggttcacagccccaaagaggcccaagttccttctactggaggagggaagggcagctccatggtccttccccacagtggtcaccacagttctaccaactggcttcctacaccacagccactgtcattggtcaaggagtttggacttcgtgagcacaactggaaggtcattatataatgcaaagactctgaagtctggtggccactttgtttactttttaaatgcagaaactcctattcaagtcagtgctattaataatatgttccaagtccacacagcatcttttttttttttttttttttttctttttttttacaaagaccataatgatcatagtcttgatcatttgcaattagaacatacctctaaagaaaccctgggctgaaggactaaagaaacaaacagcgttggggaccctcctagtccggggcctcatcccactcaggtgggccgctaccagacaagcccagagcacaggccacggaacacaggcctcgcttcgggacaggtgctgcccacacatggtccagacagcatcagccttgggaggagttctgggcagcccacgggcagcggccatcagaggcaagcatgctggatcccagagtcgaggagactgtaggacagcagtcccggagactcccaaggggatgttgggggtgtaactgattatcatggaccactttgtaaatattgatgtaatcgcaggggagcaaaaggaaaagctcaactgctgcttttggataccataatattagttctcagtctaaggagcctgacctgagactgagccagttctgggatcttctgttctgtgtgaccaaagagtgatcacatcaatgggaattaggggtctgcaacaccacaccaagtggagaggcaagagtcaaagctcaaacaattgcttttacgtggtgctgggtgaaagaggaactctatttacactgttggtgggagtgtaaattagttcaaccattgtggaagacagtgtgacgattcctcaaggatctagaactacaaataccatttgacccagcgatcccattactgggtatatatccaaaggattataaatcatgctactataaagacacatgcacacatgtttattgcagcattattcccaatagcaaagacttggaaccaacccaaatgcccatcaatgatagactggattaagaaaatgtggcacatatacaccatggaatactatgcagccataaaaaaggatgagttcatgtcctttgcagggacatggatgaagctgaaaactatcactctaagcaaagtatcacaaggacagaaaaccaaacaccgcatgttctcactcataggtgggagttgaacaatgagaacacatggacacagggcgggcaacatcacacaccagggcctgtcagggactgggcggctggggaagggatagcactaggacaaatacctaatgtaaatgacaagttgatgggtgcagcaaaccaacatggcacacgtatacctatgtaacaacctgcacgttgtgcacatgtaccctagaacttaaagtatcataataaaaaaaaaaaggaaaaaaaagaaagaggaactctgatggatggcaagtgtgtactagcagcttctcaccagtgattctcaaccatgggacactctcaaagtgtgctccccaagcctactgaggcggatgtggggggcaggcacgtgtgtcactaagctctctgggcaagactcctgtgatccctgcacacctggcgtccacctggccagcaggcagatcagcaatggtttcctccaaagtcagtgcaaatcactgtcacatataatttagacccctttctggagtgagggtgggaatccgaggtcccctgcaatacggggagtcagtgctgctgcagtggtcatcagagagcaggaggactcctccggtgctgaccagtccttggatcctggaaggtgcgagccccactgtttgggataacacattaacaactctactctctgagctcttctcgctggctctcatttaaaggaaacatttaggtctccaagttgatactgcatcccaccagggaacaggctgcagccaccaatgcgcagaccttggcaaattcctccagttcacgggcctcagtctccccttctggagaaggggcttggctagaagagtttagggtttctttccatcttaaaatacaaaggtggggtaaaacttggaatgggaggagttattgtctcaattggacagaaaattccacttttcagacagaatgctggacatgattaagttattaccagtgtcttctcaatccctaagcgacaggccaagaactggtctcctccctgggtaggacagagtgatatcaggacaaggcagaggcaggagggggagcactaagctgtagctgtccaggcgagagcgggcttggagtgtcagccctaatccgggattagtgggaatggaggtgggggagggcagccacgaatggacacagcagcccctgctctcccacaccgccatcactgtcacaacagcgatggcccaggatgctgggatgtgtgtgacaatcgctggactcggggcggccaggaatgcaaacaccactacctgctcacccacaatgccatcactgacacggcagcgacggctcaggatgccgggagggtgtgtgaccgtcactcacagggagcccagtcacccagatcctatctgcctgcaaaaccttccatttgaatgcaaatcaaatgacattcccaggcatcagggctgtgttcccccacccccgtccccaggaaagtaagcaataccaaaaactgacatcacagaactaatggactatgtccatgcaaaaatgccagagatggccctgggttgctttgagcatgaatccgggacactgttgcctcttccaggcaggaggtcaggagagacaggtgtctgagactgcagtgtgtggccaacagcagagagagaacagagaaggcgcaaacaaggtgagaccctctctcctctccctgaacgcaacccctccctgctcccacacaaagactcaagtaaaaagttttcatccaaaactttcaaatatttctttcagtgttctcagattgacttgaccagcctaagacagatgccagggacatcctcttctctgcctctcaacacttcagtcagatgggaatatggaaggatcatatccaagaggatcatattttctgaagccaatccatagatgtcaggaaacgaaccatcccaaatatacaggaggtagggtcactgcctctaagcctgaaactccagagttagaagctgaacttaaaggtcattcacccaacacttgcctgcctcctacaaaggacacagatgagactggtgcccaatcaagccaccagcctggaggggactcagcctcagaagccttgattccaggtcagtcaggggtcagtgatggcagcttcctggggaaatacctgcatttgctcctggatgtgaggccaacaggggtggagggctcccacaagagacagctggtttccctgagacactctccagctctggacagctgaggcacagattctgggcaccaggacaaaagtcagtcaactgaccctgaagcctttttcctccaaaaagtacagtcatttatgttctttttcaagagttcaaaacaaggtctcttgatttgttggatggctgctaactgatagtcaaagcttttttgttttttaattccatggccatgtcttccaaggccatgcacaaggaccaggcacagggcccgccatggaatattttgaaggttgatggggccggacattgaaaatgagcaattctgctatttccacagcgaatgaccactgagctgcacaggcatgtgcaggaaactgtggcctggaagggcggagcagcggccaagactaggggtgcctccccaaacccacccaggctccaacttctcctgtgaaatgcctaagaatagtacatgccaggagcttgtcgttatactaagatgtcttaaaagcaaaaataagtcaacgagtaatcagcgactacagaaacacccacaggactgtgaggcagcagaggtaagacacgaggcccttagcttgcaggccagggcagctggattcacatgccagctctgccgcccacgagctgtgtggcactgggcaggctgcttgccctctccgggccttggtttcctcatctgtaaaacagtgataacacccctgtcccgggagttgtgaggattcagagatggcagacgcaccgaaagcctcggtaggatgtctgcccagcggctggccctcagcaaacggtcactatttttatatgccaagaaatgcaagtctttggagataaattcttggtgaaattcagctctatgagaggcggaagcacattggggtcacagctattcatgtatcatgtgcaagctcagtaagtgtccgatcgggcacgggaattcgccccgggactccaggcaaggcaggtactggctggcgcggatgagcacttctgacggtccctccaactgccagcctgtccctcgcggagcccagggcctggagcacctgccgtttggagaataaaatcaatcactttgtcttgtctctccgtcaaggggcctcgctcccccgtctctctcctaactctcgaggatggtctgcgctggggggaggactcccttagcctgggtcaggggctgcagcgacgcctccaggaaagacctcggcccggaccgcccgccccggcatctgccgccccccggcccgcagtcccggaaactcacccctttcctctcggcctcctcgttcagggcggtcacccaggccgcctgccactggctcctccagctgcccagcgtcaggatccaggagagcagcgcgtcggaccccgggcgcggcccctctccaggctccaccgcccgccgctggggctggggtcgcgccctggccagcgcccactgcgccaggtacaggcctaccgtggccagggccgcgacgaagagcgacaccagcgcgagccactgcgcctccccgagccacgagcccagccgggccatggccatggcgcatccccggcccgcctcgccccaacttccccggcagccccgggccggaacggcggactcaggacacgcgctggctgcggccacagcgcgctgggggcgtggagggggcgcggcggggtcggagcccggcgaggagcgtggccgggggcctctgggcgggcaagcggggaggaaacgcgcggcggccgcggcccgggctgggcgcaagccccgcacacctgcggaacaggggcgcgagcggaccccgcggcccgcgctcccgactcggcgtctgggaagttcctgggccgctgcgggccgcgcttcctcctgcgcgcgccgccccgggcgtcccgcccgcggcccagcggtggccggaggaggctctggccgcggggcggggcggggcgggggcggtgcccgagggagggggcgcggccgggcctgcgggggccgcagtcctcccccctgctcccaacgcggcgtgcccccgcccccctaaaggcccggccttcccggccccgccacgtgcgcgcgtcgcccgcccctccggcgcctgcccgcgggccgcgaggtgacccgggcctccggattcatcagcccaaccccggcggctgctgtgcggctgcttggcttggctcgtgtgcgcgcttgcacaagtgcgtgtgtgtgcacatgtgtgagtgtgcgtgtgcacagcgcgcagtcagggtgatttcgaggactgccatttgctcgccagcgagacaggatccaggctcagtcctcggaaagtccctggaaatccgtggctgcccctggagccaggggctgggcctgccttagggggcgtgcttctcagaggcaaggaggggctcagcaccaggcccaggccctgccttctgtgtggctgtgtcattcattcagtgtgcgggtggggcgggggtgcatgtggtgtgatgtgtgtggcgcatgtggtgtgatgtgttgtgggtgtggtgtgtggtgcacaggatggtgtgagtgtgtatgtgtggtgcatgggtgtggtgtgtgtgtaagcgtggtgcatgtggtgtggtatgtgtgttgcgtgccagtgtggtgcatgtggtgtgtgtgatgtgtaagcgtggtgcatgtggtgtggtgcgtgtgtggtgtgtcggtgtggtgcatgggtgtgtgtacgtgtgatgtgtaagtgcacagcatgtggtgtatgtgtgtggtgtgtggtgcacaggatggtgcgagtgtgtatggtggtgcatgggtgtgtatgtgtgatgtataagtgcagtgtgtgtggtgtgtgtgtgtggtgtgtgtgtgtgatgtgtaagcgtggtgcatgtggtgtggtgcgtgtgtggtgtcggtgtggtgcatgggtgtgtgtacgtgtgatgtgtaagtgcacagcatgtggtgtgtgtgtgtggtgcatgtggtgtgtgtggtgtgtatgtgtgatgtggtgtggtgtatgtatgtggtgtgtcagtgtggtgcgtgtgtgtgtggtgcacagggtgatgtgagcgtgtgtgtgtggcacatgggtgtggtgtggtgctgtgtgtatatgtattgtgtaagtgcgttgcatgtggtgtggtttgtgtgtgtggtgaacacggtggtgtgtgtatgtgtggtacatggatgtggagtgtgtgtatgtgtaatgtgtgagtgcggtgcatgtggcgtggtgtgtgggtggtgtgtcagtgtggtgcatgtggtatggtgtgtgtgtgtgtggtgtggtgtgtgggacatgcccctgtgccctcctcttgcagagtggacgcggtccttagggagtgccatagaaacatactagcctgagattctccggggcctaaaacaggcctaaaccataaaaaagtgattcccctgttattttctgcagctgtattaaggggacttgaccttgaaaggaattagatagactgagcatttggccttctcttccctagccaggagtctgctgcggggccagtggatggtccatcagaggggattctggccctgaatccgtgggcccggattttcttcaggaaagaggaaggaatggcacagcagctggacggagagcctttgtggggaacaggataggacgctgtcagggaggtgaaattagacggggattgcccaggtgagctggggatggacccttgcgagccaggtctgttatcagaaagtggaaataagaatgagactatccatcctggctaacatggtgaaaccccgtctctattaaaaacacacacacacacaaaactcagccgggcgtgatggcggtcgcctatagtcccagctactcgggaggctgaggcaggaaaatggagtgaacccgggaggcggagcttgcagtgagccgagatcgcgccactgcactccagcctgggcgacagagcgagactccgtctcaaaaaaaaaaaaaaaaattaagaatgagaccatcagcatcctgcaagtgacccatgtgttacacacgagcgctccagtctgccgcagcctcttaagggtggggggaactgctcttcttttcttctattctgtgttattttaggcagaaacaaaagaaatcccttcttatttggcagaaaagtctaattatgttctgacctgtagctagacctatgcagtcagataattcgagtcctgctggtccccttgccagaataaccggggtgaggaatccgagggcccagtgttccccgtgccatgtgtgcacacaggccgcctgcggctgtgtgggcagtgacgagagcctgtcctgtgtgaccggtggaacccgtctcattccttcaggtctcaggtgtgctggcccatcccacttacttatttagaggcttgtaacaaactgtaaactaaccagcacccctagtttgggatttgtcacacttccatgtgacaaattttcttttctttctttctttaatttctttctgtattttgaggcagagtctcactttgtcacctagactggagtgcagtggcacaatctcggctcactgcaacctccgccttccaggttcaagcaattctcctgcctcagcctcccgagtaactgggactacaggcgcctgccaccacgccagctaatttttgtatttttagtggagacggggtttcaccatgttggctaggctggtcttgaactcctgacctcaggtgatctgcccacctcagcctcccaaagtgctgggattacaggtgtgagccactgtgcctagccccgttaagtgttttcaaagataatgtcaacatgtagatattggattacttacgtgtagaagcaaatcgagggaaaataaggaatgatgcaggcttgcaggacaatgcagttggccaaaacacgaaatcggaacagaaacatcttataaatctatgaaaaagagcaggctccctttacacaagctcccagccctacacatccaccaactcccagtccccttctcccactgcagaagacactggagggctgggttctcccagagcacaggattctgcctcacccccagtgacatttcctgctcccggcacctctctctccaccacatctcccttccacccaaggagtgagactgcagctctgcccggggagggcttctgtctccaccaaaaccttcaaatgggtctctgtcactctgcagtggttgtttgctatttttagctgctcataaagggaaagcactgtggctgtggcccctcctgcatgctcaccttgagctcccagctcccagctgtttaggtcaagctaagcccgcttcccatccatctgctgggtccaccagaaaccttgaaccagggctgccttcgctagcatggcaggcctccaggcgggaaggaggaagccaagtgtctaaattcttcataatgctttacagtagctgggtttgaggccacagtcaagagccactgttctatttttcactttaaaacatttctaaatgctggtggtggagatgagaattgtctgttggatgatctctgctgagtcacccagtcttgggtgcagtgcctcatccctgcctcaaagctgtaagtctttgaacgtcttcctctcccaagcccaggaggttctgggatgctgtgacatttttagaaattaatagatatgtctagtgtcatgtatgtcatgtatcgcacgtctataaacagttatactttgttatacttttgggttttaaaaaattcttttagaaaaatgtgggacttttgttaagttttcaatgtcattcttaaatttctagaagcagggaaaagaagagcgtccaaaatgtttatagtttgtctctgagtgaaaagtttccccttcaccctgaagcagttcacattattagtattgcttgaattatcaagttgtgccccaatattgtgagaccagcaccttgggggccccggggagctgtgatggtcacttcacaggccctaccagggacctctagcaagtggaaatacacagcttccccccagcagcacttgggggcagacgtttcgagaattccctcttagcaaaatgcttttagcacttggctcagtgccctcggcagctgctgtgggaagcgagatttctggagaccagagaggctgtggagacatttgacccaatctccttggctccatctcactggcttagtcatttccaccacctggaggctggaatgtgcttcgagtctatttcctgtactgctcacagggtcaataccggagccggcggacccaaccaaaggtcacccgtggccagagcctggcccggcgccagacagggctttccccccgaagaggggccgtgagttcttctagtaatcatttgcatgacttatggagatgctgttcatgatgccttccccaggaggaaagcagcaatgctgagtaactgcactaactccccaggtgagcctcagatgccgcgtgaacagtctctgagagtgaagaccagactgcacgtctgccgtccctcccaggaccgactgatggaaatggtagtgccatcggctgagcccctgccaccctcttgctccctcccgggtccccacagatgcaccaggcaccctaagtcaccttacgggcgttcagaaagtcatggctgtgtgtaccgagcatttcccaccatcagataccacctgggtactcaacttcatggactcgcttcattttcacagcaacacgcaaacgagagcatcgccccattttaaaaataaggaaactgagttcagagaagctcagtaactatccaaggccacccagcaagaaagtggctgaggcagggtttgaccccaggggccgtgttctctccatctcctttcataaaggtcaaggcaaacaaattctccaaaaagagaaaaatgttaaaagctggaaatagaggccccattgctaacattcatgtgcaaagatctgcctgaagaattgtcttttgtgttctgaagtccaggagacatggcctctcaaacccagaggggaagttcactcccggagcttctgtgaagtcccaagtcctttctgggaaagacgagagatgaatccagccctagcatttgccgtgatcagtgtctctgcacaggcgcccacctaggagagcctcccagggtgtccaccacccaccctaacagtgaacagcagatacgctgctccttcaaatcccaccctggtggcggctcctcagggaccctgagtcacgccatgatgctgggaggcggccgggcagcgtcagaggcagggcctgccagcctgctgcaggccagccaggcctgccaagagtctgccccgggcaaccccgatgatgcatcctgcgagtctgtgcccatgccgggcagacgaaggaatgtggcccagatggctgccctgcctctgccaggtggcttggttaagcctcccttgggaatgcccaggagcaaggtgacttgacatttttgcctgtacccaaggctgggaccaattttatgaatgaaaatatttaacttcgattctttttttgtagaggcggggtctcactgtgttgcccaggctggtcttgaactcctgggctcaagtgatcctccatcccccatttttttttttttcttgagacggagtctcactctgtcgccaggccagaatgcagtggtgcaatctcggctcactgcaatctccacctcccaagttcaagcgattcccctgcctcagcctcctgagtagctgcaactacaggcaccccccaccacgcccagctaattttttgtattttagtagagatggggtttcaccatgttggccaggatggtctcgatctcctgaccttgtggtctgctcacctcggcctcccaaggtgctggcattacaggtgtgagccaccgtgcccggcctccgcccccaatttttaaatatatttccaaggaggccgttgcataaattgtctattttctccaactccaaagaatgctggtcccacacctatgcactgataaccaaaatcacactgttgcaggaattgacctagaggaattgacctcatgatgtgttcctgggccgggcccctgtaatcccagcactttggaaggaggccgaggcaggaggatagcttgagctcaggcattcaagaccagcctgggtaacaaagtgagactccttctctattaaaaaaataaaaataaaaattagccaggcgtggtggcttatgcctgcggtcccagctacataggaggctgaggcaggaggatcatttgagcccaagaggttgaggctgcagtaaaccatgtttgcaccactgcactccagcctgggcaacagagcaaagaccttgtcttgaaaaaaataaaaaaagatgtgttcatcatgtagaagttgagtttgtaaggatgtgtcaggtggcagcaggagtctggagagagggtgcacggaggaagagagagatgacttcgctggaatgagatgacccctccccatgctgagactctcaatgaatgccatgcacagcctccagctaggggtggccacagcggggccttgctcgccttgctcgctggggacagcccctaggctgcaggactagagttgctcctagcttctcagaacctgcgggatctgcttctgcagctccagtgatatggccgttcccagcactgactctggaataacacttgatctataggcggctccactagaaaagagccaagccccgcaagtcagaggggtctccccttacccaacacaggacacaggaaagctgcccttattccctgcaggacaaggcacatttcttgtaattagtgctttgcctgtcttctgggctacagttttcctttctactattgtttttattgagcacagtgagtagaaccaactaaatatctggagggatatttagtctctttaagagttaaaggaaatcccattaaagggcttttaaaaacaatccaggagcatgcatttatctacacataactaagtactaattacaaataattattatatattccagtggttaccccaaatagtgcaataaagacgaagggaataattttcctgctccaggaaatactcatgcttctgtttgcctagtactttgtaagaaatcctataacaagtaagaggcaggaattatcacccccatcgtgggaatgaggggtggaagcttagagacgctgagcaacttgccaggggcaacaacaacgtggttggggttagggttaagaggcggagctagacctggactccaggtgtttgctgcgtgatctcccatgttgcaccaagcagcgagtctatacgacacccccatggaattagagaagagcagctcattgacacagatttattgcaatgcgtcatttcccccgatttcgatggatcatcatctcctctagctactcagagcagggagctgggactgaactatagtacgtgaagtcattgtgtatattctcttagtgtgtcatttccccgcggagtcaccttccagaagctctgccagctccagctcatggggcccgagggagggatggaccctgcagagtgggcggtcaccactatcggggcatccatgctgcctgccagtccagccccttccccagcttgttctcctgtccagtcggctaaaggggcaacgaagaggaagccagagactctcaggaaggaagcagccccagctcctcctccgggctctccttttgttagtattatggcaaaaaccacaattacatttgcaccgacctagtagaagccccaggtgacagggagaggggcactggtgggtcccagtgggagagaaaacagcctcacaagcccttctctttcagtctgtgaagcgcatcacggcctccctcgcaggtgggtgaggcgtggctgtcctcatgatcctcacaactgttgtttgaaccaggtacctctgtgtccagcaaaggggtggggactgtccccatctcagggcgctgcatagactcacaaaagcagccttcaaaaggcatggctgggcttgattttaaaaggagtctcaagtctctccccgaaaaaaaaaaaaaaaacaggaaaagggtggccaggttaagcccgctgggtccctggtgttctgaagcagggcaggcttggtggccttctgtcactgagaagcagggggtctgtagaaaggaaaatcacagaaaaagaaaactgtaggccagaacacaggctgttgctgagccgctggacgctagccccacacattgaacagtgcccttcaaaagggaactggagaaagaatgttccaggattaaaaggtgaagtcagggaagctgcacaacctcataaatccatgcaaacattcctaaaaaaagaaggtgtcttagttcaggccactagaacaaaataacatcccgggtggcttgtaaacaacatttatttttcaccaggctggaagtctgagatcagggtgccagaagggtcaggttctggtgacgggttgctgactgccgccttctggttgtttcttcacatggtgcgaagagagggagggagctctctggggtctcttttgcaagggcactaatcctattcacgggggctcaaccctatgacctcagtgtcacttcccagaggctccatctcctaataccatcacactggaggtaaggacttcaacatgtggattttgggggaacatgaagggtcaacatgtgaattttgggggaacaggaagggtccttcctctgcaggggatgtcagggtgggaacgctcagggaacctggcagaggaccctctgtggggcaagatccttagtcggtgcccagagactccttggctaggctgctccaaggaacgcaggttccagggcaagtccgcagaaatagcgaggaaccgggttaaagcacccagaatctcagccagtgcaatggacgctgggctgtccaataaatgattgaccaaagatcctttaaagggaattgaaaagatgaaaaagaaattagatactgccacatttttattttagccctcatcaaaatgccaaggcgggcagatcacgaggtcatgagttcgagaccagcctggccaacatggtgaaaccccgtctctactaaaaatacaaaaattagctaggcgtggtggcacatgcctgtaatctcagctactcgggaggctgaggcaggagaatcgcttgaacctgggaggcagaggttgcagtaagccgagtttaccccactgcactccagcctgggcaacagagcgagactccgtctcaaaaccaaaaaaaaaaaaaaatgctatgaggtggatgaaacagatgttattatcactgttttgcaggtgaggaatccgaagtcctcatcaaggaccctccacttattacaaattcagctgggactgaagcggtgtgtccgcagcttggacaccaaacaggcgacccctttactagctgagaatacgcctctgtgaagacaagtgactgcaaagcagcgaagcctcagtcctgagagcatttttctaagacatcagttccatcagatatgtctttgggaatcatttcatactcagccaagtgttagaaagggctggttggcattatttgctccaataataaatccatgtgcgctaatgttcgtcaatgctgctctgcagggagaagtcaaagcacgcaagccaggcctccatggggaggcccgagatgactggagggtttgtgcctaagcatttgttcagatgcaataatccactactcttggggagaaaatgatccttttttaaaaattattttgtctttttaaaaaactgatctaacaaattttgcagaattgaaggagcaactgaagcaaagttttcttgttgatagaggtgtgtccggtgtgcagatgtgtcctttggagactgggtcgacatgtcgccatggcactgtgcctgctccagtccctggccagccctccatctgtcagcgacagcacacgaggtcctcctggacagagagtatccagtactatggacactgtggacacagaaaatgcttccttcctctctaaatctccccaggagggctccctggtgaggcccaagggaggtgatccagacagccatctcctcaccagagcttctcctcccccctcaaacgatggagagaaaacatggagatgcttcttgccggcaggtttataagattcaaagcttctggtgagaagcagagacaaggtagtatccttctgtgttggggagagctggccactgctgatgccatagctgagagtcccctgcagaagctgtcccaggaggccacaggaggggttgtcctggtgcatgccgacggtagcagagctgctactcctgccggtccgtccctggtgtttaatgagcccgtcctgagatgaaggagggaaagtgggggcaggcaaaagagagaatgtccattgtgccaggaggcatccccgccttcctcctgtagctctgggaccagctgcaagaaggcaaagtatcataccagccttttgagaggggaggctcagaagcccatcagcagacgaatgagcagacagaatgcggtctatccgtgtgatggaacattattcagccgtaaaaaggaatgaagcactgacccaggctacaacacggtgaaccctgaaaacgtgatgctgcgtgaaagaagccactcacaaatgccacacgttgcgtgattcaaacgccacacattgcatgattcaaacgccacacattgcatgattcaaacgccacacattgcatgattccatttacatgaaatgcccagaataggtgagtgacggggcagaaagcaggtgagtggttacctggggctaggggtgggccgacagggagtgactgctgatgtgcacagggtttctgtggggggagatgaaaacattctggaggactagatggggtgacggatgcacagcctttgagtgtgctgaataccatcaaatgatacactttaaaatggtggtaatggtacatgtaatgttatgtgtatcttaccaccgtttaaaacagagcttgaccggttagtttaacaaatattatgagtggcttttgttatgggccgggtgtggtggtttgttcactgatttggcaaatatttgttgagcagctgccgtgtgtcaggtgctgggctaggtgctgggggttagtgatgagctaaatcaattctcatgggacctgaactcagcagaggagacagagggactattccacaagtaactgtgtaaactgcatgggtggcagggcagccgtgcagctaggagtagtgaccaagaagagtccaaggaaagccctgcaatgccactggatagtgggcagggggctcaggcaggactgcaatgagcctgtgggttttgttcctacagcaaaagaaaggagtggctgacttggcagagaagagatgaaatcatatttgcatttgaccaagatggagacagtagggggaggaggtgggtgacctggaggctcacctgggatggtgagccaggcccctcagggggtggtgggtgggagtgggctgtagaggttgccatgcaggggtctcccttaggcagcatagtgggtgtgtggggcaaggcttgtgagaaggggccaccccagcaaggataaagcgatgcctgcccacgggagtatcacgttggtctgagatgcaagaagaaagaaacggagaggaccatggagggggctaagaaattctaaaggcaagaaacagtcagggaaaagaaaggattccacggtgggggtggcagagaccgagtgctgagccagcgccaggcgcccaccctgtgggcacatgttataaagcagcaccatgaaatggaacggcgaggctccccaacaaaacagactctagaaactgatggctgggtgtgaacataacaaaacactgggaagggacataattagtaaatcttgggatgaattatcaaatgggaagagaccagtgaagtcaaccaggggggcccaccatgcgattgtccgggtgaggaggggaggttgggcgccttccctggcatgcaggttgcccccatcctgcctccagggctcagggctctgagaggacatggttgcagcatgaagggcatgggctttgcctcctccactgtagggtgggagccagtcctgctgcaaagagccgctatggggttggaggtcacacatgtgcacagacatggcgcctggcccacggcaggtgctccatacagcacaggaataatggcttcgttacacagagccaagaatagggaagaatttgttttgctctaagtgcaaccttcacgccaagcatatttaacttcgatgaataagcagcaaaaacaaactttgggttttgttcctacagcaaaagaaaggagtggctgacttggcagagaagagatgagatcatatttgcacttgaccaagatggccccaggagataatgggaggaagggggtgaccctggaggctgatctgggatggtgagctggccccctccactgtcgaatgtttaaaaaacattaaaaatgagtcaaaaggagaacagaggaatccgcccctagctggtgatgcttctttttgttacatacaagtgaagagagtatagagagtcattcattcattcatgcagctcatctggactgagcatctactgtgttagagagaccacgtataaatacccttttaaatgtttattcagtaacgaagatattcctgcttctgacttctccatccaggtcttggaatcaccacctctcacacacacacccaggaatcatctctgtaccagcctccttttctctaacctcgatcccatcccatctgaccaatcagaaaccaaatcccaccagccttctctctgtgatcgaactgcatcttctttcttcttccccactgggtccatctgctggctctctagctggaagcttctccacaccaccccgcacccacctgccagcccagctgccgggactttggaacagacctggctgtggatccccctggggggcttccaagctgtgtgaccttggacatgttatctcgccctcctagtgttcatcttccccatcaataagacaggcatgaagctgcctagctcaccaggctgtggaaaggatggaagaccacagcaggaggcgtgaagctcctgcatggtgcccaacacaggcgagagggcaggtaaggtttccggggcctacctcatgcaagtgtcacccatggctacttaggaataatttctggcactgggctcccctatgttccctccacatacacatttaatcaccttccattccccatcccccagacctgtcccctagatccttggccagtgctctttgccacagtttcccttcccttgggcttcatcctgctgaagacactgctgacccggctgcctgcagtgacctgcaagcctgcacctgctgcttcctgaactctccttaggtgctgcccagagacacctcctctatcctgtggaatgtcatggggacctggattgctatttcagatttcatgtgtgtgcctatcgccccggctggactcagttccttcaggattaggaccaggccttatggtcctttgaattcctcctcaaaaatctgcaggttttccagaaacatctcttgatttcaattagaggtttgtagctctagcaccaaagttaagttggatctagggctgctgtttgcaagacgtacttactaatccaggtgggcacaggccatgcagcagccaggccctccagtgctgggctggggctgccctgccccctcccctctcaggatcagtcctcccgtggagacggggtgtctttctggggtgcagaagcaaccactcactccttggctttgaggcttcatgagaccacagggaagcgctcaagcccctcagcctggaaaacaatgccaggcttcctttctcagataatccctctgatccctgcccccctgaccctccacaggcacatccagcctcctgcagggctcctcagaccccaacctgcccagctgttggcatcacccctaccattttctgcctgcagatccctctccctcctcacctgaaaatctctctcctccctccaagaatcagatcacggttaccccttagcagtgtgagaaataaactcacctgtccaagcccaaagaacagactcagagacctggagaacagtgagagtgagacttttttttttttaattgagacggagtcttgctctgtcgcccaggctggagtgcaatggcacgatctcagctcactgcaacctctgccaccccagttcaagtgattctcgtgcctcagcctcccaagaagctgggattacgggcctgcaccaccacaccctgctaatttttttgtatttttagtacaaacgggtttcaacttgttggccaggctggtctcaaactcctgacctcaggtgatctgcccgcctcagcctcccaaagttctgggattacaggcatgagccactgagcctgtgccattgggcctgagagtcagactcttaatgatggtcttgcaaaatcaagtgtctgatgggcagaaacacccagcacggttttaacaagtaatttatcccctggtgtgcaggtccctcccctgcttcctcattgctgctagtcattagcacaccgggggtcacaatcttcccagacgtcgcctattggttgttgggcagggacttcaggtgttttttttttttttttgtaggattgtactgctgcactttgttgcagcccacaatgcattgcaatcgtagttagctcaagggctcttcaagtatttaatttatgaccgaagtagccgggcaggctggtaagaacagacaaagtgagctattttgaagggtagtaaactttcgtcttagactaaacttttttgcttcgggtgacagcaactgagggcagaggcagcagacaagcaggcgttgacgatccaagcaggggcctagtgtatcctgtttcttctgtagtttgctgacctaagctgattcaaggcgctttgtcttggaaatggagcaccgtagacatgatctccttcagcaggaagtgtcacacatggattaacacccctgactccaggtctgactgtttggcgtcaaattctggctgctgtgattttaggtaaatcatttcgccttgctgcccctcagtttcctcatctgtaacatgggaggaatgagactgcccacttcttacagtctctgtgagaaccagataactaataagcacatgtgcaagcacagggcctggcacaaggtcacttccatctgctctcggtgtacagtagacggtcaccccaagatcaggtctgtctccttccctcactgtcttgttccacttcatatcccagcatgggatggggaactggtcagatggggtagcctcaacagatggttgttagataattgaataaatgggtgaatgaatgaatgaatgagtgaatgaatgcaaatgacaaaaaccaagtagcaggttttcttttctttttttttttgagatggagtctcgctgtgtcgcccaggctggagtgcagtggcatgatctcggctcactgcaagctctgcctcctgggttcacgccattctcctggctcagcctcctgagtagctgggaccacaggcatgtgccaccacacctggctaattttttttgtatttttagtagagacggggtttcaccatgttagccaggatggtctcgatctcctgacctcgtgatcctcccgcatcggcctcccaaagtgttgggattacagacatgagcccccgcgcccggccgagttttcaagtgcaattttgtttggagtcccagaatctaaagtcaccctgttggtgaaaaatatgaacttcctcttgcatcttactcagggcagggggttagtgggacaaaagctgctttcagtctcctggccagtgcctctgagtaacagcccttttgtgaagggcagaaaggagagtgtgtagttgtcaggaatattcaagcagaaccaaagctgacatcacgcctgtaaatatgcatgcatgcccacagctaccctggtattggctggctcagcctgtgcagtgataccacacacacacaaacacacacacacagctggttgtccctaactgctgctagtcactagcacaccgagggggccagggtcaacatcctcatgaccgttcctagtggcttccacagagcggggacacaacagcaaatcagcgctggcgagaggtttgcagtgcagaattcatccaccccctggagctgggatgttagaatgtgttccccaattcaatatgcttctatttaaaataaatacaatcttggcttcaaaatcatgggtcatggcactgctgtgtctggaggtaggaagcctcttcatcagggcagtttcaggccattcatcttgctagagtgtggataacacacatcaaaagcaaagttccacatattacatttattttaaatctataaagatggaaaatgattagaataaaggtgccagcctatagttagctgtttctagatattcttttgtcctcggcttagatgtaccacaggaggaattgttctttcttcttgctcccatttcttttcttggagttagtggggtaggtctcccactcgtgacacctgcttcatgcctttttgcaccacacagagatggtggtagtggccttggaggctgcagtctcttagctctcatgactgctaccacatttgtgttcagttgctcaggccgttcactgcacaaggacacctggcagaaggagcagtggggccagtgtacctcctggtggaaggctgcatctgcctggaggaaggggtgtctttttaatgcaggcagaggcctgtccagccagcggcagccctggctccctcgtcctcccgggagtaccatggcactgcactcaggggcttctgaggctgctgtgctgactaggaagtctgagacccccagtgatgcacaagaaactggggctgggtggtctgtcagccgacttcgggggagctgtgttcaggagagaagggcttgggaaagctgtgctctattccatgctggataaaaggagcagagataacccggtcagggtcatgggtagaggccatggagacaaacaagacagaggagatgagctgcagccgcctctagctggaaacgcagtgcagaggcgcccaggccaaagcagcttctgttcacaaaaagtctccccgaggccctgcaaggaggagcaggagccagtgctcccctctccccgctgggaggaagtgcctgcctgctacccaggcaggggaggggcttgctggcattttcccaggagcaaatgcagcacagaatgggggttccttaggccccagtcaatgaattccaccaggaatgcggtgagacctcaggggcagaggcccacagaggacatcaggcatccgagagacggacacacgggggaaaagggcatttccaggccctctgagcagtctctgcgcttgcatgacgttagatgatgaggaataaaaacccaaaccttatttcagcgctgcatggaaagaatttccctgagctgatatgaatgacataccttctgcttttaatgaggtccagtataaagacgatttatgtgaagaatattttggtcttaaaagactctgttattttggccaggtgtggtggctcatgcctgtaatcccagcactttgggaggccgaggtgggtggatcacggggtcaggagatcaagaccatcctggctaacacgatgaaaccccatctctactaaaaatacaaaaaattagccgggggtggtggcgggcgcctgtagttccagctacttgggaggctgaggcgggagaatggcgtgaacccgagaggcggggcttgcagtgagccaaggtcgtgccacggcactccagcctgggcaacagagtgagaccacgtctcaaaaaaaaaaaagactgttgttttaccaaggcccctttagtttaaagtgtataataaactcttcctttaatattagttggagtttgtctctccagtttaacctgaaaggttactgtgattgggcaaccatgaggcagtttccccagatgcttcttgatcaacagctgttctgttccaagggcctgctcctgactggttttgatcagctcttggatttttatttttattcattttttttgaaacagggtcttgatctgttgcctaggccggagtgcaatgatgccatcttggctcactgcaacctctgcctccagaattcaagtgattctcctgcctcagtctcctgagtagctggcatcacaggcgtgtgccaccatgtccagctaatttttgtatttttagtagagacggagtttcaccatgacggacaggacggtctcgaactcctggtctcaagtgatcccccgcctcagcctcccaaagtgttgggattacagatgtgagtccctgcgcccagccagttcttggatttttagtcgttctggtttatatttggttgactttgataaggctccttataaaagggcacgaccgataaaccaaagtgtctggattattacagaaaataaaattcaggtaagagccagatgttggctgataaagggagtgccaggaaccctctggctctgtagattgtgccagagcctcagggatcaccggccgagccggggctgcaccctgctgctcagtcttctcttgtcgccctgggagagggagatggtgggattgggccgggggttaggagacagtgccacaacaatgctcttcgaaatcaaacatgcgagaaagcaacgtttaattttgtttttcatttggcgtattcacatttccgtcttttgcttttggtccatgtttgctctcctttctgtgcttgtcacgggcatctggtcactcccggcctactgcattcctactctttctcatcccagttcaagcgtgttccccaggccagcctgccccttgcatctctgccaagacgttgtttctcacgcacctgggaaggtgtttcacatgcccgaacacgctgagggtcagatggaccccagggtctcagccggccgaccctaacttcccaggctgcatgtaaagccgttgtgcagagtcttttctggaagtagagcctcttctccactaagttattttttctttttaacttaggccttgcccacgagatacttgatagtcttccagcttttattttatctgtccactttgatcaactttgatcagcatcagcatgatttcaaagtctttgtcaagaaacagacgctggcgttggatgaggcatgggaaagatgaagagagttggctgagaaggacgtggtccccagccctgttcttgaggctgggtctttagggggccaggaggtgcggagctgaacgcttcccgcctgaggcttcatccgcccgcaagtgcatcaggactctgcttgcaaagcgacgatcatttcctgggttatcagtctggaagctgcatccacaaagaacaggaggctgttggtttttgctcatgcattcattccttcgttcatttggcattccttggagtgcagccagcagccacggggcgcaggtgcagtccgttctgggccacacctgagaagagctgcaatccttgcctcttgttggaggctttaggccccacctcgtgtcctcctgacctacctttctgcctcagccctgctctggcagccggcagtgcacaggtggggcctggcagccctgtgcctacgcagccccacgtatgtcctgcttcttgcctcgggtttccctactgcccctgcgtgggactggcgtcaccattctgggggacaggtagatcttgaaatgatgaaacattaattccctggggccaaccttgaccagtgagtgacaagagatggaggacaaaggacaaacacttgccacttgtatcttccttctcagaggcttctctgtgggtctccagggtccccagcaggaggcagcgaatcccagctgcccacagcctagtaatccagtgtgggttcccttcttccctgttttcctcctcccagcccggacctgttcctggaatcacttcccagaactcaccactaggccacaagctcttgttatttgaggaaggtagctaaggcagccacagggagctcacagtgtagggagatggagccaggcacccaggaaccatctcaacccacgtggtgagggccacgaggcatttcccagagcctgtggcacagaagaaagccagcccggtcccctggggcaggtcaggggaaggctgaactgggtcttgaagaggaagtgggggagggagggacactctagagcgcaggagcagtgagttcaaaggccaggaaatgtgaggaggccgggctccatggagactgggccctattcttctggtagatctgcccggatatccagcgtgtttgattggacctggttgagatgagtttggaactgaaggcatttcctggccaaagtgcaaagtgaccttggagagaattcagttttcctcagaggggatgaggaactcccaccctgggatcaagcgaggaagaactgccatcaagtttgtgtgtcctctacagcctcgctattccagtgtgtgggccaggacagcagcttccacaccacctgggagcgtgttggaaatgcagagtgtcaggccccgccctggacctgtggaaccaaaccctgcagtttcgtaagagcccagggttttgaatgcacattaaaatttgggaagtcctgtcctagggcactttgcagaagatgcttttgaccgggcttggggcagggcagcagagttctgtaagggaaagggtcttcgatgagagaggagaggagggactcaaagcacctgctgggaactggggagggtaaggcagggggaggagccagaagacgctgccaggtctcatccatgggtgaggggtgacaagcttcatggaaatgcagggtggggggaaaaggggagggggcgatgggctctgcctggggctgccccatctaaggtgtccatggagataggaaaccagagacgttcaccgggagtgattttagtgaatccttgcttcccttgagtcttcactgttttccaaatctttacaaaccatctgcttaatgattaggtctagaatgttcttagagatcactgtcaacattaccagactgaaatttctggagtcatcttgtagacagttgggatatttatgttttcccctttcatttgcaacttatattaaggtccctgcatggggccccagtaaatagcacccatcttcctcacttgggtgctggagatgttagatattggataagttgaataagctgagtgaagtaatgagtacccagggagcaaactgtcacgatttgtcctgtgaaggtaagttgaggatgcagcctgagatctcctggtcaagttgggttgtgaatcgggtagatctaggcacccaagcactggcagggctgatggggccgacgggctttctgcaggcagcagattcctaaccatgcccatcaaatattcttccagaactcctcctaggagcagggtagcctggggtcactggaggccaggagatgggtgattagagcccctgtcccaaggagacgtggggttgggggatgcttttccgctactcacctgacttctagatgaaggtcgggtgtgtggtgggaaagttcgccacacctgcaagctctggcagcatttcatgcaggtccacctgggcccaaaggcctggccctagcagcatctgaaggcatcccggttctctagtctctgccccactctggtccctgcagactgattttaccttgtgcaccgctgtctttagtgaggagattatgagcaaagtcagaatagaggatggaagccctgagctccaaggacggctgtccccaagctcctgaccctgaggagacacatgtgctgcgtgctgggcactggatagtcctggtcgtctccagctggtcctaggatcttggacaagtctccatcatcctggagccctgcagggccctcctgaggcaatgggggcccagctgcccttgggactcctccagccgccgctctccagggtcctgtcctctgcttctctcaggccagtgtgggcagcacctgccaagccctgctgctctcggccacctcccggctaggaacatgtgcttgggcctccacctgttgatttttgaaaaattattatttttattattttctattttcttttttttttttctgagacggagtctcactctgtcgcccaggttggagtgcagtaccacgatctcagctcactgcaacctccgcttcccgggttcacgccattctcctgcctcagcctcggagtagctgggattacaggcgcctgccaccatgcctggctaattctttgtatttttagtagagatggggtttcactgtgttagccaggatggtctccatctcctgacctcgtgatccacccacctcggcctcccaaagtgctgggatgacaggcgtgagccaccgcgcccagccgtaaaattattatttttttaaagcagtttgtgaaatccctgaaaagtcaactttctcatctgaagaaacacagtgaatgttatggaactcctcaccatctgatgaggccatttggaacttgatcagtgtttttcaaatttgcctaaccaagaataaccaaggtgttggttaaaaatgcagcccccaggctctccggggggaggacaatgaatcgtttaacacggctgctcagtgtgggcctgcttccagcagcctgggcttggcctgggcacttgttagaaatgcagactcctgggccccggccaggcctgagaaagcacaactgccccgtagcaagctccccggggggttccggccacttggaagtttaagaacaggccttgattgatcagcggttctcaatcttggctgtatattaaaatttattggaaacatccaaagagttaacaaaattttctcatgtttggggcttaccctgagaaattctggttggtccgcaatgaggctgggcacacaaataccctatatttacttgtaaggtattttattttagtataatatatgtaaagaaacgggcgtatatcatgtgttcagctcagtgagttctctccagtgggtcaaacctgtgtaaccagaacaggaatgggaaggtgaccagcacccaggacccctatactgcctccagtcgagacccctggcacccaccaaagataaccatgtattgactccttacggcatatgtgtttctgcctgtttttgttccttacacaacagaatcatgcagcaaacactcttctgtgtctgtcttttgctcactaggtgtgggacacagcatgtggcttatccacactccctgcccagcagaagtcattgtgtgaacacacctgtctatccctctgtactgctgttgatgggcactggatggttggcactgtggggctattatgaatacggcaacttgtgtctcgacagctcccctagggactttatgtagagccaggtttgccacgggatgccaccacacctgctggacaccgcctgtacctttgtggtaacctggggccctttcccgtcagctccaccttcagaggccaccgagttactgtggcagctactgcttcatctttgtgtcctgccacccaaggatgacaaatggccacatccagaagcccccgcattcttccaggatagcgggagccgcagggtatttaaagttctgcctcactttctttcagtcacactcaagggatttgaagaacactgccttacgcactggcccaagagtcgccaggcatctggccagggaacgggctgcagtgggataccctgcccaggctccctgctgccaggaagctgacgcttccaaacagagatgggtgaggggagtgaggtacctgtctgggtgtaaaatggaagaggatgccggaaactcagtaatcaagataaatattttaatgtaatattagaaaaaatcaaaattaatgcaaaacttccattatgaacaaaaaaccccatcattttaactaaagaccagtgctgagctgagccacactggatcataggcaaaaggaaagatgtgcacccctatacgtatgttttatattttgaatggttttgttttattctagaacattaaagaagttgaaaaatcttgaaaaacagaaaagtaggtaacattatcataacattgtttcaggtttaaatattttactaacactgtaaacaaatttattataattttgtttttctggctttaatggaaacaaactcatcaatagcattgtcaacatctacttctttgtgtgtctcattttcttttctttttttttttttttttttgagatgaggcctcattctgttgcccaggatggagtgcaatggcctgatctcgactcactgcaacctctgcttcctgggttcaagcggttctcctgtctcagcctcctgagtagctgggattaaagacgtgtgccaccacaccagactaatttttgtattttcagtagagacagggtttcgccatattggccaggctggtcttgaactcctgacttcaggtgatctacctgcctcggcctcccaaagtgctgggattacaggcgtgagataaaccaggccacgcttacctcattttcaattcagatagctgctatatttgataatttctcttgaccaactgatgatctcaaatcattttaagttcatatattattttcaatattaataacattaagtatgaagtatttcaatagcattaaaaattaaagtgtcacttgattaagagatattacaagtgacaatctctcattaacattaaatattatcaaatattaatattaaataatacaaaatatttacagttttactaacattaaaatgatttaacactgggaggctgaagcaagagggtcacttgaacccaagagttcaaggctgaaatgtagtaagactgcaccagtgactagccattgcactccagctcaggtgacatggcaagaccctgtctctaaaaacaaataaataaataaaataatttaaaatttatcacttcattgcctggggtcctattgcctggagaactattggtttacatattttatctgctgttttaattgttttaggtaggaaggcatatgctgtctttgttactctatcttggtcagagcagaaatcccccataactctgaacttttccttcatattttcgatcctgtcttggctcattctgtgtaattttttcctgatatatctgcttcttcattagttctctgcagtcatatgcaatctattctttaactcattcattgagattttttacttaaaacctcttttcttttttagaaattccatttgttcctttctcaaatctgcctgttcagtactgatagtgtccaattacttgtcatcttattgtttcatgtttcatttatttaaacgtttcataagtatctgctgtgtacctggcacatgacagtggtgatgtcagccgtctctgatggtctagttctgttgctggttgtttctgctgactctcattcaaggggttgcttgcctgctcatgtgttgagtgtgagcccttggctcgatctgctggaatcatgaaagtctaaatttgtggtgctttcacaaatacaattgttgttggattcactgcaaaccacaggtgtcacggacttgaaaccatgagttggggaaccccaagaccaaccctgggttcaatgattggctaggaggactcacaggacttggtagagagttgcactgatgggtgtgactgattacagtaaaaggacacaaggcaaaatcagcaaaggaaaaaaagggcatgaaatctgaaagaaaccaggagcaagcttccaagagccctctcatagtgaagtcacacaggatgcatttaattccttcaggaactacttgtggcaacatgaatgagacattgcccccagggaagctcgttagagacttggtgccagggtcgttactgggggctagtcatataggtgtcttctgcccaggacgcatcaacattccagactcttggaaggaaagcggctgttcagcatgaagtgtatggtttgtacacgtttaggcgcagtaagccactgggtttatcagggacagtgagaacctccccaaatccaagttcctagatgccaggcaagacctaaccttgcctcctctcccaggagagctgtggttactcttctctgtacaccttgtcagtccccacccaccttgcagggtcccgattcaatgtgggtgtcacaggctcaactcccctactttgtcagtgtgcccagacagtgacactaggagtgtccaccatcaggtcactgagctctgcctagctcaagagttttgttggcttcttggaggtaagttgaggaagggcttggaaaactccctactcttataagtctggcattcatcaaaaagtgtgttttgtcaagaatctgagtgcttctcagagcacctaattcatcctgtgtcagctataaaagccccttattttttagaggataaaaaaaatgtcaataagaattcatagtcacagttatccaggctaaaaaatacacatgaatgttgggaggttgtcatccactggacaacttttccaacagaaactttagaaccccaagtttccatttatctctattggaatctgtttctccctgctggctgcatgcctgcttcatttcttcctttaatcagggccaacttattcattaggcacaggagacaaagtgcttagagcccctggcacttttaaggaaccataaattttttttaatggaccacaatgttttagtttattttaaaatcagaaggaaaaaaatgagttgttaggggttgaagaaaagtttatttttaatacagcttggattatatttgcccttatatcaatgtagttgcaaaatatgactttgtatatattttgtggaggaagtgtgtccccaaagtgtctagggcccacaagagttatgatgcgaccctgccttcatggtattaaaaaaaaaaaaaaaaactaaaaccacttactggggacataatatgctcctagacctgtgtcctagcattggcaatggaaatatggttattccaaataacagaaataacagaatttccaaattgtataaattttaatatttttcctgagctctggtaactcttcaactataactctttggatcatcaagtaagtttccagcgaaagagctttagctcctcaattattggtagccttttcttagtgacaggctagagatttttccaaactattcactctgacaaatcaggaaaagctcccactcaatgtttctaaaataatatggctgtgtaggggctagacatgaagcctaacacttcttagaggaccaacagcagttgatgtaaatcattttatttaaagggctagtaagttattttgtacttaatgctttcacctaacaacaagtcagacagacatgttatttttataacatcaaacttatacattattcagtaatctatctttggtctttggttttgtgaacagaaactggctcttttgttccatgaactccacttggaaacccaactttcatgcccgtgaaaacctacttttaaataataatggggaccctcagaacaaaatctctgcttccttacacaccaatttctgtttcaagtggtagaaataaagtttgcatcctaacttcctgatgtctttatcacatgagagaaaagatctagtgtttctgccattttaactacatatcatcggtcaccaaaaacactgagaacccaaagcaatggctcttcctccagccatcaagctggacaccaccccagcctggttttgtagagtccatccttgccacccaggtcatctgaagacctggccaagggaaagggctaatggcagattatgacccattatcagcttataaaatccacatactggattgtgaccaaggtttttcactgtgaatgaataaaataggcagatttactgtgaagctgaagttccaggtgcctcagttgtcaggaaatttccaggtcataaatatctcactattttataatttgtaatattttatggctttgtaaaactgtgaccgtgcatataccaaacaggagagagatgcctgtctctttccatcctgaccttctctcccataatttctttcatgatggttgctgctaaagtgaccataggctttttcagacctgactaaaggtgagttgaggaggagataaagttcatctgaatttagtgagatgtgtgtaattttttttttaagtttgagaaaatctctactgagttctttcataaataagctgcttagaatttgggagaattttccactggcaaacttctggcatagcatccccagacatacagggctaggtgctttaggacatattagctaacttatccatgacaaaataacaagttcatttccacttctgggcaagatgaaatcatagagccttgattttccatcttgcgtgaaatgactaaattccagacaaagcatatgagtgattttcaaaacactgaacataaggcaacaaagaacagtgatcaccgggagatgagaaagagatgggataaaccagcagtgttcctgagttgaggagatggagctgggagtccaggaagggaaaggcggctagggttctaagcatagtgtgctggaaaagggaaagcctgagagtgagcgagcgcgcgcgcgaatgaacaagaacgaactctggaggtctgcagagaggtcccttgactcttcaacatgtaaggaaacttcttgaagctggttaaaaaaaaaaagcaaacaaacaaaaaaactcaacaaaacacataagcattagaaggaacaatccctggagttcatacagtgcttgaagtaattcaagggcattgagtacagggggtgtacttgcctcagtaacggaacaaaattagcccgcatttaaattctgctctgatcccatttaataccatttaaaagcaaaacctggataaaatggtttccaagtaagttaattacatccccccaataaagctccagaatatttatagaaatacaaaaacaaccagcacccatggggtaaagttcacaatgtctgcaattcaacaaaacattaccagacatgccaagaggaaacaaaaaggtacccagaatgaggagaaaaatacatcaatttaaaacaaacctagaaatggagtagatgatagaattagtagtcaaggacattataaaggtgttctaactgtatcccatatggtaaagaagccggagaaaagatggaatgtgttaagtagatacatagaatatatacctaaaattcaaatcaaacttctagagatgaaaactacacatctgaaatgaaaaatacaccagatggcatcagtggcagattagacattgcagcaggttagtgaactagaagacataacaatagaaactatccaaaaggaaacacagagaaaaaagagaacaatgcaccagaacaatagtgatttctgagacaatttcaaatggcctaatataaggtcatgcatcctaatcaaattgcataaaactggtaataaagagaactttaaaaaagcagccagagtaaaaaagacatactgtatacagaggaacaaaggtaaggacagcaggatttctcactggaaataaagctagaaacagtgagcaacatattttaagcaccacaagaaaaaaaagctatctagaattccatgcccatcaaaaatagctttcaaggttggcaaaataaatattttttagatatacctgagctgaaagaacccagcatcagtagacctacactaaaagaaatgttaatgtcttttgagcagaagtaaaatgatatcacaggaaacttgaatctgcaggcaaaataatgagtaccagaaatggaaacttacataggtaactataaagactttttttaattaaatatctttaaaagacaattgaccatttaaagcaaaaataataacaatgtattttggagcttattacatatacaaaaataaaatggctggtttcagggctctggcagggaaagagggagatgagtctggaacatcttgttgtgccagaaattaagaaaaaaaaacctcaggctctttaagcatttttcttactttgctgagaggatatgtcaaagcttgcagcagcctggtctgaaactcctactaaatttaggataatttgaacatcaaaaaaataaaaaaggtggcaactgattagaaaccattgaacagaataggaatctatgaatccacaacacatacacatgtaaattagtaagttaatgggaattacagaacatttttttccttgcagtagaaagcccacaaataaatgaagagggaacgatggatgagaaaacctccatttggcaacaactgtaaaaataaattaattcaggcaaggaacatcaagagatgctaaaattagtgggtagaattgagatgaggagtagaattttacatagtctcaaaatatctccccacaaaatacttattaactacaaatgggggcaaacatagtggagacgttggcagaagtccaccttagtcaaaggattaaaatgaatgccatcagcaacagggcatacaggcatcagatgccatccataggttgaaatgaagagaatagagcttctgtatattttgaccccaaaacgcatagtgatggtccagtcatgaggaagcatgggacaaactccaagtaagaaacactctacaaaatgactggttcacagtcttccaaatgatcaaggccaaaaaagccagagagaataaggaatattccagactgcaggagactgggatacctgagaatggggaatgggagtaaaaagaaaaacaagtctgttaatggtttacaaataccaccacacacctgtacagtgcttcacacacaataagcactcagaattagttactattccttttcttaggtttactgatgagtttattaggcaactttccatacttgggtgtcctaagggggaccttggcagtgccaaggatgcacatggattgtcacacatccagaacaatcacagcagcacagagtgcccgggattcacaaagttccaggaacttgtcaatctaacaccagccattcaaacatttccattctcccttgggcttactgagaatcacatgaaattaaaatacactatggatctctgtgtaggtgaaatcaaaatctggagaccatttgcagagatcttcactaactttcctatattagctaaaaataaattggttgactgttgcctcagacaaaatttctttgctgtatttatcaaatacttaataggcaccttccctttgccaggtcctggaaacacaagaatagcccctatccctgggtccctcctagtctagcaggataaaccacacgcagatgaaacagaaagtaataagtcaaatgacaggccgatatcagggtgttatggggaacacttaggaggggcaactgccgtgggctggggtgaagagcacctggaaagggaccaggaagtattttctggaggaaatgatgccaaccacaagtgggatttaagacactgcacaaaaggcagacttgcattatcatgaggtggatgagctgaccaagggctctcctgtggaggacggggtctgatggccaatagcatgatacccaaattcatgctgcagcagggtttccccatgctgtatttgtaaagtgcctctatgacaatatggcaaatctcacacatacaccatgtatgaggaacacctgccactcaactttccaagttcatagaactcaagttcataagaactgagccaagattttgcctctggctggggaaaatattaaacactggggacatgattttgccaccacactatttactgtcttgagtatgtgccaaagattgagaggatgcaaaggagtgcagcaatcccaaacctcacaaagcctgttattgctaaaaaaaaaaaaaaaaaaaaaaagggaaacctaaaaacaataaaaagaaaataaaaccaccaccaataattggtgacgaattgaataacagggttaaagcagaaggtttatatatatatatataaaatttgttcctggtacagtgtgttccagacactttgggcagaggctcccgagaaaggctagtttaggatatcagcaaaggaaaacagaactgtcagaagccaagaagtacgagtccaagcaggtgagaatcagcactgatcaaaccactgtgggtctctgtaccttctaattctttattttccagtcagcttggtagcattaacttgattatctacagttcagctgttcacgttacagggagagctaataaaatttttaaaaatgatataccccggttttacagaaaaacctcattagaatgaaaaaaaaaagctatgacattaaattctttagattatcaaataaaactggtttatcaactgctatgcagaaatatcaatgcagggtacttaaaaatgttatttttctgcatttacccccctgccccatcaacttaaaaactaccagttcgaatagtaaaggaaatggcagatgagcaaagatggttgcctatctggttttaatcatcgtatttgcgatgcccaaataactaaagctttaatacaaccttaattctataagcaacctggaacgggggaaaattaaatctctcacagctattcacattacccaaataggaagattttaactttactttcacaaatgtaaatgctacacccggttactatcaaagtacagggcataccattgagactgactcgaagcaaaatacagtacaaatttattgactccaatcattcttagtcaacatttaagcaaactgtagacaatggaattgaatacaaataagcaatggattaacattagatagaaatcctattttaccatgaattttcagttcgaaaaagcttattcctaagtaaaatggaaaaatgacttactctgctaaggcatatgacaaaatacacagaattataaaaccattcgtttttcttttaaccataagcatatattcaatggaaaacttgaaatagccttggactaatgttctgaaaactagtattaactgagtataactgtgtgaaaaatctggacagcattaacaaatgaaagagcactgaattctgttattttaaagatttacagtaaaatactttggttcccaaaagactgtctctaaaaggaatttttaaaaacacctgacattgtaactcattttttctcctccagaatctaaacaccaattttgtcttctccccagtcacatgggaatgccacaagctggagtacccgctgagatacactgaaagagcatattaaaaattacaaaaaattaaacttcttaaagtgctaaaaccacaaaaagccataaatgaaaacctattttttaaaacttaaagtttagtagtcagtgttaaagaacacttttaaagagtacgtgtcagcattatttaaatcaataatgcatttcacaattattgcagaaacatcactgagacatcgtaaattgtcaaactgacttgtaatccagttagatacaatttatacagaaatctatttggaattatacctaattactttttactaagaaacttcaaataattttacttcctgaagttccagattacagttgtatacacacatgcatgcatgtgtgtacaaacccaatttgagacaacaaaggccaactttagatctgttaattcttccatctctccctcaccctgatcagagagttggccttgtaggtgcatccacaccgcacctccgtgaacagacacattttattcctgtttcacagcagctactctcattagcaccaatgggactacatatggattcaaacggtcactcattaagtgctggggcacatttttacaggcaaggctataaacgttccattccaaaccagaaaaccaagaacatcacacatctccccacaaatgcaaagaacatcactgttgaattgttagttgtatattctggtaaaattataaatgcatactaactagttttaaaggtgaatattctacaaatcttcaaatattactgttaaaatgcacaatatttgttacctccattgcttactttgagtgataaaaacatgttttatgttactccttccttctcccacataaacgattcagtatcaagttctcagattaacaaagaatatattaaaacattttacattctttccacaactgcataaaaaagcaggcatcctgcatacttacatggaataaagagctttctacattttcaaaattaattacaatcctaaaatatatttacatgaatatcttcactagctaatgagttgcaacaatttaagaccaacttgttttacaccaagtatttgcctactggctgagataaacattcttaaaaaactttactgaataaagtaattaacatatctttcattattttacttcttaacatttaaaatagttacatgagtggaagcatattttttttgaccaccaaaataaactctttcagcctaatgcttttaaagtacagtataaaaagtaatagaaaaaccagaacggcattataaatgtttttggttcaaaattttatttgaaatcttatattccttgcttagacaaaaatgtgaagacaaaacaccagtcatttttaaaatctaacagatatgcagaacctatgtttagatcaaaaatattttttttttttactgattaacaatattatttttaaaaaatcttcgaaaatgtagcataaaggtttaggtcctgggatactgaatttataatgccaagatactctgtatcatggaattatcaccgatagatactctaatggccatgtaggtgatgattactcagggaaactgtcttcttttgaagtgacagctaccaagatggacagagtaagaaataccacattatacgcggaatgaattcaatgtacaataatccatcctgatgtttcatgtaaacccatatgctttagttttatccttaaaatgcatagatttctttaagaaaacaaagatggcaagaatcaataactgcaatttattttcccttctccatcaaatttaagaaagaataggaagttaactactaaaatattgtggaattttggagttttttcaagtgaaagaatacaaggcaaaatttcatatataatatccataatgtacaaagtcaatcagtattttataaaaatgtctggttcaataaaaaaaatgagaatatctttcctaccactggtatggaatgttggcaataagattgatgggtacagagttattttctgctagagcacaaatctaaaattatttcttaatgacagtagttggcttttaaaaaaaatttgaaagaatacctcgtaacacaaactagagtctaaattggtattactttcttaaaaggattttgtagtttcgtttttttaatacatctaactcccacccccacaagtaaaagttttcccttttgaaacacattgaactttggatatcctactgaaaggctttcaattacaaattatacatagtattctttgaaaagcccaaaacccatggagcaaaataagtagctaaaactaattttggaccactgatagtgctctaatacctatttttgaaatattaagcaatgatgtagagaatggccttgcccatgattttaaccatcagacccccaacaaattctaacagaaattgtcacaagagagaggcaggaaaatgtatatgtcgtatatattgttcttggaaagcatgttgaaactgcagtgaggtgtttctcctctgctctatctggaagtaaatggtaatttagaattttacatcagctgtgctaattcttgagtgtctgggatctatgtaaatatatgtcccgaccttatttgttacactaatgttaaaatcaaaattagtgccatatggttagctttgttttttgtcctaactacactcagattttcaatttgtgacagcataaatcagaggaaatgaaatatgtgcagtccttcaaatgctggtctgaatttagactgtggtgcagtgtacatgtaacatggtacaagtttttataacaatgtctatcactactgaagcccttataaactgactgtaggggacttccataaattgttttcatttcccaggtcttccttagagtttaactatcatttattatattgactgagagcaagtttttgttagtttataaaaatctaagtgttactattgctgatttaaatttctcacaattttcatacaaaaagaagttttacatgaccacaaaataccaaatatttatttttatcaagtgtcaggataacttattaaagttgagatttatcttttattgctaaagtagtctaagatataaatcaatactgcaaactactccacttcttcctattttggacttaagaacatggttaagatttaactagaactcaagtgtctaaaataattaaaagaaggaatacttcgacagtattccactaatcaataaaaaaccaaaaacctcaattaaatgattatactgacaccatggaatgaggaaccatgcacacaatcaagactaatccaatttcaacattaatgaaatcaaaccatcttgttcttgtaaggtccagaaccacaatattttaaaagctgtatttctaaagttaaggacattactaagtaattatcaatttgcctccaacttaatttcaagcgtaacaatctccaacctttattattcttgtttaaaaaatattttgtttcttatgacacatttcacaattcaggttgaaatctggggactgcctcccataggtaaaaagtgttggtctttcaattgtgtgtttgttcgtgactccaaagactaaatgcagtcttgaatgtcctgtggcaaagtttacacataaactgtcttttaaatgtgattgctgaaaggggtggggcatggtaaaaaagggtgtctgattcttggggcacaaacagtttttctgtggctggagttgggttttcggacaggcctgtggggctgtcaggctccagaggctggatcttgggcagtggtggtggcggtggcagaggtggtggagagggagagtttgtgggaacagggcacacctcagattccttatgtgccgattcctctgaagcctgagacatgtgcgattggaagtgactccagagtcgaaaattagtgcgaaaagctttgttgcacacgtgacaaataaatggtttcacagagcacagaagctcctggtgacgctccagctgcttatgcaccgtgaacatcttcccacacttctcgcagggccacaggctggcttctttgctaggacccgcttctttgggggctgtgctggcctcgggtgcctcttcttcagcctcctccacaggctcctctttgacttggattttcagttgcttggaaagactaaggtcttcgggaagacaagaggaatcttccgagtcgaagttaacttgttctgaagaatcactgaacacgttgtcgtcttttgtggtgacgatgtggtttactttgttgggctcaggctgggattggggccttgaagaaccagtcacatcaccattgtggtccaaaacgggcaaagaaaagttttcggtgggtgccatgttgttctgattatggacttcaacctggtgccgccagatgctgaaagaggacttgaaggtgcgcatgcactcgaggcaggtcagcttcttatactcacacttgctctcgtgttcttgcttcagctcgggcgagaaaaacctgaggctgcagtaagggcagacggccgcgttccggcacagccgctcgtggcttccttgctctaggagagaagagagcttagcattacagaggcggcactggtaaacctccttgttttctactggacttgcaagaggagcatgctcttttggtttagcaactttatttactccaaggggtttttctcctggatgcatttttatatgctgcttaaattgagagagaaagcggtacgcttttccgcagtaagtacaaatgtaagctcctttggctcgagatctcaagttcctcttgatgacttgctgtgcttgggagctactctgtccctgaaaaccaggcttgccgcgccttaacttaatgatcagggccttcttaatttctctctctctcactatgtcaatcagctttctttggaatttttcatccaaaacagcatgtgaactagaggctggtgatgggttcttcactatgccgtgttgggtctgacagtgtgtccacactttgaagttggtgtgaaacctcttgtgacagatgtcacaagcgtagggcttttctgggttatggtacatgttaacatgacggtgaagacctgctgttgatctaaagatcttaaggcaatgtttgcatttaaattttttgtttggtctcgtcccctccaactcaccaaattcgtctttattcaaatcagaatctggaaaatctgcatcaaggagagtagggcttgagccttcctcaaaattatcttctgacacaggagacccgtgctcattcacctttaacttcttaaacggcaatcttcggtccgcttggaacctcctttttgctgggagtctgctcatgtctttttggtcatcttctgttttcagagacaggtctcttgtgaccgacgaagatgaggcagctgctgttgttgccgcatctcccacagtgacgcggatgatgtccgaggggtccgacagcgggctgctgggctcagtctttatgcgcacctcagtcacaggggaagctccctccctgtctgttgactgagaagcactaaaggacctgaggcgatgcggttgtagcacttgaggcctgtcatctagggctgttttttcactacaatcttttaaagatgacttctgagataaagcacacaacacattccctggtgcatcactggacaccgaagatgatccctgggaagatttcaaatctatggaaggtgaatagacaggaacctggctatccatcgacaatgaccgtctgaggagactcttaacaagtgggccactcctgtcaatgctttggtttccagaaccagatccactggatgggatcactaagcctaactttgaatagtacaacaagtttctatcttcaccttgaccatttcctttgttagtttcttttaatagatagggagtctctgatgagctacaaacagacaaaacaggtggccgtggtctcttcaaagccagctctagagcttttccttttggaagctgaccactcacacctggtttatcatccatagcttctctgtcttgcagaggctttgaaggcaacactgcatttcttttcaccaaactgattctattaggatcatccaaagatccagaatgctcaagagactttgcatataccacagaactatctttcggccaactcttttcagttaatgacaaattatgaagtggttctattggttttgggacatgtggcttattggtattggccttgactgcaatgctaggagagggccgggaagtatggcttacatcgggttgattttgactaacagtttttccttgcgcttcgtttctactttgacaaacaatgacacttctcttttgagaactgttttcatcatcttctacaaacactttttttctattaggacacgttggaaagggggcttgaggtgttttagaaacgatgttagtcagaaaggaaatcccaagactatagccaagttcttgcacagcagcaaggctgctcttctcaacaaatagagaggaagaataaatgtagtttaaaacattatcaaaagcatctggctcacagaagtcaagctgaaatacagtttgtgactcattttccttatttgtgaataaactctgaaagtattcgctgctggcagccaagacgtttttatgagctcggaacttttggtctccaacaatcagcagcacatcacacagctgtcctttgagacgctcctcattcagggcacttaggagagaaatggcgtgtgcagggttgatgtaatgcagtaatccctccatggcttgagtttatctaaaagacaaaatgtaaaattactacagatattgcagtgaaaagttcccctggctcctcaagagcagggaacatcagctgtctttgcataggtaccaatatttagcagaccgtaggctaacagaagctctatgaatgaacaatcttatttaaataatggtgaaaatgtaaaataagtctcgtggtttaagtaggtcctcattaaaatagaagaattgcaggaactataatataggcatttgtatatcatcaaaaaggctgccagaacttggcaggtagatatggaagcaatatttgaaaataaaggtttattatttagggtccttatccatttgatgcttggcactattccttaccaattcagaaaacaagtacgaattatcaaacccctgaagtctataattctgaaagaaaatcagctttattactacatatacttaaacataatgtgaactgttaacaattggttgcaaagcaggtcttgtgagacccttgtttttattttgagacagggtatctctctgtcacccaggctggagtgcagtggcaccatgatggctcactgcagcctcaatctcctgggctcaagcaatcctcccactcagcctcctgagtagctgggaccacaagcacatgccaccttgccaggtgatgcggtttggtggtgtccccacccaaatctcctcttgaattgtaactcccacaattcccacgtcgtgggagggacccagtgggaggtaactgaatcatgggggtgggtctttctcgttctcttctcatgatagtaagcctcatgagatctgatgattttataaagaggagttcccctacacaagttctctcttccctgctgccatgtgagatgtgacttgctcctccttgccttccaccacgattaaaaggcctccccaaccacgtggaactgtgagtccactgaaccgctttttcttgtaagttacccagtcttgggtatgtctttattagaagtgtgaaaatggactaatacagtaaattgataccagtagagtggggcactgctgaaaagatacccgaaaatgtggaagcgactttggaactgggtaacaggcagaggctggaacagtttagaggactcagaagaagacaggaaaatgtgggaaactttggaactccctagagacttgctgaatggctttgaccataatgccaataatgatacagacaatgaaatccaggctgaggtagtctcagatggagatgaggaacttgttgggaactgaagcaaaggtgactcgttatgttttagcaaagagactggtggcatgttgcccctgccctagagatctatggaactttcaacttgagagagatgatttagggtatctggcagaaggaatttctaggcagcaaagcattcaagaggttctcaggtgctgttagaggcattaagttttataagggaagtagagaataaaagcttggagaagttgctgcctgacagtgcgatagaaaagaaaatcccattttctgagaagaaattcaaactggctgcaggaatttgcctaagtaaggaggagccgaatgttagtcacccagacaatggggaaaatgtctccaggacatgtcagacctttgcagcagccccttccatcacaggcccagaggtctaggaggaaaaaatggttttgtgggccaggcccagggccccctttctgtgtgcagcctaggaacttggtgccctgtgtcccaggtgctctagccatggctgaaaggggccaaggtacagcttgggccatggcttcagatggtgcaagctccaagccttggcggcttccatgtggtgttaagcctgcaggtgtgcagaagtaaagaactgaggtttgggaacctccgcctagatttcagaggatgtatgagaacacctgtatatccaggaagaagtctgctgcagggctgtgtcccctccatgaggggcagggccccatggagaaacttctgctagggcaatgcagaagggaaatgtggggttgaagcccccacatagagtccccactggggcactgcctagtggagatgtgagaagagggctaccatcttccagactccagaatggtagatacgtcgacagctggcactgcgtgcctgcaaaactcacagacactcaatgccagcccataaaagcagccaggagtgggggctataccctgcaaagccacaggggcagagctgcctaagaccatgggagcccacctcttatatcagcttgacctggatgtgagacatggagtcaagggagatcattttggagctttgagatttgactgtcctgctgaattctggacttgcaccggggcctgtaagcctctgttttggccaatttctcccatttggaacggctgtagttacccaatgcctgtacccccactgtatctgggaagtaactaacttgtttttgactttgcaggctcataggcggaagggatttgctttgtctcagaagagactttggtctgtggacttttgagttaatgctgaaattagttaagactttgggggactgttgggaacgcatgattggttttgaaatgtgaagacatgagatttgggaggggcccagggtggaatgatacagtttggctgtgtccccagcaaaatctcattttgaattgtagctctcacaattccccacatctgggaggcacccagtgggaagtaactggatcatgggggcaggtctttcttatgctcttcttgtgatagtgaataaatctcaggagagctgatggtttcataacgaggagttcccctgcacaagttctctcttccctgccaccatgtgagatgtgccctgcactccttgccttctgccataattacacagcctccccagtcacatggacctgtgagtccactgaacctctttttctttgttagttacccagtctcaggtatgtctttattagcattgtgaaaatggactaattacacctgggtaattttttttattttttatttttagaaatggggcctcactatgttgctcaggctggtctccaactcgtgggctcaagagatcctcctgcttcagcctccccaagtgttgggattacaggcatgaaccactgagcctggccaagagacctttaaaaatagaaaagaatttggaaagcaaaaaattatttgctaattactaatgaaagtgtttacgccaggcacggtggctcacgcttgtaatcccagcactttgggaggccaaagcgggcaggtcacttgaggtcaggagttcgagacaagcctggccaacatggtgaaattccatctctactaaaaatacaaaaattagccgagggtggtggcatgtgcctgtaatcccagctactcaggaggctgaagcatgacaatcacttaagcctgggaagtggaggttgtagtgagccaagattgcgccactgcactccagcctggttgacagagcaagacgttgtctcaaaaaaaaaaaaaacaaaaaaacaaaaaaacaaaaaaaagattagaagtgttgaagaataagtttgttttctttcttatgctatttgccttgcaatctcatgaatactattttcttaccaaatcacattttcaacaatagcacaaaggaaactttagcctagttctaaatttaattaaagagtttaaactgatatttcactgaaatgctcttcaaatctaaacatgagaagaggaggcctagtggtagagtgcaagctctggtgccagacacttgggttgagatgccagttccttgcaggctggctgattgtccttgggtgtttctgttagcctctcggtgtggcagatccctcacctgagttaggaatgacaactgtgccctcctcttgcagggttgttgcaaagagttcatctaaagaaaactcaacaaatgtgcacttaactttcagaaattgcaggattaataggcatctaattcagtatcaaagaaagtgggcagattaaccccaccatactctcgatgcagacaaagccatttcatgcagagacaatgcctgactctgtgtatttgaccctttatttaggcttctgttcctctaacacctcatccttttcattttttttttttttttctagacagggtctcgctctgttgcccaggctggagtgcaatgactcagtcttggctccctgcaacctctgcctcctgggttcaaacgattctcctgcctcagcctcctgagtagctgggattacaggcgtgcaccaccacgcccagctaatttttgtatttttatatagttggggtttcaccatattagccagactggtcccgaactcctgacctcacgtgatctgcctgcctcggcctcccaaagtgctgggattacaggtgtgagccaccacagctggctcatccctttcattttataatgccatattttctttcaaatattgttaagacatttatttttaagattacatgaatcccaagtaactatctgtgacggttttatctttctctagcgggcaaactgtagatgaaccaaacttgaccccagctcatttgtaggttctcttctggcctttgctggttaccccagccaccaggctcttcaggaagagcccagagtctcctaggctgtcaacctgggagtggccacacacggtatacaattccttctgactccctgataagatgcgactcaatttaaccgactgagacacaggactttgcttctagagatgatgcctttagcctgtccacaaacaactactttggtcagactgtaccaagtttctgtccactcccgcctaccatcctttcaaagtaaatggtaaattttaattcctctatttttttaaaaaattattctatttgtgactacttgataatttcccttcctttttcttctcttagtcatttaaattttccttaatcctactatactttctttacatctatttgtatgaagaaacccttaccatcttttacagagatcagcagaaaaagacataagcttataatgttacacgtattgactcagctgggtactgaggagtttttagcactaataatttttgacaaagctagttcagatgttgccacagggaaaagctgtaacacagaattaaaggtacagatttaaaggcttggatagtctttgtcaaaaggggttcttaaactcaacttggtggtttaaaactagcaattaaaaaataaatgactaggacagagtagaaaatatcagaatgcatcaaatgtcataaggctaattatgagcttgagaaacttttgtttctattatatatatgtacatacccacataagcaagcatggactggattgagatgtaaaatgtattccttcctgtgggtcagtcaaaatattttgagagccactgttctaggctaaccaacctctttgagcctcagtttacctcgccataaaataaggataatactagcagctaccacataatgctattgtgggaattaaataagataataatagtcgctaccatttatatagcacctaactgtacaggaacctacactacaaactataccagaaacttctcatgtcattcattcatcaaaatgggatcaaagaaggtgtgaaggaggcgagggatgagccatggagataaatggaggaagaacatcacaacaaagggagaagctaaggcaacaggagggatggagcagtgtgtgctgggagccatgtaagatgacatctgagaggcaataagaagtaagaccgtctagggctgggagacctccagaagaactttattttttactatggatgaaatggacagccattgaagattctgagcagaggaatgacaaagacctgaattacatttccaaaggattgctctggctctgttgttgagattagacaacagagggtaggttatgggggaagctgcgggccagcttgcagtccactgtaatgacccagatgagagaggatggtggctgggaccagggtggtagcaacggaggtaaaggcagagtcattagaatttctagtggacagactgcaggagaaaacagaaggtgtggagttaagtattctgccaaaataactggaagggcatccttaggagagatggggtttgacagaaaaaccaggagttcagattttttaaagaattcagttttgatatcctacacgtgagcagcaacctgttcatcaatgtaccctttatgagcctccatctccgccttactgtccctacttcctttcttgtgcttcctgggatcagttcccaaataaacgtctacctctgaatccttgtcttggggtctacttttgggggaatccaaactaagacacaaacagaactcgaagcacaggtaacggctaaccacttcacactaaaacctcccttccaagggcttgtcctggccctttagtgtgaagactaaaccaaggggagttttctacatccctggacctgaagcaaatggtattccacagaccgtatgcatcccgttgccaaaaaagcaacatttgtgtcccttttgtttagaaaggtttccttctttatgcattattcaaagtatcatgatccctatttctgctctaagtcactgcttcaaatttcttggatcacagacctctatcttctttggatgaaaacatctatggactaggggacaataataaagtcattcaaagttaagttgtaagagaaatactcactgtccctgaaaattattggggatttaaaacttaactttcctataacctccatttagagccatcacacctgcctgaaaagtgcctcaagatgtccaaattcctgatacacaagtgcagaataactttatagagtatttattttccattccattcagtagaacagtaactaggtacttaataacagctaaaatttgggtgtttattctgtcacatacacaaaaataaagaagttatttttatgtattaactcaatatttacatcaaccataggaggtaggtactattattatccccattttacagatgagaaaactgaggcacagacggtcaagtaacatgctcaacgtcatagagataagtagcagagcaggattcacatcagctggcttggatccagaggctaagctcttaacccctacacgacactgcctctagtttcctcttccaattctcgtatcatcttctgaactagacagtgtcatcaatcctttttacaaacaaatgagaaaactgaggcattgagaggtcaagtcatttgcctaaggtcacccagacaattatagacttatggctagcatctgtctagtgtgtgctagaacccttctagacatggaagatatcaatttaacaagtatggccctgcctcatggagcttaaggtcttgtgcaggaagagaacaggtcaattcatcagcctagtccagtatgctgagcagcagacaggatgtttgcagaggtagagacgcagtatagatgacaggcatcagagccaggtgagatggaggccaggaagggcgttctacgaagaaagttttatagggaatgctgggaagagataggaaggatgaaggacatttcgagggacgagtatttattttccattcctttcagtagaacagtaactaggtactcaataacagctataatttgggtgcttattctgccacacacacaaaagaaaacacttttaatgtattaactcaatattgacatcaaccctaggagttaggtactattattatctccattctacagatgagaaaaccgaggcacagagggttaagtaacatgctcaatgtcagacagataataagtagcagggcaagattcacatcagctggctgggctgcagtacatgcaacactacagagacaagacagagcaggaggaatccaagggaaccacaggtggctttgcctggtgaaaggtaaaggtacacataggggaggaaatgcccatgaggctggaggaagatggaggcatgagcgccctgggggctaaaatatgtcatctgaggatcttgcacaggaaagcaacattgtccattctccccagtaccccaggatctagagactctagatgtctagataggagacaggggtagctaggagatgcagatccctcaccttcacattaaggcccttgttttttttacattttaattcaattattaagttttgaaaacaatgtaccctttcctagtctggctgcagacagacaattaacatattgaatttttgtgttttaatgacagtcagtatatttgagtttaacaattacctaaaaatataaaatgctccatccatcaagaatgtaagtaaaaagggggaaaatcacaactgctgacgatcacgagataatccagcaagactgtttgtggctggtggctgtgtacaccgaatcctcaaaaacttttgatttctctgctcttctgctgtcagataaggcgagctttgttgccgggtgtactttctcctcagtgtatttttcagatctagaccgataagtttgctggcacatcactccaaatttccatgcaggttttcattatgagtaatcagggcctccgacttacagaagcagtgcatcttacacataaacacgcactgctgccaccaccgtctacgcccctcctttccacggctcatctccacctgactcatcacggcagaacttctgccacttcagtcatggtggaaaaaccttggagctcttaaaagaccagtgggtgaaatttggagaaaaggtctatttacgagcaacagaaaaaactaagaggaaaaccccccaggaaaaccagtttctaaaatagggccggcttgcttaccactttgatcctcgcacacaaatagcttcccaaagccttcctggattgtttctacttcatgtcttctgaaatttcaaaatgagagaatctttatggttaacaattcacagaagaccttacagttccatggaaaagcctttcgaatcagtctatttgtctcaaatcctggctccgccacctattaggcatggaaccttctaaagatgactcaacctttctgactagtttccttacctgttaaacatggctaacactacccaccacataggatttttatgaaggacagaagaggcaacatgtttgaaagccccagtacgttcagcacttcccatgtggcacatgcacatcttccttccttctccacttcccctcacagatgcttgcgtgggcctgctacccaccacacatcacaagaggtgctggtgatggggagatgagtaactggcctgcttcttgttctcctgtagctcacatttccatgttaggacagacaataattaacaaaggatgtgaagaatgctacgggaatactgattccaggaagcaattaatttggccagggtgtaggagggtggaagagtgaatagtgggaactattcactattaactatgagtgaatagtcctaaggaaggcttgggactcatcactcctttgacaattataatacaagctgaatatctctagtccaaaaacccaaaactactttctgagcaacgacatgatgcacaaaggaaaggctcattagagcattttggacttttggattagggacgctgaaccactgggtataatgagaatatttcaaaatcccaaacaatctgaaatctgaaacacttctggtcccaagcatttcagataagggatagtcaacctctaatactaaaggttccattctttacatttctactatagacgcttttcagaaatgctcatctggccttgctggggcttaaaaccttccaagggcttgccctggcctcaacttccaattccctggaatggctacaaaacccttcagaactggattccagaagattatttcataccatcacttcaaattcctcaggtaataaatgctaagggggtgggggactcatatctcacatcttttttttttttttttgaagagtctcactctgtcacccaggctggagtgcagtggcatgatcttggctcactgcaacctccgcctcctgggttcaagcaattctcctgtctcagcctcctgagtagctgggactacaggcgccagccaccaggactggctaatttttgtatttttagtagaaatggggtttcaccatattggtcaggccggtctcgaactcctgacctcaggcgatctgcccacctcggtctcccaaagtgctgggattacaggccagccacctgtaagatatgagccaccgcgcccggcctcatatcttaacataaattaattcaatgcaaatactttcctctttatagagtgttaaatcagttgtatggaattaagatttttgagggagagggaaggtaggcaatttcgaatatagagcattctagtgagaagcagaggaaagcaaagcgacttggcactcagaagggtaccagggggtgagtgagggggtgagaaacagagatggaaagggatcaaaataatctcacctacttggactagtgtcatagctaaggtacactataaattaagttggctcccagactagccacaaaactgctactaccagttctacaggaaaatggctctttacatccagcatcaacctagatttcaactctgggaacatgggtcctttggaatgttggggattgcttctatagtcctaaccatgatactagaaaaaagagggaatgcatgtaacacaaggcaaatacctagttaaaaaaacaaagcatctacatttgactttggaacataaacacacacacacagactgcttatccccaaaccctcatttcaggatttagccgtaacacctaccattggattttactatttgatggtgataggaagttgcctctgagtttcggtcttatcatcactcacttggtgacaacgcaaatatcctcagatttcaaacctagactagcttatccaatccttcaagaggagtcatgttactatcttgtattccatttcaccacactttcagtctctaacaagggggtttgattttggtttgatggttgttcttggccacattcaggagaatgatcctactccaacatagttcaagctcctttgcaccttagcagagcagactctggtcacagcctttgctgttttcttccagccactacacagccattccacctcctgttaacagccccatgattttgctatagaagaactgctcttgtcccactgtgtgctacagcctgatgtgctcctctcccctacctctgggctaaccatacaaccaaagccaaaccaatcagaaactttgtcctcggaatatgaatcctgagaagaatgacaaaggcaataaataaatgaagctgacttatctcaacggaggcctgaaaatgcaaccttgctagtgcctgctacatagattcctggagttagcttggtttttgtccttcttcctggcccagttttttagcttttcttttaagtccaagagcaaccctgtatctttacaataaactactttttccattcaagccagacagtttctgttcttgttattaaagaaccctaatatatttccacgtggtattcactgttccttgtcatgccttccaaacccatcctaatacagcttctagactgagcttcttagaacaaagctttgatcgctcacccaacatacacgttaaatattcctattattaattcaacttatttactgaattccaattctgtacaaggcatggttagatttatctgaaatataggggtgcaccaaacagacaagacccccactttctagtgagataaatcagatgctaaggaaacaaataaaaaagacaacctcagattctgctaaaagttatggtggaaataaataaggtgctatatcgctggatgcagtgcctagagaggatggtcagaaaataccttgatggaatatttcagctgagacctaagatctgaatgaagagaaccagctttgatcctgtttaaaaataaaataataaaaacaattgttctccattaggctaaaatttttaaaacaatgactaaaggtctctataaaatctggtttcaaatgacttttaaaattttcttagccaggtgtggtggctcatgcctgtaatcccagcactttgggaagccaaggcgggtggatcacctgaggtcaggagttcgagaccagcctggccaacatggtaataccctgtctctactaaaaatacgaaaattagccgggtgtggtgacgggcgcctgtaatcccagctactcgagaggctgaggcaggagaatcgcttgaacctgggaggtgaaggatgcagtgagctgagatcgtgccactacactccagtcaccactgggtgacagctgagccagagcgaaactccgtctcaaaaaaaaaaaaaaaatttttttttctttcccttagttattccctagtgatccctttctgctccagatactctgtctctaagacctaacctgcacatctgacttctcccactccccaatctggaaagtcctagaactcacctaaacccctcctcagcacactactcagaatattaatcacctttcaaagctcaggtcaagttccagctactccataaaatcttccattatgggttgaattgtgtccccactcttccctcccaaatttatatgataaagacttagcctccagtacctggagaatgtagtcatacttggagacatggtctctaagaggtaattaagttaaaatgagggctttagggtgacccctaaactgatgtaactggtgttcttacaggagaggaagattagcacagagacatgaacagaggaaggaccaagtagggacaagaagatgccatctataagccaaagagaagcctcagaagaagccaaccctgctgacaccttgttcttggacttctagctttcagaactgtgggaaaagaaatctgttgagtcatccagtctgcagtactttgttatagcagcccaagcaaatgaatataccttccttgactacttcatcttataacgtgcaaatacctcaacttcagcaccatttacatgtttattcactgcctttattgttagtcatttgtgtctccccaagaggactgaaagctatttaaagactgataatctatttaatatcttttggcattatcaatgctcaacatgttatcttccacaacaataaagatttgacttttctgtactcttcactccaattaaatgcacgagtgaaaattatggctgttagttgttttgctgaagtaaagcgtattacatcactgccctgctttggagtactgtactgatttttctattcctaaagaaaatccaaactacagactggcatacaagacttttcatactctggttacaattcatctctccacccttattggacactacttaccatctactctacaaacttgcatatccagcctctgccacccaaaatctctctcttccctctcctttacttggctaacttctttcgaaagatccagttgaaatgtcaccgactctacaaagcttttgtaatttgcccctagccagcagctcagtcatctaaactaccacaatacttcatctctctgtaataacaccacaacttcttcaattaatcttcttttacatgtgtctcccccaagggactccctaaagaaagaacccttgtttgcatgcacgtatccctgatgcccagcacaaggcctggcaagctaggtacagggcaaagagagaaatcatcaaacttgaggctcaagacctggactggctcacctttatttctccagcatccgttacagagccccaaaacgtggcagtattctttgctttttctattagaccttgtgactttaatcactactggacgatgattcccaaatctgtatctctgtttagactcttgaggctccagcctctcaggtacctactgaacggttccatcacagtatatcctcaggtccagcatggtacttaaactccacaactctcgtccctgctcccacatctgtttgtcctcacatattcccgatttactttggtgtgttgccagaccctaaaatttcttctctttcccttatagcctatcactgtgacctggtcaaacctagctcttacatagcttataatctgctctctctacttccattggctttgcggacaactaaaactgtcccttcggctgggcgcagtggctcatgcctgtaatcccagcactttgggagaccaagtggggtggatcacgaggtcaggagatctcaaggccatcctggtcaacaggatgaaaccccgtctctacaaaaaaaaaaaaaaaaaaaaaaaaaattagctgggcgatgtggcggaagcctgtaatcccggctactcaggaggctgaggcaggagaatcgcttgaaccagggaggcggaggttgcaaaaccagggaggcggaggttgcagtgagccaagatcacgccattgtactccagcctggggcaacaagagtgaaactctgtcaaaaaaaaaaaaaaaaaaaaaagaaaaaaagaaaagaaaagaaaaaattgtccctttaattatctcatttccatcgagagaccttcttaacttaaccccaattttgttatttacaatttttccttcagagtgtacacatctaatattcaacagtgtaagttcctcgagggcaggggttatatcttcttcaacttctatttcaacagaatgaagcacattatactttcaataaagtgttaaaaaggaaaaataaacaaaaagttacttttaagtaaaccagcacttcaaattttgactttctttttaacatcaatatttaggggtgcttaaatttaaacttaatgactactagtccttagagatcatcatttactccaagtacacgaggaaagctttaaaagataattttccatgagaaatctttctaaaatggattaacccactttcttgtcttcttaaacaaggtatgaggaccgtaatgtaagctgcttaattgaggactcagggtcatcgtgtgaacaatcgctggactattttgtaacacacgcgtgccctcggaggctcggtgccagggctgtgagcgcttgcacgaaaggaaaaaccccaggccgtgtgaagtctaactttccccgtcctctcggtcaggcaatcccaccggggcacctgtctaaaaacaccccgcctccgaacgcgcgctcttgcggaattctcccgaaccgcagagccctcgtggctgggaccgcatagcaaccgggggcagagtgcgagcccccagcggtgtgctgggatggaaaagcaggagccgctgaggatggactacggggcgtgttcccgaaaagccgggaagagatgtggcggggctgccgcgggcgtctctaaggccggcacgggtggcgtcttgactccctgcccctccagccgcggacctcggacggggggaagggggctcctccaagcggggagacggtcgccggccgagcagcagggctcctggccggcggagggtgctatgctctgcgggaccgccgggaagtcccagacaaggtctgcgggggctctggaggaaaaaaaacgcgctgtgaggtccaggcgtccgcgggaggggccgggggcggggagggagcgtccagcgggcaccgagcggtcacgctccggccaccgggccgaggacggggcggcggggctaggtcccggaccgtgaagggagcggcgggtcgcggcaggtgcggggtccccaaggccgccggccagcttccgcgcacaccccgcggcccgggccgccggcccccaacccctgcccggaacaggagaacgcgcccttctccacgaggcgtttcaaccgctccgcgcgaggggcgcgcgcctgggccaggcgtgtcccctaccccaggggcagctcggccagggtgaagagtgaagcccgtgagggaatggagcatgcgcattcgcgagggcgaggccaagtgctggcagggagcgtgcgcagtgtgaaggtacaatcggctacgtgggaacccgggacatgctcggtgagcgcccaggtcccgcgcacgcgcagaagcgctcggagcccgcaacccgctggtggagaaaaaagaggagagaaatcacctcagagttacgtcaggaaaggccgcgttttgcggggaggctgtagcctcccaaggagccccgcagttctcctagagctaggggcgtgacagttactcaccggtcttcagtctcgaggcagacgccgggcccctttccgctcacactcggctcgcgcgcgccgcagccgccgctgccgctgtgattccatccatcttgaatttgacgtcatcccacaccagggatgaggtcatcgcaggcatcgctcgtcacgtgcgcggcactctgattgggcgccgggcgccggagggcggggcggggggggggcctcgcggcgcagggggacgggggagggcgggcctgcccggagccgcgcgccgaacggacgctgccgcgctgcaagcccgcgctctcggtccatgaggggagcctgcggcggccgttaggggaggcggccgggctgggggccacggcgaggaggctgagcgccccggccgggtggagtccgtcgcggcgaggagcgcgccgattctcaggggactttgccgcctgccggaggcgcccttgctgcggggtcgccccgggtcattcggccgcggtcctgcccagctgggccgccagtagtccccgcttccggcgcggcgggatgcgtggcgcgagcgcttagtccctcggaggggaggacgcgctcccgttcaccggtggacggcgggcgactccccgagccgacgaccccgacagcgacgggagcgacgcgcggctttctgacgggcgcgggcggcgagcggggccctgcggtcctcgggtcggcggcagacgctcccggcccgcgaggaaagcccgcgggaggcggctcctgccgctcgctagtcgctcagagcgcttccatttcctcctcccgacgcaacctggccacctggcccctgggcggggacccggcggccgcggccagggcgtccgggctcgttcgccgcgcagatgggggtcggtcctgacccccgccggggcgtccacagcggcccgcaggcagccggagacttcgcatagtgcccggctcatcggagggctgtgatcttttttttttttgcagaaatattacaactccactgatgagaaaactcacttcgctttcagtcaaaaccagaaattagataacagaaatgccacactgtcaacaccgaccgggaggaaagcctcgctggcggagaccgctcaagggagccctccgcgcgttctcccagcccgggtcgcaggtggagggggagtgcctcctgcagggacggttctcccgcagacactcaaactccgggatgtaaaacccctgttaataattgtcaggggtctgttaattgccaaatacagtttttgaaagttgtatgcactaggtaaaataatttatgtaatgtttggaagtatgtgaaagacagacattagattgatacaaattaaaaatttgttgccaaattaacagctctgttgtagattattagtttgactaattttaagaggactcttagtcttacataaagaatcttgcacctaaaaattttctcctacaactttaaaacactttaaatttttttttttttttcctgagatggagtctctgtcagtcccaggctggagtgcagtggcatgatctcagctcactgcagcctccactccctggctcaagccatcctcccgtctcagcctcggcagtagctgggactataggtgcatccgtcacacctagctgatttttgtatttttggtagagatggagtttcaccatgttgctcaggctggtttcaaactcctggtctgaagcaatccacccgcctcagcctcccaatgtgcttggataacaggtgtgagccaccatgcccagcctaaagagtgtctgtattttgaactgtatggtggaaaagcacaaagtgactgttctgaaggtagaaggcaacagtgattataagtcttaaaagaaccttgagttttaggttcccctgtgattaggctgggggagtgtgtgctgttatcctagttttataggtgagaaaactagtactggctttaccgcatgctggaagcagcctcccttgagcgatccctttctagccacctgcttagctgtttttttgttttgttttgttttttgttttttcaaccttcctcaggacgatacacattggtgtctctgctttgagctatatgatcaggcttttggcctcaccatttcactggaattgacctgactgccaaatctggcagaaaccgttgcatctttcagttgctctctttgatttgtgacacgcttccaattgcttcagcagtgattgcttcagttacgcctcattccctggatttcccacctcttggctgactgctcctcctgggccggctgtgttggcccttctgcccctgcccatgctcgcactgggtttcttggcacacacaccctatgcagtctcatccatgcttggaacatatgcccagttgctggagccaggaatgtgggcaccatggtgggctcctccctcacttccagtattgggtctatccccaagtcctgtccgtccgacctcctcagtgtttctctggtaacgtaaccgcttaactgctctcccagcctccaggtttcctcctttaatccactctcacattacagccaaagcgatttttctaaacagcaaaagggatcatgccactcccttgcatagggtttaatggctctccattgcctaggtgagagttcaaaccacaacgcacaagtgcctgaggacttggcccagcctctcccatctttcccccacctccactctgacatgcaggcctctaaactagtcttgctctgtctcttgcctctgggcttctgggcttcaagtgtgttgtcccttctgcctgagctattgcccccaccactaccaccctgttttaatgggataatttcatcttgattggtgtttcttcctccaggattccaccacctccccaccccacctgactggcatcttctcagctgtatctagggttggtgctccctcctctgtgctcccataacacctggtgcaggttttgttgacaccacttgtgtaggtgatgttggatttgccagccagcaccctctcatccgccctgcaggtttcttgtttgcctctgcctgcccaatgcctgactttcagtctaaattccttacctctttcagcttctggtggctgccagcatttctgagcttgtggctgtatcactccaatctctgcctgtgtgttcacatggccttcttctgtctgtcaaatctccctctacttcttagtgttagccgtacactgaagcaccccaaacaggatctctcacaccatagacacatatgttcttttatacaaaatgcacattgtttatgcagccacctcattagacaccctgcggacaacccacagctgtgcacacagcaagctcacagctggacttcctatcgacattctatctgcccttgaaccattttttccatccttgactgtgtcctacttaattaaagatgctgctgtctgccttgctacccaagccagaaacttgacggttatttctcaatgtctgcattcaactgtcactaagtcctatcaatctacctcttaaatgccacttaaacctgtccttaccagccttatttcagctgtttctggcctgcagcagctctgtccaatctgtagccattgcaaccaagttcctgcctcagttttgcttccttcccttcccagcctagtgcgttttcaatcaaatttatctttccaaatgcaactcgggttaacttgcattggtgctgtatacccacccaccctcccatgtggcttgcagatgcctgcggcctcatagctgggcatggcctgtccagtgctgccaaggtggctttgctttctgcttgcctcgcctttgccaacccctctagccatgtagtctggcataggcacttcctgggatggccttttcctattcaatctgcaggcaaatccaatttcaagtgtcagaccgaggctgcctccctctgcgcttcagtgattccactataccatctatttcacctattcccatctgctcaaaggccggtttctccactagtttgcatgccccttggcacagagaccatgtctgttaacttgtgtatgcccggagctttggacctgttgctagggctgtgtcctgggccatctgttcccgatggctagagttttctctctgaaactgttacagtggtagccgattctccagtgttcatgctgttaagttggtttgcatttcttataacaaaaaaaaacacagcccttttataatttgggggagggaagtctctatggggtttaacatatctgcttcttcatatttggaagcgggaagttttaatcagctgtgattctcttaaccatcatttcattggaatgggtacctggctgtccagatttgcccaatctatgggttgggtggttatctctttaaaaaattcattagtttcctgtggctgctgtaatagctttctacaaacttggtgggttaaaacaatagaaacttactcttttacagttctggaggccagaagtccgaaattggtcttatgggatggaaattcaggtgtgagcaaggccacacttcccttggaggatatagagaaagtgccttgctttcagcctctggtggctgccagcattcctgggcttgtggctgcatcactctgatctctgcttctgtgttcacatgacctcttttctgtctgtcaaatctccctctacctgtttctttctttgttttgttttgttttgttttgtttttgttttagacacctggtcttgctctgttgcctaggctggagtatagtggtgcacttatagttcatgtaaccttgaacttctgggctcaagtgatcctccagcctcagcctcccaagtagctaggcctatgggtgtgcaccaccacacctggccttctctgcctctttcataaagggacacttgggaaggcatttagggcctaccaggagaatccagcatgatctccccatctcaagatcttttcatttaattacatctgcaagacccttttttcatataaggtaacattggaggtttcagagatcaggacttgatatctttaagggtcattagtcagcctactgcagataagaacagtattcctgtgtagcggcatgggaaggcctttgaaaagtatgtgaaacagaaaaagaaaaaagagaagagaatgggaagtggggaaagtgaggaaggtagtaacactttgggttgctgtgtaaatggtttccaacaaccaccttcacagtgaatatcactccgcgtgctcagaactggagtgccccgggccatagtgcctcttcagcatggttgaagttgggtgggattaagtgttgatcacactgggttctcataattgagaagccctatctgtaaacattatcataaacaaaaagtggtactaagcttaaggacctcccagccagaagcattagtgctggttttctccaaaggccgtaattgcctcttcctctctcttctcgccaccccatccttgttcttgaagagcagatgcctggaggatatccttccagttcagcatacaaacgccaccaataatacttggatggcattagatccacaccagtttctaagaaacccttttgtcttaagattgggagaggactgtgtgtgtgtgtgtgtaataacagtagtaattctatttgattataaactttgtatgaattaagaaaattcttatgtgctattccttaagttgctatcatgaaaggtaaggaagaccgttgcattcagatctgcaccatgggcatcctttggttaaaaaaaagatggattccacatccccaaagctgtgaagtggggtgaagagtgactgcttctgttgttacaattatctgctacatgtcctcaactgtgatcccatctgcaccgtgatcctgctttttaggaataattcccattttacacaccaggaaagggggctacccctttctaccctcaaggactgtaaaggtgactaccagatgatctctaacctcaaggaaatggcaccagctctgtctcctggaaatagacacaaactattgatacaagtgggaaatgcttggagacatgtatgctctcaaggttatgaggcacagaggaggggagactcttctgcctctgccagggacccagatgcagctggcctgagcctggagatggtggtgccaggccttggtcctctcagtgcatcgagctccctgggccggggcctgacgaggacgagtgctgaagtccatcagttacccccttccatgcagtggccacaaaaaaagcgggggcagctttgccccagacagaggctttgctgattcctggacaggcctgagggggctgacagtggctgctctgggttcacagcctgggacatcagactgtgggcgagaatggtgaactcaccagaaggcattcgtctacgtggccttttccaaacggaagcacggatggtgcatctgcaaggcgaatggtggtgtttctttcccacgatgttctgagcagccaaggccgtttgttcagtttggatatcaagcttcacgagcccctgcacacataatgcatcagtggtgaaaagtactcactaaattatccgatccaaaagctattaaaaaacaacaacaacgcatagctggtttttgtttgtttttgcttttaaatcttggagattttagagctttactccttttgttaagagtcagccttgttgactcatgaatcacctgattgagaaagacgtgaatgtgcgtttagatttgatttaaaaagcgtttgctgtacttttttatttccaaaatctatttttttatatttggcatgcttatattataactttgatacatttaaatatcttaataaatatataccctcaaatttgaattaaaacatccactttagaactagatttaataaaacattatagaacttatacttgaagtttgcttataaagcactctcacaaaaactgggtcaaatgatttaatctgttttctccattatagagcagcctttctccccgtcccccaacccctccttttaaatgtgactcaattgatttggtacactgtctgcttctctgatatctgtgaaattactatgtctaaaaatagaaactcagttctctttatgctttctttctgaggtaggccaattgttaatattgcagcactttaaaaattgttagctggtgaagaccaatgatcaagaaccacagtgatgtcatctgaggttttacgaagtttgcatatttaatttgttttacatattgttgactataataactctagaattttctttccttttttttttttttttttttccagacagggtcttactctgtcacccaggctggagggcagtggtgcgaacatggctcactgcagcctccaactcctgggtcaagcaatcctcctgcctcagtcccccaagtagctgggaccacaggcgtgcaccaccatgcctggctaatttttgtattttttgtagagacagggttttgtcatgttacccaggctgttcttgaattcctgagctcaagtgatcctcctgcctcggcctcccaaagtgccgggattacaggcatcggcaaccgtgctcagcctaagtctggaattttaaatgactcttggaaatattcccccaaattgtgctttataaaaatcaactaaatttgaaaaatgagatgactagggcacgtgataagggtggtaagggggaaaaatgtctgaacatccctatgaaatctgacttcctttttaactttagttctgtccttgcaatcagtggactggagtgattatttgatttcattacggtggcatggttatcaaggtagtattgttactagaccatattatcagcaatgtaatacttattctaaaattaagccctgtgttctttctcctgggcttgaagttagttcatcagaattctctgttaaaactgaaatccccatttctgcattcactgtcttttactggccagcacagtgactggcctatcctcgattcaggtacgaaaaccaacaaccaaagaaacaaccaggtaggcggccaccatgacaataaagctacagtaaaaaaacaccaattgttttatcaggtgtaagctacccttcagaataacattgctcagaggttttgaataggaccagatatgtgcaaaaatgtcaaaagaccataaacacgcaaaaattacgtcaaatatattataaaagacaaaatatcacagagcaaagttgaactactgcaaagaactttgaaactgaaatgccttcaggcccgagaatcgacgttaattgtattggaagtgaagaagcttcagttgacgcacgtcacaggatctgaacgggaggtttccagtgtcgtccccactgtggaactgcgatgtgttgtcactgtagccccttggagcacaggcccagcagcacgtgactgaaggcaatcagcaatactgagacgaatcgctactccgaggcttcactgagttaaccccaatgatactcgctcagttaacaacctcaaaatcatttttggtcatggaaatcattactgaattatagtgaggatccaaaacttgaccatagagttataataatggaggggggatggagattctttgataatcaggaaattctaaattatctttcagagttttctaatatgttgatgactcagaagattttacatgcaaaaactagaactctgtggaaggattttacagtgcagaagacagaccttaccgttgcccttctctgatcctccagttgggcaaggcagttaccactaggcaatactagaaggcagtaacaccctaggagtgtagcattgtcctatctccagggcaggtgggctggagaattgcagcccatccttctaggccacgggcaagtgttactgccttgtagttccctctctgatcccttcaactggagcagcacccaccaacacctggggacccgggacacacctctcttaaagcactgggctggaatgttggcttatgagctgtctctacttgtagaccatgagctcctacgcaggtgtgcacctggccccgggtgagggctcctgtggtatttgcgggcggaatgggatttgcttttggggagagcagcagagactttctgtgcttctctctgggtcatctccctccccgtcagggcagtcatgatactgacatggctagcctcctgcccttaggtaggctgtgtgaccagtggtggctgctggattctgagaagtgacattggtcagctcctgattgttcatcacgtgatacctgtgtttgatgaacattcactgagcacgtgccaagtggcggctgcatgctatgctggctggcagggtgtagagacgcatggggctcaggccccaacccgagggagcacatcagcccaggggtgtgcaaacactttaaacacagtgtgctgtgtccccttcaaggcctatgtgtccctgtctccatctcacctcccgactgccagtcagtcttctggagtctccacgacttgtcagggtcaccagtagcctctgtgtgaccaaatcccggagtcatgtatttgtcttcactcattcaatcattcatggtgctgcactcccgacacacactgtgtgcatggttccatcccttaggatacttcagtaagcagaacagaaattcctgccctcatggagtctccgtgcttgtggacatccacaggtgttgagcccagagcagtccctcatttacctcctgcaggaagcgcctgctccgggggcacccagccccggaccatctctgctgtccctttcaccacctctagctgcactgttctctgccttccctcctgcccaggggccttgtgtgggctcttttctccacctgggatatccttcctctttgttcttcttgtgtctccttctttcattcagttcttcccatcctgatcctgaatttgactcattgtagctcttaccaatatctgctgtgttcttgtgtctttgtttactgtcagttaccccacccaaatatcagttccacggtgtattcctggcacctaggatagggcctggacatggcaggtgctcagtgaatacttgaaagaatgggcatcgggaagggagttctagatagaaggcctggcatggggctcagaggacactctggacctgagggtttggggcccagctagagccctggtgtgagggctgaggatggacaggtgggggcctctgtgcacatgtgtccaggtatggactccccttgggtaacaagaacacagggtggggtttcaaaatcaggagagacatgttcaggttttgagccttccacaagccttctccttgtggaagttcaaaggagaggaagagattagaagtggggtcggaggtgggggtcttctgcaatgctggcaaggaggaattaaacagcctgaacaagacagtggtgatggtatggacaccagcatccagggcaggcctgtggctcatcggatttgagaggagcctgcgacaatgacggtttgaggctgggggaccaggtataaccagagccctaccctcagagagacgcttcctcactccccactttccttcttcatgccctgtgcctgccccggagctctacgcagaaccctgcccccagccccaacacgcctgcccattgaacccctgccacagctgcattaatcaatcctgggtgtttatccaaaagaattgcaatcaggctctccaggagatgtctgcactcccacgttcattcacaacagctaagatgtggagtcagccccaatgtccatcgacatgtgaacgaatggaaagcgtggtgcgtacagccagtgaaatactattcagccttaacgaagacaattccgcaatacacaacaacacgatgagtgacacaggccagtcacagtgggacaaatcctgcaggattccacttatatgaggtggctaaagtagtggaactcatagaaccaaagagtgggaaggtggctgctaggagctcacggaggggaaatgagggttgctgctcaacaggcattaagttttaattaagccaaatgaatgagctctagagctccgctgcaggacatcacacccatagtcgcgatgctgcggtggacacttagcattttagcaggacagatctcatgtgttcttaccacaataaaaataaaataaaattctggaattaacatcaccaaacaggcacgatgggatttgattatattgcaacgtatgctaagaaggggttattcatctggtgacagtggcatacatcctgccacggtctcctctggcagctgcccagagcacacagcagtccaggagatgcgctttgaatgctgtacccagcacttcatgggaaatgtgactttttaaaatggagggtgaatacgcgaagtcacaagtgtccctggaaatcagggatgtgtggctgttcacatgtcactactggggagcgtactgtgtctggggagggcctttgtttgagacaagacgtggactgaggacaagagagccaagccaagtcctgcaaaagaggaacaacagggcagggaccgggtgaccaggtggcgatggaacgtagagcccggactttgctgggcagtgggcaaagggcaggagtcaggctctggaagcctgggattccgagctcctccagggtctttagcccctggggtgaaggggacagggcacagagccgtgcgaagccccacactggcattcacctcaggctgatgacagtggcagtgcgcaggggcgctgcaggaggccggggaaggcgaggtcacaacaggcacaatagggagtcgttgccaggcaacctctctaggcttctgttgtgattctgctttagttgggtctgggggggtctctctggagagtggctataaatgctagcctttgtgctgggcagcaaagcaaatcatcgggaataacccgggagcctggcagggaaaccgctgcactatggagaggacgcttccagatacagaggacaaatcaagtgaagggacggaacaggtcacacccagagcggcacagaggtgtgtgagctgttcccacggtagtcagagcctctgttccaactgtcctcccgctgggctctctccggtccccagtgcatgggctggagtgtggcccctggcagagccctggaggccggctctgcttcctgcccccttccagcctggagcagcccgagggcgcagcattcctggggcaggcctgagccctgtggtgggctgagttgagtccccagaaaggtagattgaagcccaaactctctgtatgtttgaacgtgaccttatttggaaaaagagtctttgcagatgtgttcaggttcagatgaggtcatcctggattagggtgagtcctaaatccaatgctgtgaccttataattgggggatgcacagggagaggccgcatgaagatgcaggccaagactggggcactgctgctccaagccaaggagcaccaaggactgaagacgcccgcggggcgctgggcaaggtgcagagggattcttcctgggggcttcagaggagggtggtcctgcccacacctcacttttggacttctactctccggaactttgaaagaacacatttctgtggttttcagccacctggtttgtgggaatttgttatggcagccccagaaaacgaatacaggcaacatcacttagtgcttaagaaagagcctgtgcccgggcgcggaggctcacgcctagaatcccagcactttagaggctgaggcaggaggatcgcttgagcccaggaatttgagaccagcctgggcaacaaagtaagatcctgtctctacaaaaaataaaaaaaattagctgggcgtggtgatgcgcgcctgtgtttccagctacatgagaggcagaggcgggaggatcgcttgagcccaggaagtcaaggctgcagtgaaccatgttggcaccactgcactccagcttgggtgacagagtgagaccctgaaaaaaaaaaaagtctgtgggcccacgtctcacatcctgaccccgccggcgatcaactgtgtgaccttgagtgagttacttaaactctctgtgcctcggtctccccatgggttgtggaagggttgagttgatgagtgtaaagtatgcagacaacagccaggtgcccagcatgatgtaaacaccgcaagagcactggctgttgtgaaaggtgccgtgtttaagaattggagtttcccaacgggttcagtattagtacctgttctttagggcacagacttgttctgtgccattttacctgtatccatttcaaccagacttacatcttttcgaaggaaggcctgagaaaatctcaattctcaactggagtgatgattcaaaccccttgtttcccttccttttctttggggtctctgttagtttcctgtggccaatgtaattaattaccacaagcagggagcttaaacatcagaatgcatctttcacaatctggagaccagaaatccaggtgcaggattttacagggccatgctgcctctgaaggcaccagggtagggtccctcctcgcctctcccagtttgctggcatgccggcaaggctcggcactccttggcaggcaccagccgtgctccaatcactgcctgtctttgcatggtcatcttcttgtgtttctctgtatctctcctcgtataaggtccttggtcattggattcaggacccaccttactccagcatgacttcatcatcacttaattacatctgcaagaaccctgtttccaaataaggtgacattcttaggtactgggggtgagtatgtatcttttcttcaacatatctttttggtggaatgcaattcaacccagaacaccacctctcacgaaaacggctaaaaacggctggggaggcattttcaagaactttcactaacaaattttaaagaatagatttcactgtaagccttgggcagccactgaagagtgtgttggaatagctgctgagtgtcggccactactgggtgacgtttccttaatggctggaagagtgaaggaattagggccgagcgtgtatgcacaaaaacttcttctgttttgactgtatgggcttcttcctttcatttgttcatttagcaaacatgtattgccttcttttgtcttctacgatctatgaaagataaaatgtggtgtgaggacacggcccagccccaccgtcgtcttccagccccaccatcgtcttccagccccaccgtcgtcttccagtcccaccgtcgtcttctagccccaccatcgtcgtcttggactctctgggtggcaccacgctgtgggtgctgctctcctctgtgtcccaaacgagtttgtgcctcactttgtcgggttttggctgtgacttggagcctcaccaagctcccttttcctctgtctcccattctcctctccaggccagggtggcttccccagccctcctccccgggtcctgcctgtgccgagccttcctcccaggagggaggtgatactgacttgagatcttatgggtgttttgtttgtggctgggcctggccgaccctctctccacggccttagatcacactctggatggataggacagtcgtcctcaatactgagcctctttggagcatacccactgatggtggttcacaagctacccacgcccacaggctgacccagatctccgtgaaattaaaaaatactgtgaaaggaaaaagagccaatgtcatgtggataatgaagtgtcagccactgaaaaatctcaaaataataaacatggcttgtttgtcagggttctctagagaaacagcagcaactgtgtgtgtgtgtgtgtgtgtgtgtgtgtgtgtgtgtgtgtgcgcgcagagagaaagaaggagggaggaagacataaggaatcagctcatgcaattgtgcagcctggcatgtccacagtctgtaggatgggccggcacgctggagacccaggaaagagctgcagtttgaataggaaggccatgggcgggagagttccttcctgttcaggggacctcagtctttctctagaagacctttggctgaccggatgaggctcatccacgctatggacacaaatcagctttactcaaagtctactgatttaaacgttaatctcatctacaaaaagtaccttcacaaaaacatctagaacaacgtttgaccaaatatctgggtactgtggcttagccaggttgatacatcaaattaaccgtcaccttttgcttaatctactttttaatttgcttttactttgaaaacaagtaaagtttttgtaagcctccaagttgagattaacgatgtgagaaggagaatccataaactttcctgttgaacaaatagcagatggattttttcaggaggtggggaccacacagggctggcctgctctgacgtggcagccgcagaggggtggcatcagcagcagacagtctcatgtcctcagccctgccgacgtccagatcactgtggagtgtagctattactcatgcctttttctttgatctttgcctttttccttattattttttttccttgctgaagataaaaataaaatggaagtaatgataaaaccacagttcataacctaaagtgccacaaggattaatgacaaattggtgccctggacatgttcgtcacacagccaatgtccccgctgtgccagatccattttgaacgtaagctggactgtctcaccctgacagagttttccagtcctcttcctcccaggttctcagtgtggccagtccagacatctgccttgcaccactgcctcctggtgacccctcctcacgggacagctggacacaacctgcctgattcgccctcagaccccacaccccacatggactgtgcagacctatgccccagtgacccttcagtcacagtgtgaccccacggagctcttgcctgcttgctccagacccaccgattagaactcccgtggtaaacctgcttggctaactccttggtccccataaaggtgttggcccctgggtctccctatctttccccctgcccgatggttgagtgtgcatgtccccagtggctccccactcccgtcagccctgcgaggtgggctgccctctcctctcgcggccctgggagacatcagctgcttctgagctcatgagctctgcagcaccgcctcctgtgtctcagcccagctcgctcctggtcagggctagaatttacagccactctcaagagagacctcaggccaaattagaaaaaaattaatatttacaaaacagcatgtgtgtatgtgtgtgtggggtgtgtgtgtggagggctgtgtggtgtgtatgtgtgtacatgtgtatgtgtgtggggtgtggtgtgtatgtgtctgtggtgtggggtatgtgtgtggggtggaatgcgtatatgtgtatgtgtacatacatatacacgtttaaaggtcaagctgttctttaatcaaccagaaagcgtaggacacacatatttcttagttttttccaaactgagatagagaaaggaagatgtttttaagtatgtataaattcgtattcattttatgaagagagaaggaaaggcccgctctgccagtgccccattacagcccatacaccctgcaggtggctggggcatgagaagcgttgagttgcctctgggtgacagggggcctagagcccttgcatcttggctgtgtgtgtagtgtagggtgtgtggggtgcgcgtatgtgtggtgtgtgtatgtgtgtgtggcgtgtgtgtgtgttgtgtgtgtgctatatgtttgtgtgggaaatgggtgtgtgtgtgtagggtgtgtgtgtggtgtggagtgtgtatgtgtgtgtgggtatgtatgtgtgatgtgtgtatggtgtggggtgtgtgtggtgtagggtgtgtgtgtggtgtggggtgtgtgtgtgtggtgtgtgtgtagggtgtgtgtgtgttgtgtggtgtgtgtgtagggtgtgtatatatggtgtggggtgtgtgtggggtgtgtgtgtgtatgtgtggtgtgtgtgtggtgtgtgggtgtgtgtggtgtgtggtgcgttcatgtgtatgtgtggtgcatgtgtgtgaggtgtggtgtgtgtgggtgtgtgatgtggggtgtgtctgtggtgtgtgtgtgtgtggtgtgtgtggtgtgtgtgtggtgtgtgtgtagggtgtgtgtgttgtgtgggttgtgttgtgtggggtgtgtgtgcggtatatgtgtgtgtatgtgtggcatgtgtgtggttttatttgtgtgtgtggtgtgtgtgtgtggtgtggggtgtgtgtgtggtgtggagtgtgtggttgtggtgtgtgtgtagggtgtgtgtgttgtgtggggtgtgtgtgtgtggcatctgtgtggtttttttgtgtgtgtgatgtgtggtgtgtgtgtgtggtgtggggggtgtgtgtggtgtatttagggtgtgtgtgttgtgtggggtgtgttatgcggggggtgtggggttatatgtctgtgtatgtgtggcgtgtgtgtggttttgtgtgtgcgattatggtgtgtgcatgtgtgtttgtggtgtgtgtgtggtgtgatgtggcatatgttgtgtgttgtgtggtgtgtgtggggggggtgtgtcacacgtatattggaatctgaaccaggtgctgtttgtcatcactctgcctctgtactttgctgaagcagcccacatggacgatggggcccttcccagtgctgcagagtcttgagctaagagtttacgtattccaagacaacgcacatgggacatgggacttcctcccccgtgctcctcctgtcctccgcctccttgatgagctggacgtgcggggagaccccagacctggcgcatggctggttttgctctgtgcctgcacagaccggagatgcccttggtgacgccgtctgctcctcccgtgctttcagacacagtgagcgccctgtacccaagtgtgtgtcacgcaggggtgctggggtccctttcgtctctattccccattaaacatctttcaccattttaacatgcaggcatttagaaactcttttttcatataataattgtctgagctcagaaaagccagcagcgttactcactgtcaccgaagtccagatggtatttttattctgtgctcaaattggcttcctcatttctttccaggccctgtaagcagcttaaaatttccattttccaggtcaagctgttctttaatcaaccagaaagcgtaggacacacatatttcttagttttttccaaactgagatagagaaaggaagatgtttttaaatacgtataaattcatatttgttttatgaggagggaaggaaaggcccgctctgccagtgccccattacagcccatacaccctgcaggtggctggggcatgagaagcgttgggttgcctctgggtgacagggggcctagagcccttgcatcttggctgtgaccgtggccttcgatcgagcacagtgggtgagggccttctgaataagaagggcaccgccacaccctgtggggccgatgagcaagtcagttcctctaatacaaactctgcattccttgtggctccccaaaaaggtcagaggacttaggagatggagaggaaccaggaggtcttctagttcaacttgctcacttttcagatgcagagttcagttcaccgaggctggggcagcatcaggatcagaacccagaccctttgaccccagggctctttgcccgcagcatagggaggctggagagggccctctgcctgtccccagtcttgggaaagtccttctctgtgcggcggtgaaatactcaaagagaggtgaaggcggggcctctctgggaaggtgacctggggtaaggagcctgggttgcaagtctctgggagtcagtgggaccctgctgtgcccttggcttttcctctatggcccttctctagctcaggaactctactatgctgttcctggtgccacctgtcccagaggttgtgagccagtaccgtgttctctgccctcaaatatgacttccatctgtttcctcctcagtatttacaatgcagacagagattgcctgattctgtgttgccgcccttccactctaggctgcctgggtcagctgcgtgtctgtttctgtagatttggaggggcctcatcctgggctggctttgcataacgagaacaaacaagagctgtccaaactgctgtggaaccaactttcctttccttgagaggaagctggaattcaaggtgctgagtgaacctacttccagacaggtggtcctaaatgggaagtgttgcatggatctcagaaaatgacagtccctaaaataagtccatttgtttttccaaaatcaccaaaaacctgggagtggaacgcagtcacctttgagacacagcttgacagtgactgtggcctttgattgagcacagtgagggacagacttttgattaagaagggcaccaccacaccctacaaggctgatgggcaagtcagttcctctaaggcaaactctcctttccttgtggctcgaaaaaagccggaggactttggagatggagaagaaccaggaggtcttctaggtcaatttgctcacttttcagatgcagagcttagctcaccgaggctggggcagcatcaggatcagaactcagaccctttgaccccagacaggtagtcctgagattattataagctccgtttattacaacttctgggagccaatcatttgaagcagaaggtaatgtttcctgctctggtgaaatgaagactagttgaagaaacagtttgcagaaatattgaagtgtagctccattcagctctgtcttaaatagtgtttgtggcagcagtcaggccttgaggggtgttaagggctgaattgcatccaccccaaactcatatgttaaagtccgaacccccaatacctcctgatgtgactctatttggaggtagagtctttaagtgagtgaataaatcagattcactagtgtgggccctaattcaatctgactgtgcccttatcgaaagaggagatgaggacacagacactcacagagggacggccacgtaaggacacggagaagtcaccatctgcaagccaaggagagaggcctcctggggaaccaaccctgccgatgccttgatcttggacttccagcccccagaactgttatgaaataaatgtctgtcatttaaagccacccagtctgtggtatcttgttatggaagccctagtaaattgatgcaagggacaaggcagtcagaagtggcattcgacttccaattagaagtcttacaaatgctgtaggctccaagcccagggtcaaggtgggaggctgtgtgcactcgggaagtgctaaataaacgcctggtcactactgattggtccacacatggggccgtgggtgcagaaactgctgttgtttttagcaacaccctcatagacctaggaaacaatgccatcatcaccaactacaactctgcctctcttcacatgttaactttgtaaatagaggaagataactttgataatgatggcctataaggactttcttttgaacaggataaatctctgtggcagagatcactggttgccacccccacatccaccctccaccttcccttccttcttagcaacagaactctgctttatctggagtgtttaatgtgcccagctaaaagaccacttttcccagcctcttgttccttttggccctcatatgatgttctgccaaaaatatgtccacggaaatgtgctgtggggattctgggaagtcttcgtcaaggggaggggatatttctcttggatccctctgcttctttccctctgttgcctggaatatgtatgtcatagctggtgctccagcagccatattgttccttgagttgcctctgagaagggaagccacatgtggtagaacacaaaaccaggagcagcctgggagtctggtggcttccatattttccctgaaacacctgctttcacactcgttttatgtatgagaatgaaacctttctgtgtttaagccaccacagtaagagctttgctacatccagctgagcataatcctaacattttctgtggttcaagatgaatgaaggcatcttagtccaaagaggttaaaaaaagtacctgagtgtacatttggtgactagaaacgcctccctcttttctggccctgaagggatgtgagaacctctgggttacatgaatctggtgcactcagatacatggtgtgtccttcttgttcccagattgacgactctgctttctcttggtccgtgatggaagaggaagcccgaacgcacgcctctatcagcaactctgcagcaccgcacttgccactcggagaaaatgctttgaaagcccagacagccacataccattagaaacaggtaagagggctgcagctggcaaagacaatgcgtagctttttcctttcttttcacttgtgttttcttttcttggctttagcttgatcttaatccatgttagcatttccatgtgttttctctgtaaaaggagcgactttggagctttgcagattggaaaaataagtagggtgaaggaagggtgagacctgggtgagcccagacccgggggtccaggatccaggccctcagcatggactgcccatcccccaggcaggtacaagcccggggttggggattgggttcatggaagagaccctgaagacaccctggagaagcagctgtgtggtgcctggcagccacagtgcagagacaaactgcaggaaacaatggggaacctggcccagttacaaatgggatccgtgggcacaaacaagggcagagcccagcaaggaggcagcgagcactctggaaatagcattgttggctgattgaaggtgtttgtggttgaaccaggtggcctatttcaaaatagcaacctgaccaggcgcaactgggctctccttctttccttacagatgttgtgaggacctagaggcggggccaatccagtcacttccagaggctgctctggtccatgccccaagggcaggagtttaagaggtggtcccaggaggcagtccttggtctcagtctggccttttggggtccctgcactggctgaggctcaacactgcaggggaaggctgactccatctccagccatcctggaatttcccttcatatgcagcccatgacaagctggaccccacaactctctggagttctggcccatgttggaggtgccacgctgtcctcagaggggctcagacagaggagcctgcctttgagggaagcaggtacaagcccacctcattgcagcctcttctctgctgctgtgtttttacctacactgctccagacttggcctttgaaagctcatgttgaaacatagagttccatgaaccatgagatgtcactggttacagagtttgttttttttttgtttttttttgagacagaattttccctcttgtcacccaggctagagtgcagtggtgcaatctcggctcactgcaacctccacctcccaggttcaagtgattctcctgcctcagcctcccaagtagctgggattataggcatgtgccaccacgcctggctaatttttgtatttttagtagaaacggggtttcaccatgttggccaggctagtctcgaactcctaacctcaggtcatctgcccaccttggcctcccgaagtgctgggattacaggtgtgagtcaccgtgcccggccaggttgcagagttttaaaaatttttaaaattatatgcccaggttatcattggtccactgagcattctcttgaacaaggatgaagacccagaaacccctctgccctgcagaaggccccctctggcccaaggtctgtctcatcttggctttagatcagggttcccctgggagctttccaaaagcccagtgccaggccgcaccccaggccactctggtccgttctcctggggagggtgtgggtgctccccaccatcccagtgtttgccggggctgagggttgttgccagatgtggacacagggcacagccaggggcaggtgggtgctggagcaaggccctgctgtcagctcaggaagcctgaccttttgaggggcccagccttgccaagggcaagtgagcttcagcctctgaaactcaggttgctgtggctcaggctgcagttagagacctgggcaagcatgggtcttcactgattagcagccttgggcacatccttgctctgagctatagggccctcctgtgtacccagggatgacagcagccccttgcaggctcactgtaaaggtggaggcaagagcactggggaccttgcacagtactggacccacactgccctgagtctcttccacttgaacaatatgcacactcagatctggacgctccctaggctggcctcctcctttatctgctgatcttctgacagacttccctagctcctaaagtatgttttctccttcttcttcaagagatttttggccgggtgcggtgccttgcgcctgtaatcccagcactttgggaggctgaggcaggtggatcacctgaggtcaggagtttgagaccaacctgaccaacatgacaaaaccccgtctttactaaaaatacaaaaattagctgggcatggcggcaggtgcctgtaatggcagttactcaggaggctgaggcaggagagtcgcttgaaccccggaggtggaggttgcagcgagccaagatcgcgccactgcactccacactgggtgacagatcgagactctgtctcaaaaaataaataaataaaataaaaaaagagattttcactattttctctgtccagttcctttgggagctgttagcctgtcagggaaggtcgctgcctttccccatgtactgtggtttgcttatattagagaccagcaggtgcctgtggttttttccttctctgctttttttttttttttttttttttttgagatggagtctggctctgttgcccaggctggagtgcagtggcgtgatctcagctcactgcaagctccacctcctgggttcacgccattcttctgcctcagcctcctgagtagctgggactacaggtgcccacccccacacctggctaatttttttgtatttttagtacggacggggtttcactgtgttagccaggatggtctcgatctcctgaccttgtgaccgcccacctcggcctcccaaagtgctgggattacaggtgtgaggcaccatgcccggccccttctctgcttttttccccttccactgacatttcacatttcctcaacctggcctttctgctttctttaggtccttcccccactctatgctctgtccaggtgaagttgtgggttaattataataataaccctctgttttgtcgctatttcctcccagggtgttctctaatcagcagaacttttcttcctctggttctaaaccttgggctaatctgaccatggttttctgagtggtttggtctgtggacactgaaatcccctcttgcttggctgggtcagttcactgagtaccctgcccatggttccctcttgtcctcctaaccccagggggcctttgacggcccaggcagacaagtcaatgcagcgtgtgctggtgtgtgcatgtatgtgtgacgcgtatgcacgtgcatgcatcatagtctgtaatttacacatagcgagttgcttctccccttccgctggtcgttgtttccttcattcccttgggcctgatgttgcacagttgcttggtggaattcccgctcatttcccagtgagagagcagaagaagtaatcaattgatctccgtgggatttggtctaagtgaagaaagcacaagtgagaattttacatcaccctttggggaaaggttttggtccaagaattttataatgaccgtgtttgggtgtggatattgtgcccagcaatgggaaaacatgatgttttgatgaggggttacgaaaactgattgttggatgtgtagacactagcattcatgaattgccagattccatggtacggtgacagaaggaccttaccatcttggtttaagtgaaacacagtgtattagttcattttcacattgctgataaagacatacctgaggctgagcaatttacaaaagaaaggggtttcactagactgacagttccacgtggctgaggaggcttcataatcatggcagaaggcaaggaggagcaagtcatatcttacgtggttggtggcagcaaagcgagagcttgtgcagagaaactcccatttttaaaaccgtcagggctgggggcggtggctcacacctgtaatcctagcactttgggaggccaaggtgggcagattgcctgagctcaggagttcaagaccagcctgggcaacatggtgaaaccctgtctctattaaaagtgcaaaagttagctgggtgtggtggcacacatttataattccagctactcaggaggctgaggcatgagaatcacttgaacctgggaggcagaggttgcagtgagctgagatggcaccagtgcactccagcctggttgacagagcgagaatttttctcaagagttcgagaccagcctggccaacatggtgaaaccccatctctactaaaaaataccaaaaattatctgggcatgttggcacacatctgtaatcccaactactggggaggctgaggcacaagaatcacttggacctgggaggtggaggttggagtgagctgagatagtgccacttcactccaacctgggcaacagagtgagactctgtctcaatacaataaaataaaaccatcagatcttgtgagactcattcactatcaggagaacagcacaggaaagacctgcccccatgattcaatcatctcccactgggttgcttccacaacatgtgggaattatgggagctacaagatgagatttgggtggggacacagagccaaaccatatcacatagtcacggggctgtggaggcccagggtggctgccttcaaccccaccggggctgctagacaccctcctccaggatttgaactgatgcccagcacgatcgggggcaggacctgggtgcagcttcccccactcttgtgcacgtccttagatagtatgtgaagcaaggcgctagccacaggctccaagagttgagagtgctggggtgcctcatcaggaactgtggtgcccctgcagctcctttctaggaaggcagagaaggcactcatgtcagcacctttcagctggtgtcaggtcagacaaaggcactgtctccactgcaaacaaacacaattcttttttgatgaatcagaagtcaagaaaccaggcctgcaacacagtagtgaagaggtagaaacaatccaaaagtccaataacagatgcatgggtaggcaaaatgcaggacgtccatagagtgaaatagtattcagccatgaaaaggaatggagtacaggtacatgctacagcatgggtgaaccttggaaaaattgtgctaacggcaaaagaaactatcatcagagtaaacagacaacctacagaatggaagaaaatttttgcaagctacccatctgacaaaagtcaaatatccataatctagaaggaacttaagcaaacttacaagaaaaaaacaaacaaccccatcaaaaagtgggcaaaggatatgaacagacacctctcaaaagaagacatttatgtagcaaacaaacatatgaaaaacaactcatcatcactggtcattagagagatgcaaattgaaaccacaatgagataccatctcatgccagttagaatggtgattattaaaaagttaggaaacaacaggtgctggcgaggctgtggagaaataggaacacttttacactgttggtgggaatgtaaattagttcaaccattgtggaaaacagtgtggagatttctcaaggatctagaaccagaaatatcatttgacccagcaattccattactgggtatatactcaaaggattataaatcattctactataaagacacatgcacacatatgtttatggcagcactatttacaatagcaaagacttggaaccaacccaaatgcccattaatgatagactggataaagaaaatgtggcacatatacaccacggaatactatatagccataaaaaagaatgagttcatgtcctttgcagggacatggatgaaggtggaagccatctttctcagcaaatcagcacaggaacagaaaaccagacaccgcatattctcactcataaatgggagttgaacaatgagaacacgtgggcacaggaggggaacatcacacactggggcctgttgtaaggtggggggaaggggagggagagcattaggacaaatacctaatgcatgtggggcttaaaacctagatgacaggttgataggtgcagcaaaccaccatgtcacatgtatacctatgtaacaaacctgcatgttctgcactcgtaacccggaactttaagtaaaataaaaaaaattaaattaaaaaagaaaagaaaatattgggctaagtaaaagaaacagatacagaagacccaaaattgtatggctcaatttacatgacacgtccagaatatgcaaattcgtggaaacagaaagcagataagtggttgcttagggcgcagggtgaaaaggagattaggaggattgaggaagtgacagctaaaggggcttctttttgggggtgatgaaaatgttataaaatggacggcggggatggtcacacaactccatgctaaaaagtgaattgtacactttaaatgggtgaattgaatagcatgtgcggtatatcgcaataaagccattacaacagaaagaatcaaggaacaaacaaaagtggcagggttgggaggacgggtctggaggtagcagggagggtcacagtccccagggcccaactgggagctctcctgttccccggaagacatgctgccacggcccctcccaccagttgtcacttaatctcaggaagagtctgccacaaatgccccgttgcgacggctcttcccagcagaaggggagaaaaagaggcccgagtccccgggagctgatcaaaggtctgagctgtgctggcagtgaccattgtgcaactgaacaaatgcgtggcaggaatataaacagactccacctttcagcatcgagcttggttaggaacatggcttgacagccagcttcgtcttcctaagccgatgttaaactccatccatcactttcattctttgcatgaatcttgttctttctatttggagccatgtactctgggtcttagagaatggaaacaggcccgaaagcctgtcagatgcacttaggataaatgagaagtcattcctttcgccatggcgttaggaagatgacggtgaccctgccggtagagatggccttccagagtgtattgcctgaatcctgcctatatccaagctggtgaaccctggctgcctgccggctgaatgatggggtcgttctcaattccacccagctcctagcttgctgttcttttccttcccattggcctgtggctctcccttccttgggtccccggcccctgccctcagccccacaatcccggagctgcattcaagcccctcacggccttctacactctgacgtcttgagaacaagcacacaaatgactgttcattctgtggtagactgaataaaggccccccaagatgtctgcatcctcatccccagatatgtgaccccagaaggcaaaggcacttgggagaggtgactaagtgaaggatcttgagctggagagattttcctggatatccaggtgggccccaaatgtcatcacaagggtccaagcagggaaagaaggagggcaggagggtcattgaaggaagtggagatcagagctggagagaagtttgaagaggctggctgccctctggccttgaagatggaggaggggccacgagccaagggatgcaggcagcgtctaggagccaaaaaagcaggaaatggatcctcccctgaaactccaaaaggaacacggcgctgctgacaccttgattttagacttctgacatcgggaactgcagggtaacatgttattctgcctgggctgctgtaacaaaacaccatagactgggcagtttataaacaacagatgttcatttctcacagttctggaggctgggaagtctgagatcaaggcgctggcagatttaatgtctggcgagggccacttcctggtttatagctggcatcttctcactgtgtccccacatggtggagggggtgaaaagtctctttctagggtcccttttataagggcattaatgccgttcatgagagcctcatccctatgaactaatcacctcccaaaggctccatctcctaataccagcaccttgggggttaagatttcaacacgtgaatttgggtgggacacactcagtctgtagcaggtaataagcatatgtcctgcaagcccttgagcttgtgtgctttgttacagcagtgacgggaaactgacacatgggttttacccttggcaaaggcagggaaacaggcaaggtttcacaagaaaggaagctgtaagatcccgaaagtcactagttctggaggacactgtccttcccacagtatcaacagacccaggtctgttttccacggttcttctctgactctctggttgaaacttatccagggagtttcccaattcttgtgtgtgtgggggggtcatcttgcccaaccctggccaggttggagcttgggccaggtgccctgggctggctgcagggcggctgctgggggtgtcctggccactagttctgatggagctccagcctctcctcacctgtcatgagcaggtgaggagacctgcccacatgacctgcccctccccatcctgagacgctggatgcccacgttttctttttgccgccatttcggagtctgctggggaggagggcggatgccgtggccccccttgtcaggcggccctgcttatctctgcaagttgtctctggatgtctcacaggagccttcacaactccaggccctggaggttggccgagcccttgaaacttccccagcagccctggggcctcattgctgggtttcagcctgccgcactgttccctggggctctggcgctgagaggcccctccctctgaggggctcagttgcttggagtctgttcagcagctggaagaggaggcggtgcttcttcactgaggctctctgcctcacgtgctttgccatctatgttctgagttgatgtcttgacaaagaccccctccttggtcgtgagtgacagagcaggggccaagctccctgtgtctggtgaccttgagccccttctgccatgcccagcgggcttctgtcccttttgcttccaagtccctgttttccacgatggtagctttgagctctccactcctttgaaaccccgaccctaatgatgccggagggagccctccatgctcagaggaccagctgcagccacctcttcaaattccttttgactcattcttgcgtcatcactggatgcgtggttgagtccttgcttggtagcaggggctagggattctgtggttattccggcccactaggagtttacagtgtcatggagactaccaaatacagaactatgcaaacatctaattccattgtgatgaggggtatgatgagaaggttcagggcagcgcggcagggcccatatggtttcagggccagtgaggccatccatgagtgtgatgtttaggctgagagtagacacctgagtggcagggaatggactgtgtctgtgtgtgtgcagatgtgtatgtgcttttgcttaccacagggcaggacgccacattccagatacgtttgaaaggacgtccgactgctcgttcacttatctgtctgggaactgctcctggagcaccacaatgccaggcccaggctggggcatgaagcagtgtggactgaaatggggagtggacgccagcgagtggtcactgccttctctctggagggaaggaaggtagcagcttgggcaagagcgatggccaggagagcagggaggctgaatggagaaagaacggagaatgatcagaaggtcctgggtgccccagggccagaggctgattgaaagtgctggaagaggcacagggcaggccccaggggcctctagtctccagcatgaacaactgggagaccttggggtcccttgaaggagagaggcaggcacagagaagtgagttgtggggtcaaggggctgtgagctcctattcccgcttctcctggggtgagtgatggtggggaagcagggagtgcagcagaaagaaggaggggcgcctcagagaaccccatgtgactgttctgtggccctgatacgactgttctgtggctctgatgtgactgctctgtggctctgatgtgactcttctgtggctcttatgtgtctgttctgtggctctgaagtgactcttctgcagctccaatgcaactcttctgtggccctgatgtgactgttctgcggctctgatgcgactgctctgtggccccgatatgactattctgcggccctgatgccactcttctgcagctctatgagactgttctgcagctctatgagactcttctgcagctctatgagactgttctccagctctatgagactgttctgtggctctgatgtgactcttctgcagctctgatgtaactgttccgtggccctgatcgactgttctgtggcacccacattcttcagagccacactcagatggaagctttgctgtgtgcaggggatgaaaccaactgtcattcatcctgctggaggccaggatgtctgccacaccccccggggctgccccctgcctgtctttcctgaagacgttctctctctggccctgttcccagggcaggctgaaggacaaaggacaggaaggtaaggtcccaggagtgacccccagtgtggaggatgagagttgttggataaatgtcccagctccctcctccctccatggggcagttctggggcatgttctgctcagacctcaatgcagtcccagtgggatgaaccgaagttccctctggcagggatcctctctctagggtacctgcactcctgccttcactgtgcttcctgagatcacccccaaaatcaactgcttgcccccaaatctttgtcatagggttttcaagagagggacgtgaagcaaagacactcatgaaagttctttgtatgtactatgattggctctgtcagtttaatggaaaagttggtaatggtgcattattattattattattattattattttgagacagggtcttactctgtcacccacgctggagtgcagtggcacagtatcagctcactgcaacctcgacctcccgggcccaagcaatcctcccatctcagcctcccaagtagctgggactaccggcacatgccaccacacctggctaatttttttgtacagacgagattttgccatgtttcccaggctggtctcaaactcctgagctcaagtgatccacctgccctggcttcccaaagtgctgggattacaggtgtgagccactccaccggctgcataattttttttaatgagaaaatatcttaggaataatgcttggtgaaacattttattgagtcataaaggttctaatttacttatttggagctagatttttctgacatttaaaagcttgtgtctcaattaatttgccgtgtaaaaacaacacgtggctgcacactgccgtcccacccaggttaggtatgaggaggaggaggggagcaatcccgcaggcatggatttgggggcggggtgaccttcctaacatgttttaacttacaccgtggaggcaccttcagctgtgcctgcatctgaggtcaattccgattcccacatccaccccgctacacacacctcttccctccattccatcccgctagtctctcctgcagggtgagatctgaaataaacagaaatactgcagatgtcagaaagcaggtgtctaaagcaccctgcgctcttgagcctgtggcagctgcaggtttttaaattgatagcaggggtgaatcaagaaggcagatgctttgctgtggccccaccaagggccaaggacaagcggaggctctgttcacagtcactcttccttctaagactccaggtctgtgatgtaattaccaccaaaagcagaatcaagccaagttgtccaatatgacttaattaattatatttcacctgtaacagtgactaactggtccatacttgtcgggcctgctctggtggacggtaggtcagtctctgctggccccttgatgctcatctgtgctgcctgaggatgtgacagcggcccatcccgctacggggcccaggtgtgctgcttgggggaggcagcaggactctgaggaccacagatttaaaaaagcacaatattttggagcatctttttacccttttgttatggaaaggttgtcccatcccttgatcctcccacagatccctcgtctcagtgcttggaacttgcttggtttaagaagtcagaacaggagggctgtgataatcacacgctgatgattgtgaggcacaaggattggtggtgtctgcctgaagggtggggaggggaatgtgcgagccgcaggacgcccaccaacgccgaggggcgaggcacagggaattctaacctcccagcagtgggtggtcagcacgggatctactttaataccatgaatagtgtttccaatgacattaacagtgacaatggcaactaaaagcacgctccgttttacaaagtgcttcacatccatggttttgtttgatcctgatgatagcttgtgagtgaggttttctttataaagcctcatttcacccaggaggaagctggggctcagagaagctaagtgcggccctaccagccagtaaaggatagtgccggggcccaggggaccttccgagcctcgtggctgggctctggctgggtttggtgacaatggctctttctctggacagttgtgggtgcacaggaaggtggccccgtgggcctggctgcagcagctccatctgtgagttcccgtccagtccccaagagccaagggcatcacttgtcagacgaccgaccgagagccacgtgaaaccgtgggccttcgctggtgtccctttagaagctcgaagatatcccgcatgtctcacagttttggcctgaggcttccagcccacctcacgtatcccattccacgctcctcaccacccagcctgcctcagctcggtgtcttctgggctcctcattccagcctcggggcacctccctgcagccccatgcctgcctcctgttcattgtggctttgagcccccagaatgggtttctttgggagctggtggtctccagcattggaggtaaatcctgcagaagttggacccccaacttccatcatcagatggactcgacgtagctgtttatatcttcagctgggcagccacagcatgggtttggttgaagggagaagagagaaattgatttcaaaagttgataattaaatgtgtatgattttcttatttttctctttctaactttaagaggatcttcttggtcacagatcctgggctattttattttattttactttatttttgaagcagagtctcgctctgtcgcctaggctggagtacagtggcatgatcttggttcactgcaacctcagcctcctgagttctagtgattctcgtgcctcagcctcctgagtagctgggattacgtgtgcccgccatcacgcctggctaattttttgtatttttagtagagatggcttttcaccatgttggccaggctggtcttgaactcctgacctcaagtgatccacctgccttggcttcccaaagtgcagggatgacaggtgtgagccacatcctggacttgacatgaacactaagcccaaccctcctctggcccagtcaccggctttcacttgtcctcatgggccatctcccgcacctcagccctacccgacctgctcctctggttctgtttagtcttgtctgggcctctgtcagccagtggccaccagaggaggtgaaggctgggtcacacagactccctcctccccattgtccctgagcctctcaggcagacctgttttagggcttggggggtgtggaggtctccctgggggctggctaggatgagcccagggaggtggctggggatggagtgaaggatggaccctgtagaagcagatcctcagtcctgaccatgccctcctccaggaccctgaacagctaggccgggcacatgccagcgccttccactcttcctgcctctcgtctcctgaggctgtgtgggtgggggtggatggggcattagtacaaattttcccaccttcagactttcaagagccatgattcccatgtttgtttgttttttgagacagattcttgttctgtcacccggacaggagtgccgtagctcaattttttgttttttgttctgttttttttttttttttttgctttttttttttttttagtagagatggggtttcactatgttggccagtctggtctggaattcctgacttcaggtgatccacccgtctcagcctcccgaagtgctgggattacaggtatgagccaccccaccccaccaaatctcatgtttttactgcccttcccttcccagatcactggaagcccatcttgggatagtccccttcccttcctgtcctacttagaacagctacattccaatggtcccttgtagttggctgcgtgtcctggtgtctgtcagggcacagaatgcagctgaggcaccttgagtctgaaaagttggaaggacggagaattcaaaattggctttgagttgaaaatggaattcaaatacagtcagctcttcttgagtattggaattagtggtagagggtgtattggaggtacagtaatgatgtgtgtttgaatgtcacccctccactccgtcccagtggttctgtatgtctaactctatctgacttaagctcatatgacccatattaccctccccagacaacccccaagagggtgtgcatgggcgaggggaggtggggggggttgctggctgctcaagagcgacatggaggaccagggccgcacaagctcatttggaagcagatggggacagttacctctaacagcttcatgactgaatgacaccacaaccactggtgtccttggccatcagaaatccctttccccaagggagtggggaagctgctacgtgagctagctacataatatcaactagaattagaggcgcttgctttccatgttgaacttaatcatagtttgttattacttcccatccccgcctggcttagtttgttcattgtgcccctataaagagtgctgaggctgggtaatttatatatacatatatgtatgtacgtatgtgtatgtatacatgtatagtttatttggctcatgattccagatggctgcaaaagtccatggttgggcgtctgcatctggggagggcctcaggctgcttccacttatgggggagggcaaaggggagctgggtgtgcagagaccacagggcgagagggacccagcgggaaggaggggaagtgccaggtccttttcagcaaccagctttcttgggaactaatagagtgagaacccactcagccttagggaggggcgttagtccatttatgaggaatctcccctccttatccaaatgctttccattaggctccacctccaacacggagaccacattttttttttctcaaatttcttttttcactgcagcctcaacctcccaggctcaggtgatcctcccacctcagcctccttagtagctggaactacaggtgccctccaccatgtctggttaatttctatacttttttgtagagggaggtcttgctatgtagcccagtctggtcttgaactcctgggctcaagcaatccactcacgttggccccccaaagtgctgggattacaggcatgagccaccacacccggcctaggagaccaaatttcagcatgagtttggaggggacaaatatccaaaccatagtccttgtttcttaaaggatctggacctggcaggtgatctggcaggtgactttaggtcactatgggagtcctttaacttttacacaactgcaatctccacgtccacctctgcttaaatcacacggaggccggctgcccagcaagtttgagagcagcactttatgagttttctgctgatcattcccctaaagtgaagtgcagccagccaaggtagttattcaaaacctcgctcagtgcccacttggcttcctctgcccaagacaagatggcttgctcaggaagaaacacctgcatccccagtggcagcattgttgcagggcaaggagcagcatccacgactcttgtcctttctctgtgtctctaaatgcaaaggccaaacatgggacatttcaacagattcaagccaaggagagggtgggagaatcatagtctttaaaatttgttttggccgggtacagtggctcaggcctgtaatcccagcattttgggaggctgaggcgggcgggtcacaaggttaggagttcgagaccagtctggccaacatagtgaaaccctgtctgtactaaaaatacaaaaattagctgggtgtggtggcacacacctgtagtcccagctacttgggaggctgaggcaggagaatcgcttgaacccaggaggtagaggttgcagccaagatcgtgccattgcacagagcaagactctgtctcaaaaaaaaattgtttttaaaacaataaggcaggatttagacattggtaactgactatcccatgtttatttgaagtaccatggaattttagtggcagtatttattcaaaacctgtctcagtgtgaaaaaaatatttggtttcccagagactgtgctgggggaggaagaattccgggaagccacaattgggcttaagcatctctagtccaaacagttggggagccatcggtttccatgtctgtcgggtaattgaatgacatcattgggctgaatccggggtgactgtgcggcagggggctttcggcttcgagggagagagtctcaccatttcttacctataggaaaaatacccattgcgcatctgagaatttagagggtaagtaatgcccaacaccaagctagaatattaggccttggggaaatttattttggctgaatgggatttattttaagattctgaagtcattaccactgcactttattttctgagtaatgtgcctgtcttgtagactctcgggaggaaatgcttcactccagctttatttaggtcattaccacaaggccaaagcaaagaccacgtgtgaggtcactgactggctgctgccaagggcaggtttatgaccgtgtagtggatgccttcccggcagccccgccaccaggctggctgatgcacatgcccagctcccgcacgatgctttttagcctacaaggtgctgggctgttaaggggcggaggttcggggaacaggggctacgccaacgcacaggtagataggggctggtctgcttcccctggggcttcaggaaaacatttgaatgtttctttcttccccagtaacaatgagcaggttgctcggaccacttgccgggggcgtctaaccgacctcttctacgccaggcatattagccgcttgtcacgggtcagtgacagatggagtggacggtagtaggaatctgtatcggaaatctgtgtccgaccttcctttactgcttcctgggcttaaaaaccttgattaaaatgtttgtctcctggctgggtgcagtggctctctaatcctagcattttgggagactgaggcaggaggattgctggagcccaggagttcgagaccagcctaggaaacaaggcagaaaccccatctctacaaaaataaaaataaattagccaggtgtggtggcctacatctgtagcccagttccttgagaagctgagatgggaagatcactggatcctcccacctggttaagcccaaccaggaggttgaggctgcagtgagctatgattgcacaactgcactccagcctgggtgacagagcaagactctgtctcaaaaaaaaaaacaaaaacaaaaacaaaaaaagggcttctttttttccccccctcataaaaggcatatcctacaccaagttttcctcaaatatgaataggcccaagaaccacctgtagatcttgtagagctgcagattcggattcagtaagtctgggacagggcataggagtctcgcaagctcccaggtgacactgatgttgctggtctggggccacactttgaacagccgggccccaagcctctctcgactccaggagacatccagggctggcttgctcattgcttctccttagcatggtgcggtgcccactctgggtgccggggtccacgtccccatcattattatggtcagcatatagctgtgacctttctgacatcaatgtggatgtgcgataagtccatgtttgcgggaacctaaggaaagacccacttactcatcatctatgaaggtgtgggtaggagacaagagagccgtgcagagaaacgagagtcaggaagagaatgaggagctctgggcatggagatggacaccagggaccagtggggaagctgaacggggcctgggcctctgcaaagagacctggcggggagggggcagaagtagggtgctcacctgttggcatgtccagggcggggtggtggcagattcaggctgaagttcaggctgagccctggagacccaggcagagttgaccctgcctcctggggaccaaggagccttcagtgaactgtcaccccctactgcagagcccaggacgtgcagacaacatgttttgaatgaatggagtggaagtcaggtacaaatatgagacaagggcctgatgctgtgtgtaatgctgggtcagacccgtgggcaggtgagcagtgcttgcttagaggggaccttgggcctggtttcccttgctctgtggtcctgcttctgagctgagtagctgtggacctatcgtggggaggaggaactcagaatatgcccagctcagagtctgggtcttagaagagagaaactgggggcgtggtgcaagccctgagggcattcagctgtgtggtccaggggaaaccaccatagctttggggggtcagactgtgaggctcagaaccaggcagccggccccgcccgtgtgttctactccacacacgccgtgtgagttgctgttcatgtggtccagggcactgcctcaccctgagcatttcatccactggacactgggtatttctcatcgcagaggagcctgcacaggctacagagcacgaccagactgagagctctgagaggggccctggaggaaagaatttgcagcatgatgtgcccagtccttagaccctctgtccccaggtgtgtggcctgcagcatacctgtgcattctgtgggtcaccgatgtctccaagaagggagcattttctccggaacccagcaaggagcagctgatgaaggcctgctgactgcttttggctttgcgagtgctcttgaaacccgtgtactccccaggagctctgggcagctgcttcggctgcaagaagccttcactcacagatatggatgcgtcccagggcacctcactcctgcctttattcttccagccacacgccaggggtccccaggccacctccactgagattaggcagtgtgtttctatcatgattcacacattagccattgtgatatacaattttagccttagaaaaaagttgcaagaatagtacaaagaaacgtttgtacacttcaaccaattcattaattgtgagcattttgtctcatttgcttaatatcctctctctagtataatctctatgtatatatcttttcttacatgtatatagtatcatctctgtccatgtacatatcttttcatatatatgtgtgtatatatgtgcatatacatagatgtgtatgcaaatatatgtgtgtatgtatgtgtgtatgtgtgtatgtaaatatatgtgtgtgtgtatatatgtgcatatacatatgtgtgtgtaaatatatgtgtatgtatatgtgtgtttatatgtgcggatacatatgtgtatgtaaatatatgtatgtatatgtatgtttgtatatatgtacacacacatagattttagggcaagaactatttaaagaggttgtggacatcaggtttcttttcccaagtgctttggtgtgtattgctaggaatagtcattctcttatatcactgacattgttatatcctacccttgaacccatcatccttattcaaatagaatgccctttgcaaccacgttttttccggtttaggatcttttctcaaattcatgctgtatttgccttcatgatcttgatgatactgagggaaggattattttcattttctttagtaaagaaagtgcaaaactagaaccaacaacatcaaagtcgcttttattgaaaggcttggaatccacatcgatggatccttcccatcgatcagcaaaatccaaaaacctatctgctgggtggatctccgcatgtggctgacctccagggagcaggtgggcacggtggcctgttttcaggtttgcagtgtatgaggcgacaccatctggatactggcctcctccgagtctgtctgaccgagaaggcagcccctggttctccagtcttgactctggtttcagatgctgctcttggattaaaaagcagatttctggccacgctctttgatcacaaatttaattacaaaatttgctctaaccccaaaggaatgaaaacttaccagctaaatgaaagctgcaagttgctagattttgacttgatcagcctgtctttctgtaaccaaataatcattctttgtcccgatgcgatgttggtcaccctcaacatcaaagcccttttgtgggacgcctttatctctctgagggcctgtgtggtgcagataaggggagtgagaggagatgatgtgatcgcccttggccctactcttatatccggagccagcggtgggacttagaccgcagcatcctgacctgacttccaggctctgcttccagcgggagagcttctccagcaggctgaagacacatgcaaaattaagatacactttcaggctggcttttatgataaaaaccccaacttaaaatttttttccataagttactggggggcaggtggtatttggttacaagagtaagttctttagtggtgctttgtaagacttcggagcatccatcacccatgcagtatatactgcaccatatttgtagtattttatccctcgcccccctccaactcttccccctaagtccccaaaggccattgtatcattcttatgcctttgcgtcctcatagcttagctcccacgtatcagtgagaacatatgatcttcggttttccattcctgagttacattacatagaataatagtctccaatctcatccaggtcactgcaaatgctgttaattcatttctttttatggctgcatagtattccatcattgtattatgaaaattttcaaacacacagaaaagtggaaacaattgtaaagtagacactctaggttctacagttaatatttgcggtactttatcacacatctacccacccgtttatctctcatccatcaacccttggcatcttgtgtttaatgcatttcaaagtaacttgcggacctccatttgtttccctaaatatttcacctggcgtatcattaattagagcttcatatttgtttacagtccttttttgaggtaagatttagatacagtgttatgtgcaaatgctaagtgtacattcattgagttccaacaagtgcataaacttctttcaaggcttagaacatccccagaaccctagaagtttctctaatgccctttccaagcaatacccccttcaatcttcagaagcaagcactgctcttattttttcttcaccacagatttgttttgcctgttctagaactttatagaaatgaagtcatgtcgtatgtagtcagttctgtctggctccttccgttcagtgtgttttgtgctatattcatgtcatttgtgacgtgctgaggattcatttctttttgttagtgagtagtattccattttaagaagatataatttgtttttacattctcctcttaatgggctgtttctgggttttggctatgattcataaaactggtgtgaacaaatatttttgtggacataaattttcctttatcttgagtaaatatcggattgaaatggttgggtctggggtaggtgtattttcggttttataagagacttccaggcccttttccagatggttgcaccactttacatccaccagcaatgcttgtgcgttccagttgctccacagcagcaccactaaagtctttttaaaatgttagcgattcccgagtgcagcatgtataaccttccaaaaaattcaacatcatcttccgctgtgtttccatccatctgaagcctgttagaatttatccaaatccaaatcagtaaacccagagtcagttctccaaaaattgtgtggaaaatctaaaatttatctttactactgctggctgccccctcttggcacttctgtgctcttaggcaccaggaatttggtaacctggtttctcatctcttccattgttttgttttgttggagagagagtctcactctgtcacccaggctggagtgcagtggtgccatcatagctcactgcagcctcaacctcctgggctcaggtgatccgtccacctcagcttctcaagtagctgggacttcaggtgcacgccaccgcactcaactaattaattttttttttttttttgtatttttttctacagatgaggtttcatcatgttccccaggctggtctcatactcctgagttcaagcaatccacctgccttggccacccaaagtgctgggattacaggtgtgagctactgcgtctagccctcttccatcgttttcaaggagggatcaggggtcagctgttcgcaacttggtacgaatgagtttgtcattggatcacctcccttgggaggaagtcttgccctggggatgtaggaacaagaactaacatgctcagtgcctcctaacagccccactttacctagtgtgtcaattccccacagacaagtaaactgaggcccaggaagcatcgttgcctgaggttgccgagttgataagcaaaggtctcagtccctgtggactcagagcctgggcttctcccctgggaccctgcagctccaccggcagttattccaattcttcctcaggtgttggaggcttgtatggaaactccttgcttctgtctctcgctcagcccttagaaaacctccaagagatggccactcctgcctgtggtgcagagaacgcccaggcagaagacccttggaggctcagacagagaactcactgcactttcagtcatcctgggctggctccccggcccctctcacgttctttatggatttgacccaaagtcttccagatggatggagctgtgggcactgagtctgggaatgtctcagcccaccttggctcccttctccagcaggagtggaggtgtgtgatgtcaaacaggcccagcctctctctcagacccggttctgggcccacacagccccttcttcctgaaagcagaggtggcagtaagaggatggctttggcctttgaatgttctcaagcgatccaagttcagagtatactgttgctgtcctctgtccctgaagcttctctcctactccttggacaaactcacttctcccctcagggacttctctcatgtagcagagtgtacacctgctgccccagcaaggccttcacaatgatccaagcctggcctgttgctccagcttctggaacctcccatggccttcggtctacttgaatgctcctgaggccaggtagctcatcactgccggaggacctgttgccactcacttctagccacaagaaatgtctgcctgtcctgagcaaaacccaccttggaggaacttctttactcccttgttgaatttttggctctaccaaataaacatgaattgcttccctgtgaaagacctccaaacactttcctctgcctgtgtgttgttcatcagtggtgtagccgaatccagggcgaggaggacctgcattttagctggtgttaaccagagtggagggaggattaggagtggcctttgggtggacaggaggtatgacaggctgcagatggtggagcaagccttgctgtgcccccgacccagctcgacatgcacacgtgggtggttctggctccctgggtgggaagaatggtggggtgggtgggcattgtgagcctggcaaccagaccccacggaatagcagggaggaggaggaaggaggacgccctccaagaaacagtggagtgaaaccttagtgcctacttcacagcccatctggggtctctccctgcttgcttctgggcagagggtgtccattataccacaagcacaaccttgaaatgtgctggagcaggaagtcgcgcaggacctcattccccaggactttccatacatgaggaatgcagggctgagcaggtgagatgcggcggtgggaggcatgccgcctgctccctctcctgattcactggggttttgggctgcaggcagtcagaaggtctcattttggggggttctcagcaatagatggggatacagtaggagggcaaagtcacagaaattctctgccggaactccaagacgcaggggctgggaaccgtctgcaggacccagacccagagttggaccaggattaaaggtggtggggggtgtggggtgccgaatgtgaagaacagaacggaagtgcaggaagacagcccgacctccaggagacaccatcactctcggtgtttccctccctgtgtttctttcttccaagaaagggtatttccaagaggacagattggttgaccaaaaggccattttatttctactttataaaaatagatgaaaggagacttgaaattattttgcctcttacatcactgggtttgggttctggaagtccctggagggtgcgcctgtagcccagacttcacaggtagacatggaggtcatgcaggtcacatggctggttgacacctgtaaagctatgatggccaagcagaactttgccgggtatctctggtcctattccctcccccgggtcatctgcctccctcctggaattgattgattaagtgctgtccctccatttcgtctaatagaccacgggaaggataggccaaacaagaagggcctacttcaacttacaagtcaagtcacggtttcagaacaccttatctccaacctctgtcctcaccacaagccagcccgacaatgtcctcatccgattttctcaaaagagtttgggcgatcttgagggcaaatcccattaaatatctgtacccagtctagcatccagagttgtcagcgttcgtgagcaaacagatctcagaggcatcagtgttcgtgagcaaacagatctcagaggcgtcagcattcgtgagcaaacagatctcattcttagtgagagtgcttctcctctggaagctcttgaggagacaccctccttacatcttccagctgcaggtgttaccggcaaaccgtggtgcgccttggctcacagccacatctctccaacctctgcctcctcggagtccttttctgtcacttagaaggacgctgtccctggattcggggcaatgctagggcaggatgatctcatctctgaccttacatctgcaacagccctttccaaataaggtcccatcctaagattctgggtggacatgaattttgaggagacaccattcgaacatatctttgtatctcttccttctcagggtgtgtcctaccccctcacagcttattctttttcccttcaaacactctgttgagacccttacacgaggcggtttccccagacaccgcacagatctctcctccctaacgagttccgcagactctctggaagtctggctggaaatgctgctctccctttttccttctgggatggaaaaacgctcccaatggctccaccagtcagtcagtgagacgttccaaaccggtctttccacttgggcttcctcatctgtttatcttttatttatacaagcctcaaaccactgaacactgcttggtaaacattccctcatttactatgcaaatgttagcacgggggcccacgcccgcccttccccaggaaagccactgagtgctgaatgcggatggactttcttcacattctttggggttttcggaaagggtatgtttttcctaacgtcacttcaaatgtatttcttaacaaaaacctcctaacctttggaaaatggaaaagaagttactcatctgaaaggaaactccaagtttttaggacctctaccaaacccctgagtgactgcggtcacctcgcctgccagcatgctaagaaggcattgtcttgccacagggctgggtttctgccagcgatttctgcaacatgttatgtctgggttatgtatttgaattcccggccaggattttctggtgggtctccctaccctccatgaaagagtccctgtgcagtgccagccctgcatcatggttcttgcaacgactgagcattctgcacgcctggaaatgtggagcagccgggaggatgaatggccgtcagcttctgagtccctcctcatctttacagtgcaatagtgagagtctttttctaggtcagtggtttgtaaaatggccagctttagagggaaccaccacccttctaagaattgtaactatataatcacatggcatttaaatatattaccaagaccaagggcatcagagggcatcagtttctcagctgggagtgacttcctcacactcctggattcccttggcaggaggcagatgaagagagctgctgaaaaagtgactttcctggtttgtgatctccacgggaaagaacatgcgacccgtctgagccttgaatgtcggaatgaagtgttttgctgctggtcacggctattctgggaagcacggctgtgggtctgtgagaccatagaagaggtccttaaaataatatgcacgcccgggagttgggagcgatgagcggctgtggggagccctcttctgcctgctgcttcctggtcctaccctaatgtgtatgtgggctgaccccaggccattcaacaagcacttattgagtacctactgtatgccagacatgggctgggccccaggaggaagtagtcttaggtcctgattcctccttttgtttttgttttgttttgtttttgttttcgagatagggcctggttctgctgcccaggctggagtgcagtgacctgaacaaggctcattgtagcttagacctcctgggcccaagtgatcctcctgcctcagcctcccgcatagctgggtctacaggcacacaccaccacgcctggcaaattttttcttttgtattgttttgtagagacaggggtctcactatgttgcccacgctgatctcaagctcttggtgtgaagtgatcctcctgcctcagcctcctaaagcactgggattacaggcgtgggtcaccgcgccaggccctgactcctccctttgtgctgcccatcacctatcagggcaggggagaccttcactcacattgtcacagaataaagggaccaatgacctcagagaagcgacagcgaagtgctgttttaggtgtcgggaagtgggatggcagtgggccgaggactgaagggcagcagggaggaatgagaatttgaattggcgctgagtgggatgagtgtttgaattggcactgattggaatgagtatttggattggcgctgaatgggtcaatattggttctccccttttgggttgatgctgatttgtggccctagcgtcccccaggcagggccccaattgtgttgcttgaacttggcctctgaccccaggctgacgtggaccctgggtttagctgctgctgctcgtgggtttagctgctgccgctcggctctgcttctgttgcattctggttctggtcatctgctcagtggctcagcccctctggggatggctcttgccatgtttagtcccagtgtcaggagtttctggtcctggagtcagccctgccactccctggaggaccttcccgaggccagctgcctaatccccagccccgatcccctgtctgtggccttgtgtcgttgtgatccacactgtcctgcccaccacgctgtcacctgcttgcctcaacgctggccagctactgctgaacacccttggaagccctgacctggcccaggctgagtgtcccctcccctgaccatttgtggggacagctcctccagcactggccggctctcgtcggggtccattgggggccacttctaggctagaccctcactgcctgcctgtctgtccctagagaccaccaatggcaaggagtccatctggccagtggtcccatggacagtggaccgtggacagtgacagcaggttggacagtgactgcggtggacatgacacagccctttcttgcagggaaggttgatttcagggtcactcttgcacttgatcttcctaaagaggaagcaaggaagccagcctctccaaagcgctgattgcatcctggggtctctgagcaagctggctcagttgccacctgtgggcatgcactattcttccacttgcagattagatgccaggacaagtgtcttccaaaggccacctagaaagcaaacgtcaatgaatctggggttagacctggctctgcaaggacccaaaggtcatggcagccctcttcctcctcgtcgtcctcagcggtcagcggcttctgatgtctctgttccccagtcgctgcatacttgtgcctcagagctgagcttcttatctaccctccactgacgctgcccactcgggaaggagcctcccttgctctgaagctgccactcaggtacggaggctggagggcgccataggggacagacagggtgggtaggggagtgctgcctgcctggcagattcacccaatgccagcatttctcatcacagcacctcagacaaggcagcctgacacttaacagccctcattatctgacctaaattcctgctgaaattgaggtcggcctcttctgattctgccccaagtgatctggaggcctcggtcggtcaccatgcccctgtgaggggacacaccctgtgcacggaaactgatggtgaccggggccacgttcgctggtgccctgccttgatgcccacttctagagaggcagagctctcagcacctacattgtcctgggggccgggcaggccgggacctggcgtgtggctggaagggtggagtgatagggcagtggaaatgcatcttgtgccctgtgctccggcgtccctgccctctgcatgggttcctgggtgaggccagctcccggccccagcctctccggagggcccaactgacccttctcccttcaggcttcagtgttggtgccacggaccctgttgtctgggcataattgggcgtgggattatgtttaacctacaggtgcacacctgtagtcccagctactcgggaggctgaggtgggaggattggtgcccaggaggtcgaggctgcagtgagcccagatcctgtcatgcactccagcctgagtgacagagagagaccctgtctaaagaaacaaacaaacaaaaaaaccagccaattactaaacaaacaaaaaagcagtgagggtcggacatggtggctcatgcctgtaatcccagcactttgggaggctgaggcgggaggattatgtttaacctgtttaacatcttcccctttagactctgtgtgagtcggcttgggctgggaacaaagcagtgcaaactgggagcttaaacaaccgacgttgattccctcacagttctggaggccggaaggtcaagatccaggtgtctggacagagccctcctggcctgtgctggtgtgggcggaggcggtggtccctggtgtgccctggctgcagccgcctcgctccccctccacctctgttgtctcatggtactcccttctccattcatttgcatccaaatgtctctctttttataaggacatattagatttagggcccaccctactccaatttgacctcattttaactacacctgcaaaaatcctgttcccaaatacagtcacattcaccagttcggaggggtaggacttcaacatatctttttgagggacacaatttagcccccaagagactttaaggcttttggaggccatgagcgggtcccactgaggccccaggctggcctgcagcaggcagggccggcaaatgtgtgtggaaggagtggggcagggcagaggccggctctcagataggcagctgaagaaaaacccggcacatccacggggagttcgtgctggtgtcttctctctctcttttcctctcctttcttatatgttgggttcttctcaaatgtgaattttctgtatcagcatccctcctgcctgcccataccctcctcccaccacccaagtctcacttcctgttttcggcctttcgcctgaactgcttcagaagttgaaaccccacagggctgggcctgcccctgcgaggcatgttttttttctggaaggaggaagcggcaacgggttacaggctggaggctgtccctgtgctcagatcccacacacgtccccagcaagccccagcccctgccctgcgggaagtggggtcttgaacactgccccgtggggctctctcaggggcaggtgaggcagcgtcttctcgcgccctcatttccctcaacttatctccagggcaaaatcctatgcagtggcacccagtggccggccctgactttgatcttgggtgctttcttctccacccaaaaggctctgaggtcatctctgtatcagaaaatcagcaagatctgcagcgggacagtggggactgatggccactgtcatcagcatcatggtgagcacttgagctgtggtttcctcaggacaaattggccttccccacgtgaactcgcggcaggcagagaatctaggttgggaccctggactgcacccggtgctgggctcctggccttttccctctccgccctgctaaggctgctgtgccgagccctgggaccatccaacagggagaaaggccttgggacaaaaatgacactttctcaacatcacccactgttgaggttacaagaagcagagagtgtgagaacgtttccaaatgaaagtgggggaaggatcgcaaagaagcaagttagttagggctgtgcccagccagcgccagtgccaacgccgagccgcctctgcaggggaaaccgaagcagatgtggtgagataatacatccaaccctgagtgctactctaacctgccagaggcggagggttctcagtgagatgaaagcattacagatgcgttagatctaagggaggggcctgcagatgcgcagctggcagagaaaccagggaggggctgaactgtcagtcgcgaccaccagggatctgaatcagttcaccgacagccttggggacattcaccttgggctccacaacctgtcagaaatgcccccaagcccaaaggcgtcgagagaatggccaggttgtttcagattgacacatatcctaatgtacaagtcagcccacacaccccacgtgcactgagcgtctcttgttgttcaccccaaataaactctgccggaactggggcgggactcgcaggggcggagaaggggggagacgggcagagggcagaagtggatggtgagaagagccaatggaggggccccgtgagagtgagcaaggctgcacccctaaccgacgtcctggggctactgtacaaacaaagaaccacaggctgggaggctgaacaacagacctgcactctctcgcagctcggaggctgcaggtctgaaatcgaggggctgacagcgctggtttcctctggaggctgcgagggagaaaccgtcccctgcctctcccaggctctggggtgagcccttcctggcatcccgggctcattgtagatggatcactccaatctccatggcttctcagggcttccctccatgcacctcaaatctctctctccttccttttgtaaggatgccagtcattggatttaggttcaccttaaatccaggatgatctcatctaaattacatctgcaaaaagaccctttttccaagtaagttgacattcacaggtacctggggttaggattggacatatcttttgcaggggtgcagggggctgccactgagcccgctgcacagggtgacctgggccaagggcccttcactttcacttcctcattggcaagctgccctgtgtttggactgggtcgaggctgtcaaccttgctgcccctcggagtcccccctggtgtcccccaaacagattctaagctgctttcctggggctggaggccaggcattgggattttttaaagagcttcccagcaggtgagcagcctttcatgggtatcaggagaccttcctggcaaatgtggtgaaggtccttcctcctgagcgatgccttagacccaggagcccagggaggctgctcacctgatcgttaggacaggagcagtggaaacctctggcctcagaccccctggaggaatccctccctctaagactctgggactggtgcacgcaaggagctatcgtgaacattgctcccaactggccgcttgcttgtcccccggctccccttggccccagtggcggctttgcctgaattagagggcgtgagagccacctgtgtctcagcactgcaattaaagcaggaagccctttcggaagcagccgtgtgcaccagcctcccatgggtggagcagagcaaaccacccacttctgccctctgcccttcttcccttttctcgacaccctgcggccccccagtttcagcagagtttatttggggtgaaaaacaagagatgctcagcgcctgtgggatgtgtgggctgactcgtacattaggatgtgtgtcaatctgaaataacctggccgttatatggatgccttggggcttggggggtttctggcagtctgtcgagcccgaggtgaatgtccccaaggctgctggtgaatcagatccctggcgttctccgttggcagttcagcccaacagtttctctgccggccgtgcctctgcaggtccctcctctgatctgattggattaatatttgaatcaatagactgagtcaagcagaatgtgggtgggcctcatgcaatcagctgaagccctgaaaagagcaaaagggctgccccttcccccgaggaggagagaacccctcctgccggacggcctccgaactggaacatcagctttttgctgcctttggacttgaactgaaacattacctctccctgggtcttgagtctgcctacgttggcacgggaactacacgttggctctcttgggccccagcttgctgactcaccttgcaggtggtggtggacttgtcagctccgtaactgtgtgagccaatttcaatttcttagaatcacaaatttctttctttcttttctttttttcttttgagacagagtttcgctttagttgcccaggctggagtgcaaaggtgtgatctcggcgcactgcaacctctgcctccaggttcaagcgattcccctgcctaagcctcctgagtagctgggactgcaggcgcccaacaccacacctggctaatttttgtatttttagtagagatgggtttttgccatgttggccagactggtctctaactcctgacctcaggtgatctgcccgcctcagcctcccaaagtgctgggattacaggcgtgcaccaacatgcccggcccacaaatttctttcttttcttttctttttttaaaatcagttttctgtttctctggagaatcctgacaaagagcgcatatctgagaattttaaaatcatttattggaactattgaatctgttgtattctgtttttacttttgaaaatccttgcggctgggggaatgtacaccttctctcttttcctcttaaacattaaagcctgattcgaggtagaggcaactcactgttgtgatgtccttttatcccaacctcagccccggcagaaagactccgcgccttgggacattggtgttttccaggagtgactgtgctggggcagctgcctgttgcgatgagggctggcggggaacgatcccctctgagtttggcgtcacttatttggaaccctccagcagaaagctttctaagatgccacactataaactcattcatgcagttattgcgtttcagttcagattctattgctcttgcttcattatttcaaagccacatgatgatatccattactgggtgcagaatggccctgatgggtctagaagcaccgtggtctgacccgtcctaagagatgatccagtcacgaaatgctggtgcaggtgtggatcgagccagttatcttcactatctggaaacaagaccctgaagtccaggtggccaaggactgcaccagatctctttctttttttttctttttttttttttgaggcggagtctcgctctgtcaccctgactggagtacagtggcatgatcttggctcactgcaacctccgactccctggttcaagcgattctcctgcctcagcctcccgagtagctgggattacaggcatgcacccccatgcccagattttgtatttttagtggagagggggtttcaccatgttggccaggagggcctcgatctgctgaccttgtgatctggccgcctcagcctcccaaagtgttgggatttcaggagtgagccactgcactcagcctgcaccaacttttacagacaggctggagtcctgtctagaagtcaggacaccaggcctggctggcaccctattctccagaccacgctgccctccgcagccaggtcccaggacccagacataggtggatttttgtttctgacttgcattcgctcttttacatgaaccgtgaattctttgtcctaacgttattgttagggcgacagcattcctgatcgtggtgctaatgcggttatcaataggctccaaagcttatccttgatgctcacgatctcagagttggaagaggccctggcaagcacccaggccagtcttctctggtaagtgccctatgcccttaaaaccacctcaggatttcaaggacagagacaaattaaaaatagaggcttaattctcctgattgaaaagaagggaagagatttttctctcctttttctctgagcattactctttatttatttatttattttttgagacggagtctcgctctgtcgcccaggctggagtgcggtggcgcaatctcggctcactgcaacctccacctcctgggttcaagcaattctcctgcctcagccttccgagtagctaggattacaggtgtgtgtcactatgcttggctaatcttttttgtatttttagtagaggcagggtttcaccatgttgaccaggctggtcttgaactcctgacctcaggcgatctgcccagctcagcctcccaaactgtctcctggcctctctggtttcctagggaggccaaaagcctaacttagttgatcttgctccaagctgcaaaaccacctcctgtcatgaagataggagttcattcttcttctagatacagacaattaacaaacacagatggtaaccccagtgaccaggtggttctggggtcaacggtgtgtgacaaatggcactgtcagggcctcttccttaaggactagttattgtttatgttgaaaacacgcatgcagttagttgtacctgtttgagtctttaaaaggataagatcctttctttgcagtctcttagccattgcttgtgatgcatatcatcttctggcttaacggttattcaataatgaaacttttctttcttttccacctttgtggagaggtttcctgggtttagagcacacgtcttttttctttctttttttttttttttgagatggagtctcgctctgtcctccaggctggagtgcagtggcgcgatcttggctcactgcaacctccgcctcctgggttcaagcaattctctgcctcagcctcccaagtagctgagattataggcatgtgccaccacacctggctaatttttgtatttttagtagagatggagtttcaccatcttggccaggctggtcttgaactcctgacttcgtgatccaccccccacccctcccaaagtgctgggattacaggcatgagccattgtgcctggccagcacattttatttttaattatatttccccagtaatggccttacctacatttaatgacaataagtgatggatacttaaaatacactctagttctagaaggcattcccatacattaattaatttggttttcataaaatcaggaggcattaaaacaccattaaattagaaggcatcactattcccttttggtaatttctcatttaggaaaccgaggcactgaatggataaatgccacccaggggaccctgtccagccgttggcagaacgaggactggactgagggtatttggctcctaatccagggctttccccaggttccactgtgaggcatgcagggtctgaaaacacaccggcacgtgcgtgtccactgcccccctggccttagctatgcctttgctgtgttacggaagcacctctgaaggcctgggcgcctcttctgggagtttctcgtgtctcttcgccttccgatctgctctggccttgccacgagaaagcgacaggcccatgctgctccttggggcctggagacaatgtcccaaccccaggccgcaccctcgctttccatccaacccggcaactgctgcccgtggagggccacagtctccgaagtggaatgtggaaaaggaaaagtcattcgggctgtgataagaaagccgagcttcttcaaaggtaaacagaaacagagacaaagacgagggcacgtgtctgtgtgagtgagggagagagagatgggggaggggagcaaaacagaggcggcccggagaactctccagaagggtccgaaggctgccacatggaggagtggcactcactgtccagtgtgagggtggaccaggcttctcggatgtggtcgttccagcaggaaggccaaccgtgattccatatcgtgaggaattttcaggcagagccatctgtccacaaaaggggccatcccactggattcgtgtcctggtgttcaggaggacacggtcccgtcctcaaggtcgtgtgagcacctgagtcacccggatgccggggggcctatcctccagtgcctgagtgagagaggggtgaggctgggagcctgcattttctatatgttccctccccatgcaggtggtccccacacacaccccgagaaacagggtgttaagtcaccgccgctgtcagagagccacctggatgggctggatgctgggctggatgactcaaggtctcttccaagtccaaaccattttttggttgcatgactctcctccctagctcgtcctcacattctccatcacaaccagctttccctgaaaataaacccagctggccaccccttggagatgagggcttctcccaccctgcctctttctgcctgcacctgcccggcagccgttaccatgcatgcccatatacatatgagtgaatatgtgtacatgtgttagtgtgggcatgtgtgaatgagcatgcatgagtgatgtggcatatgagtttgtgtttgtaagtgtgtgtaagtgtgaacgtgtgtcagtatgtgtgtggacttgtgtgagtgtgtctgtatgtgtcggtgcacatgtgagtgtggatgtgtctgtgtttatgcccagtgtgagcgcatgtatgtgagtgtgagtgggtgtgaatgcctgggcatgtgtgccctgaaagccagcatggcacaccagtggcctccattgtctctccagcccttggatgctgtgtgggggatgctggcctttctgcacagaggccctgagcgaatttggggctctctgctggatggactgtggaagacacaccccggcattgttggacaccaagtgctggagaattctctccctggtgggttacagtatggggttgtttttctcctcagagtgtttacatggacagggcaaatgtgaaaaatccctccggccatcatgcaggaaaatatgtataaaggataactggagaaaaatgccttccatggacaaaacacagacagaaacacacacacacacacacacacacacacacacacacacaaacagcaggggtatctttcattgtgcctcaataaaacagaggttgaaggagacaccaagctagaaacagactgttaattttgggatttttttctttaatcattttaatataaagagacagcatgttacaatgacattttatggatgattataaattattatgaagtcctcaactggtaaaatgtcttgattttgttcccctgtcttggggtctgtggttaaatcatgacagaccagcagtggagtggagtgtgaagaactgcggcttgaggcttagacaagcctgggtttaatctcttgtttactggctgtgtggcctttctgaacctgttttctcacctatataatagggacaaaggacctatttcatagggcaatcgtgaagatgagagacaacagtgcaccagacgaattttgagttttaacctgtaatattatccctgatttaccttgatattttatagacattcatacattatagtagcaaacattttgagatgatatatacaagataatacaaattcatcttgcattttaaaatgttcagatttacttaaatcataatactttttattcttttagtgttaataaaatttcacttccttgagtattatataatagctttaacatttattcttttcgtatgaaaacgttttttaatgagccaattctgtgtgaagcttttggttttctataaaagctgctgtgttccaaggacacccgttgtacgcagcccctttgctgtgagatcatttccagcctcctttttgtattcttgtcatggcatctgacatttagtcattagccaagcaaatgcagcagttcatcatctcagagattaatctacagagaataaaagaggtagcaacgttggtgcgggagttaggcgagaaggtcccttctggaggaatcgttttgtatctagaacaccagggaattatgctcccgaaccatgcagccaacgtgaatctttgttaattcatctgaatgtttcctcagtaaaatcaacaagatcttcttcatccaatgttaaaaattgggcttcagcagtcaacactaagaagtgagaggcaatcaacggtgcagtatgaaaacatcatgagctagaaagaacttaacatgagatttagaaatctacttcacatataccatgatgactactgaaataaaacattaatcacctgtattcttatcactcctcaaaatgttttcttcctgtcccagggccctttctggagttttctccatgcttatataactgtacagagttgtcactttcatggagatgaaattgcatgcgttgctgttttgacttcacattgttaagtatttgtttgtgctactaaaacttcatggtgagcatttcaacgcccgtgtaatgctgcatccagatgctctgtaataattactctcccactctcctgtggctgtccaattatgtaatttcccactttaagtcataataggtaatgcacatccctgtgaccacagcttcgtgctctcagcccaagctccgggaggagaggactgggtcaaagcacctggacatttttgtgacttttgaagtgcattgtggaaccgtgtgaaggacgcttttctgaacgtgatgttccactttgatttgatgctgttttcttctgccagttcagaacgatagggtaagagaatactccgtgttgatggagagactcagatatgagtctcaaatgtgttttctgcgtaacaacgagatgggatccagcgatgcggtctgggcttttgggtactcacctttcctaaaagatgccatctgcttggagcagaataggctgtgacacgcaggagcccccagggaaacggccatggcaatggtgggtgttaacgagcaggcataagggactgctcccagcggtgcttcctctgaagtcattgccacctgcagcagcacaggggacagaaaggccgtttctccaggtccaggcagctcaggcccctatgagccctggcgtagcagagacccaggcttcttggtagaggcccagagccctgtactgccaccactgccggacgatgctcaggacctcggggctggcactgctggctctggtcagtgctgtgggcccaagccaggccagcggcttcacaggtgaggggtctgggcttggcatgggcagttcttaaggacaggggcttcctggcatgggtctcatgaggacagccccctgtggagacctgggcaggcaaggacgcctctgcttggagaggcgacatctgttcttttgtggacaagctttttggtaagcgcacatggtagcagctgtggaggtggggcaggagtgccgggtagggttttgggaagaggactcccccagtgggaacctgttgctgaatcacctgggcgttcgtgggggtaaaatgcagattcttagccagcaggtctggggtgcagggcctggaactctacatgtctgtgggtgatgcagatgctgtgggtcctcagatcccactgagaacagtgagctcctacagacgcagaagaaaggtctcctgaaccttggtgcattcaagtcctcacttacagatttaaaaaaaaaaggagacctagcctgggcaacatcatgagaccccatgtgtaccaaaaaaaaaaaaaaattagccagccatggtggtgcacacttgtggtcccagctacacaggaggctgggatgggaggatcacttgagcttgggaggtccaggctgcagtgagctaagattgctccactgcactgcagcctgggcggcagagcaaaagcccccaaacaaacaaacaaacaaacaaaaaaagccacaatacaaaaacaaaaaagaaagggagacccagaatggatcagggacttgcccaggccacacagctcacagggcagagtcaccacaggagccagaggctgcaccagggctctgtccggagttttcccaggcatgcggagagcagggcagcttcttaaaaacacacgggagttctgaaaccccagaatccagggaaatgggactgcggaattttaaaatcattttcctcttaaaatctgtcatattcagttacaaatttaaaggaatccattctgtttctaaaatcaactatgtttttgtactactttaacgtttttcacccagaagcaggattttgctttgtgatttgtgaaatggattttcccattggaacaggtaatgtgtagaccccacagttcagatgcataatgggtgggtatcctgggaagctggagaaggtcttaggaggtgtttccagaacccctcattgtatatgaggacacggggcagaacctcagcaaccccacacgtggtcgccccgaattttccctgtgtgccagcactgccttcacaggcatgaccccacttcagccttttgcagccacaggacatggctgttatttcacagatgacaagagaggggcactgggagggcatgacatgggcgcaatcatgcaacaggggtttgtgagcctgggtgtgagcacaggtccatctgaccccaggactcttgttggccccagagcattaggctttcccatctctgagaccggaatccaagacccccggctcctgctctgatggcccttgtgggtctttgcgggatggcaggatctgctaactgctttcttctctgggcttggccaagaagccaggcttgggatggcacgtgacctcggataaaatgttaaaaacaaaacagggcaaacatctcccgggttccacaggagatgagtgtgtgtgtgtgtgcgcgcgcgcgtgtgtgtgtgtgcgtgtgcgcatgtgtgcaggacggctctgctgcggaccagctggggccatgtaacgatcaggtggggccctggcacctctctagagaccaggagctgtaagtgtccttaatgtggttggcatctctgctcaggttacgatgaaaaacgcaagctagatccactctgctaagttcttggtgcaggaagtcctcggcctttgcctagctcggcgtggtcactgagtaggtgagcgcgttccttccggccatattccaccgttcttcatgcaagtcacctctaggctctcagccaagctgccctggtcccggaagctgatttgtcctgttccaccccgtacgatgaggacctcccgttcctttgcagagctcacagtaactaccccactggtgatgccaagcagcaggtggtccccatccccagaggccctgctgggcccgcagggtgatttggggttcagcccccagaggaagttgcagctccagtccctgttgcttgtggagtggggtcgctgtgcagcaagtgtgtggtccagcacctgtgttctgcccagagcaaatctgcagcctcttccctcaccgtgtttgagggctggctctgccctatttcttcctggggtgagtaacaagcccctggagtcctgctttctgcacacttgtaggttgctgcgaggtccaaggagggaatcttcagagatgctgccccagtggagcgaataaggacagcagtggttttgtgatcatttctgctcccatctctgtgttcctccccagaaatcaatccagctactcattgagggaaatcaactgtaatactgagcccccacctcttgggggtacagtctagtaaagcttagagctcaggggttgagtgtctgaaatgcaagcactgtatgtcaaatcctccgttcatcctgcactgagagtccatgtactcagggccccctgctaggtgccacgggggagctggaggggacccttcaccatccctgtgtgcactggctagggctgctgtaacaaagaaacacagcctgcgtggcttaaacagcagaaatggattcggtcacaggtctggaggccggaagtctaagatgaagttgcgggcagggctggctcctcccgagcccctgcaggagtctctgctccgggcctccagcttctggagctgctggcaatctttggtgttccttgacaggtagaagcatcaccctggtctctaccttctccctgtgtgcctgtctgtctccacatttccctttagtataagggccagtcatattgtattagggcccaccctaatgtctccactttaacttgataccctctgtaagacattactgcagataaggtcatattctgagttactggggtttaggactttaacacactaatttttggaggaacacaatcaattcaaactaggcagtaggggctcccggggagatgggaagcccaggcaccacgtcaggggatgtccatgaccaaagagtctcgtggtgaatgtcatggggccaggggtctcgagaacggagtaatcacgttgatggaggggcgatgggccttgtgtaaaggaaccaggctccagtgagagatatgtggggcccaatagggtaaacctgatgcttgtcctgcagcgggggtgactgtgcctcctcctgatcacagtggtaacggctgaaaagttgaactggtcttttttttgagatggagtctcgctctgtcacctaggctggagtgcagtgacatgatctgggctcactgcaacctccgcctcctgggttcaagcaattctcctgcctcagcctcctgagtagctgggattacaggcaccagccaccacaattttttattttattttttatttttgttttttttttcagagggagtcttcactctgtcacccagggtggagtgcagtggcgcaatcttggctcactgcaacctccgcctcctgggttcacgccattctgcctcagcctcccaagtagctgggactacaggcgcccaccgccactcccggctaattttttgtatttttagtagagaggggctttcaccatgttagccagggtggtctcgatctcctgacctcgtgatccgcccaccttggcctcccaaagtgctgggattgattacaggcatgagccaccgcgcccagcccacacccggctaatttttaaaaaatatttttgctggagatggggggggggtttcaccatgttggccgggctggtctcgaactcctgagcttgagtgatccacctgcctcggcctcccaaagtgctgggattacaggtgtgagccaccacgcccggcctgagctggtcttttatcatcaacaaacttctcacacacttgccacagagcgaccgcactccacaggtgctttaagtacctgcttacttatcttccacctcattgaaaagaaagccgtcattgtcatgtcctggccacagcaggccttcagtttgcactgtggagggaactgctgcacattcacttcccatgtggcaaccttgaggctcagggggactaagagatagatgtgcacgagattctacggcctgtggaatcagctcacatggagcagaacaaagggacgtgatctctaagcattgattccagcgctgtgctctctccttcgtatatggaccgtgagaaccctgtgcttcaggaagcatgcgtggggcccaggtggcacctcctcctcggtcacagcggctttcttagcaggccaggctacgtttatgctttattcttctgtgctcactcatgcaacagccttcctggtgcactagcaggcaaaggccagtggagagggctggtgggcagcttctgagaggcctgcgcgagtgcgggaggtgtgctctcacttgctattgcagagggacgccttgcggataaccgctcgcacggatctgatcctggtgttctcagtcgccttcttgcttggcctctttcagaaaaaggcctctccctgttgggctaccagctatgcagccaccgtgtgacccacactgtacagaaggtggaggccgtgcagacgtcctacacgtcctatgtgtcctgcggcggctggatcccctggaggcggtgccctaagatggtttaccggacacagtacctggtagtggaggtccccgagtccaggaacgtgactgactgctgtgagggctatgaacagctcggcctctactgtgtcttgcgtgagtccagggctgctgggctggggcggggccacccttgccgtcgagacgcctgatgggacagtcaccgttggcatccattggccccgaacttgctagatcttccaggagcacggctcccagccttgaccaggcagcaggtcatcggcagggctttccctggccccactcctaggtttctgagtccgtgggtgggggtgaagtacaagaatttgccctcctgacaagttcctgggtgacgctgacgctgctggcccagggaccccactttgagaacctctgctgttctcagagggctcctggatggctttaaaaatgcagatgcctgggtctcttcctgagagagtgtgagggaattggcccggggcgttgagagagtgtcggaagttttcaaagctcccagagtgattctcatataccactgagtgtgagagccagcactgaactctcttctacagcagccttttctttctaaaagctgcagtgaaatgctttcgtagccaaaatcctattctgaactccaatacgtgaaagagctggaaggagccccgagcctaccaccctaagtgctcagaggcccccaagtcctcccagttcctcagtgcagtttggaagctgctttcctgtaggatgcttggggccagttaccagggtgacctgtgtggttatgccaggccagggtctgagccgttgggatagggcagggactcagggctcagcctactgacacacaggtgatctcttccaggggaggggtgtgtgtgtgtgtgtgtgtgtgtgtgtgtgtgtgtgtgtgtgtgtgtgtgtgtgtgtgtgtgtggtggctgctaattttgagtcaataccagatctgcaatgagtttctgtacagtcagaaggtcctgccttgcacccccactgtggagggatgtgggggtgtgtggctccagcttggtgttggccagggtcactgagacataagggctgtgacctccagagtgcagaagccaccagctcctgggtgccacgaaggggatcctgcaggacccatccttgtggcctgagactgttgtacccaggcgagttagagaaaacgccatactttgagacgaattaagagtcttttattagccggcgaccgagagacggctaacgctaaaaattctctcagccccgaagaaggggctagattttcttttatactttggtttagaaagaggagtgggggtctagttaaaacaattttacagaaataaagtaggcaaaaagttaaaaagataaatggttacagaaaagtaaacagttccaggtgcaggggctttaagactattacaaggtgatagacacgaggctttgggcgttatcaatcagacgaattcctgggaactgcggatatagctcgccacagtatcttatcagttaactgcattcttggatgtgctgggagtcagcttgcacaagttaagtccttgaggaaggggctgccagtgaaagaggcaagatggagtctgtctggctctcttagctaagggagagtccattcaggtggaaacaagcctaaaaacagggttagtaaaaacaaggttgggcattacaagaccaggacaacagcagaatggagcgtggactccgcaaaccagggtgtctgcctcctccagaaaccaagggccccagattgtagagtctggggtctgcatagacctgcaggctgggccatcctgagtgggccctccctcagcccccagtgctatttcactgatgacagggagagttgatgcgtttctgttgccccgttcagagggccaggcagagagagggcctgatggtttcgggtgtgctgttaacaggcatgttcctctttcaggagtgttaaaacaataccaccataaccaacacctccatcaccaacagaaaccaggcagggccagctgaccccagagcaacacctccatcaccaatagaaaccaggcggggccagctgaccccagagcaacacctccatcaccaatagaaaccaggcggggccagctgaccccagagcaacacctccatcaccaacagaaaccaggcggggccagctgaccccagagcaacacctccatcaccaacagaaaccaggccgggccagctgaccccagagcaacacctccatcaccaacagaaaccaggcggggccagctgaccccagagcaacacctccatcaccaacagaaaccaggcggggccagctgaccccagagcaacacctccatcaccaacagaagccaggtggggccagctgaccccagagcaacacctccatcaccaacagaaaccaggcggggccagctgaccccagagcaacacctccatcaccaatagaaaccaggcggggccagctgaccccagagcaacacctccatcaccaacagaaaccaggcggggccagctgaccccagagcaacacctccatcaccaacagaaaccaggcggggccagctgaccccagagcaacacctccatcaccaacagaaaccaggcagggccagctgaccccagagcaatggcccttctgtactctcattggttccctagagggccactggcaggacaagcctatgccttggccatgctgctcaggtgctggtctaaggagacccttcctgtcctgatgcctggccccatttccactttcttcgagggccacacacacagaggggcctgctgagctacagttgctgctgtgcaacaactccactcctaggggatagcggggggccattaggacacaggtgctggtgccacggcaactcggtttagagcatgtgggctttgcagtcaggacatgccctatcctgtccagtcttacctgtgaaggccacacctcttcctacctgttggcattgtcaggactagtgaggggaggaggccctgggggaggctgatcagcagccccttcctgctcccgctctgcagggccacaccagccccacccatgcccaccatcaccttctgtaagagaccctggcctgctgcagcaaacaagttaattccctcccagaagatagggaggcctctccccaccacctgccctgcatcctccttcacagaccagcctccaggaagcgcctcttgttggaatcagccccacttttagagtgttaacacctttaattagggactcaccagggcgatgcccttgcagtcagggagtcccgtgggtgagagtgggctgccctggggagctgcagggagtggagagtgaggccacagggagggacgtgaggcatgaggggaggtggactcaacctgtgggccctgagcccctcagtaatggcccctcaggttctagaaggctcactctggcacagtgaagagggggcagatctagaaggaggaaggaagagaagagggagggaaacaggcactgcctgagtgcattctttctaagaggccagggcaggagaccctccaatccctcgggcaccaaaggaatgagtatccctggctctgcatgtggggatccaggctaggggaggcccgcgcctccaccaccatggcacagttccaggaaggcaggctggggatgtggaccggggctctctgacccccaggcagatttttgggggtttaccaagctgcactttagtataagggagtttgtggcatttgagtgctgtggctgtggcgactgtgggaggaggaacatttcagggcactgaggacacggagttctttctcagaaaggtccctgcctgtgccggggcctggtgaagggcacagcccacgaggcttctgcaactcctgccgctggagggcctgtatcccatttcttcccagccccacggtcagagacaccatgctggtggtgtgaaggcgcctgtggtgggcggatttacaccccggattttggcagcgcgaacttctccatgcttgcacagctcttttgatcaaagccgcctttttctgggatgccacacagcaggttggctccttggagctggatgtgagatggtttcagtaagtgacctgttgagcaccgtgactctgatttgtacagaacgaagcagggcccgaagctggacctggcagatgttggaggcccctggaaatactgggaagcgtgaagggcaggagatgctccttcctctgtggcggggcctccaggtcacccgagtgtgggtgactcacacctcagctacccgggggtctgcgcctcggagtcctatcccccagacagtggtaaaatgccagacatgtttcctcctttctcctcccactcaataatgacttatgcaaaaaagggaacggaagcatggacacacacgtgatatgactttcagtgactttttcaactttttcagtccagcatttggaatgcgatgacaactggtgcattattttaagtttttaaaaatataattacagaaatgaacacacgagccatacagaaaatttggaaacacagaaaagaacaggaggaggaaacgatcccaagcctgctgctcacgaataaccacctttcacatgttctttatccagggcagacatttcacaagaggatggccactgtgtccaagacatttgtagcacgattttaccactcagcaatgtatccacagcagctttcatgcctgtgaacatgactccactgcatgcttttacggccacatggcattacctcatacgcacatcagcattcattgagcaagctcttgccacttaactgtcagttgtttccaattactcattatcatacataatgctgtgatgaacatcataccgtacaaacacgactgtgcacaagttggattatgcgctgaggatgaattctgagaagtggaacccagcatcttagctgtgctctgttaactccagtgacaccccagctctgcacaggatcaacctcctggcaaactcagcctcgttaggcaagtccaggacccccagaggaccaggagactccccaaaacttcctgtccccgcatgctgatgaccaggggccctttggtgagaacctcctgtcccgaccaggcgaagaggccccgaggaaggaggagggagacaggagcgactcctcctcagcccacccagtcctcagccctgggagccttgggttttgttgctcaaacacaaagctcccctgttgcctcactggaccatgactagcagtgttgccaggagctgagcagttctgttttattgtttgcattgagttagggacgaaggagatttgtgactttctaccaagttggacttgttcagcgttctcagggcactcagtcagctggccagctccaagggatggaggggcttcccggcagtagccagttaagatgcaaacctttcacttaaaaacacgcctctggtgattaggcaactatttttagaagccagttttggggggattgtttctatttaaataggcttttagtttagaatagttttagatttgcagggaagttgcaaagataatgcagaaaggtcctgtaccccccaacccagcttcccctaacgttagcatcttacagctctcgggactacttgtcctaaggaactgacactgggcattgtcgggaaactccatagtttatttggattcccctgttttcccctgaatgtctttttctgtcccaggagcccaccttccatttagtccgcatgtctgcttaaccctgaggcctttgctttttgcactgggagacaaagcagagaccttcggattctcagcaagcctccaccaggctcctggcgttgccctcctcgagctgcacccaacgttcatttttcatgcacggccatcggtagagctgcctggatgatgaggagatgaagagtgagtcagggacaacgcaggaaagagagtgcggctgagaggaatgcccacagcaaggccgggcgccaggcagacagggctgggtgaggagagcggggatgcaggctctctgcatattccgtgactctggctgcccctgctctggccagctgagcagtgtccttggtgatgtggtcccagcagaagccagggccgccacctctttcttcgttgcagagtgctctgcagagaacttgggggacccgagaaggccagtccctgggactgcagcctgctgaggctgcccttccgcttggccaatcccacgagttttccccaccctcgcgggggtgagtccaggacccagttaccagctggcctcctctagtcttctgggctctgagaggtcttgagctgtgctcctaaacatccccgggccatagacacacaaagcttgccatgtatctgggcatgaactggacagctctgagtaaagccccaggggggcatggcacccaccgtcagggtggctggctatggaggccacagagctgggcaagccttctctggggcccagcactggggtccctcctccctctgtgtcctcctcatggctgccctcagcctcgtcccggagctcccatcttctcagcttccttccgtcctgggagatggggtcatctcctgccctgggcccacctctgccgtcttggcaaaggcacactgcaggctctgcggcatcgggcacacgctctgctgtctcctgacccctggggttcggtttcttctccttgccctcctcttgtgcttcttggagccctgagcatcagcctccggactcctgacagcttccctttgggtggattctcagactcctgcagtgctttctgagacctctataagcccctttttctggaaagcccaccgtggcctccccctgcagccttggctgaggtctggtccccaggaccagcacacctcccatggggaccccaccgggttggcctcttgccttcctcatctttgcctcctgcagaggctggccgcgtttctgtgtctagagctgcatcggagctgcactcacactgtgaagggctggggagctgtgcagccaacagccagcgggctggcctcaggggccacctccagtgccactctgccatgcgtctccacatgggcgagcagtggacatgtccgacttcacatttgcactgccacactcctggtctacaccaggccgttcttcccgcagctttccccagctcaggaatgaagccccagggatgccagacccgaagcctgggagccttcctgaagcttcttcttctcttacaccccatcccgtctgtcagcacatcctgtggacgcccccacctgatctccccagggacccatgctgcactcacctgcactgtcacctaggtcggcccccaccacaccccacaccaggcctgtacctcgccttgtgggcgccagggctgatgtctgcagagctgctccgagctcccctctgcccagcctaggcatgagcccctctccagagtgtccttccaatcccccacactgcttcattccctgaggctctcaccccatctgaatatctgtagatctccttgcactattgttcccccactggaatataagttccctgaaggctgggccctgggcacccggcattgtgcccggcacatagcaggtgctcaacaaatattgaatgaatgaatgaatgaatgaatgagctatcaggacttgaagcagcaaggggccctttcagggggtggtggagccccctggacctggacttctgaggcctagaggaaacagagacacctaggaccccagctgaagctgccctggaaggacagatgggcagaggatatgaaaaccaaagccaatggccctccaatggggtgggtgtctgcccaggcatggggatgggccccgaacaggccacagacctacaggcagaattcagcaccaggaagcaccgacgtgaggtccccgtgcagcaaatcaggtttgtcttttatcgccagtatcattaattgtatcattttctcccagccctgaatcagtccgggcagttcacgtcaagacctggggcctgccccgcagaggggcctgaaccatccacctccccctgcagcttggacatcgactgtcctggacttgagaagtgctgcccctggtcaggggggcgctactgcatggcccctgcaccccaaggtaggctgctgcgggccatgcttatggacaggcagcaaaggcgggtctcggtgaggcctgatctgtgtgaaggtgtgggggggagtgtgtttctaggagcagtgaccgatttcatcaggagcccccaccgtgtgcacaggcagcacctgctcttagataatttcttagtcaaaatctggccactgaactctcgggggagaaatctcatggcgctcttaggggccctgaaatgggaagacacttctggtggagcagagacccggatttcccagtttgcctggagaggccaggagctccaggtagattagttgcaggtgtggagctggctgtgcctgcagtgccacaggggcctgacgagcgccacagcacccgtaggcaggccctgccacctcagatatgcgcctgctggtctggaaagttctcttttgattggggtctgcatccaggagaatgggagaatgggatggcctatacatatatatatatgtataatgttacatattatttaatatttaaaatattatatattatagcgttagtatggtatgcagtaataaagcaatagtatacataatatcagatattatgataatactatatcattatactacatgctattatatagtatatatcatattacatatgattatactatccaatatttgtagtatcaataaaataatgacaaagtataaagtaattttctatatcaacatactatgacagtataatgaggctgataggctctatttacctcctaagcagatctcttcaagggaaggcctgctgctgtgggtcccaggcccagctcacctctgagcagggatcggtggtcttcagggacattaggatggagaggagcgaggggcgggcagtgaggacatcccccgtctcctgtggtagatgtctttttgcagggaggtaaatgcagagcagggcctctcatggcctctggttccctctcctgccccctctcccaccccagcagcttttgtgacttcaacctgtcctgggtccataatcatcagtgttttcccttgtgtagctccagagagggaccctgtgggctcctggtacaacgtcaccatactggtgaaaatggacttcaaggaactccagcaagtggaccccaggctcctgaaccacatgcgccttctgcattccttggtaggtgagacagacgggggctgcctgcaccctccttgtggcagctgctcaggcagacccaggtatggggccgtggaagggacctgggggttggggagggtgatgttccccaaatggccccaaatgactgactctgaacgaaattctagttcttaaaaaatcagcttcaaagaggtatgatttacatgcaacaaaatgcacacaactgaagcgtgtagttggctgagttgttatgtgtgtaccctcataggcccgcctgtcgtggtggagaacgcggatccctaagcttgcaggggtctgcagtcccagcaaagacagcctaagccccgagctcttccctcaccaccctcagtcccaatttcttcaagttctggctcctgcttcgtggaagccagcaccaacctgggagtgctgagatgggaaccgtagcccagggctggagagcaccctggggtctgatggttagcagcgcccctggcctctccacacaagtcagaagcacaccccagggtggcatccaaaactgtctccagacgtcgcccactgtcccctggggataaaaacaaacaccctggctgacccttgctgatgacacaggtcatgctttctggcccatcagcagtgattaccaaccaggatgtcttctccagctcaggccaccatcagtctcgggaatcccagtgtggacagggcgctgcgtgtccccaaggctgccgcgtgtccccaaggccgccctccctgggggatggtctggcttcaggaccggctgctgacaggggcttgtgctcagaggggcctcagcttggtctaatgtgctgctgttgcctctggaaatgccgaacacttttcagacaaggggccccgcattttcctttggcatctgtgtagctgttctgtgcttcagatcttttgtgtgtcccatatgtccctgggtgtcttggtgtcaaacccagggttgggtcactccttggccgttagactaagctggctggcagcccagatcagatggtgcacacctcatgttgttctgggctgctggccagtgagctgctagacaggtagtctgcagcctcggccttaacagcccgggctaggagtgattcctgtttcctcttagcttgttaaggggactgcccaattggccagtaagaaactagctctgaagccacactgcctggccctagtgttgccactcatcagctgtgtgaccttgggtaagtcacttaacctctctgtgcctgagatacctcctccattaaacataaataatcggccaggagtggtggctcaagcttgtaatcccagcactttgggaggccgaggcaggcggatcacttgaggtcaggagttaaagaccagcctggccaacatggcgaaaccctgtctctactagaaatccagtaattagccaggcgtggtggcacgtgcctgtaatcccagctactggggaggctgaggcaggagaattgcttgaactcaggaggcggaggttgcagtgagctgagatcgtgccactgcactccagcctgggctacagagcgagactcttgtctctaaataaataaaaagtaaataaatagaaataatcataaccctgcctgagacagggccatgagcttaaatcatacatgtaaagagcttgagatggttcctgagcttcctgatgcgtgtggggcctgagatgttgtggttgttgtgttttcaatattgctgcgtgacacctgctgtctcctcgtgcatgtaggtttcatgtctccaaccagcccattaccccctgcagaagcgcctgccttgcacaggggtcaggcaccagcaggggctggtctctgaggcctgcttctgctgctgaataaggggttccgatgaggtcggggctggttcccagttctgtatgctaaattatgagctgcatctcctcccaggaaggggcttcaagtgtgtatcggaggactcctgctctccccaaacctcctttggagttcccagtggaggcttgggggtttgctggcaaagtttgttctggtgaccactggtctggctgtgcagctgccagttcacctggcttcccaagggttgagatttcaagatattaagctgaaataaaaatactgcatatgaaatgaggaaagtgatcattaaacctcagaaaaataattggatgtgtacaacaggagaccgtggcttttgatctctaattgtctaattctagttctaattctctgttgtcagctgcaagagacctgcagtcttggcaagggcagaagaccgagggtcctgggtctggctgctgtattagtgtcctggggccactgtaaccaaggaccacagactgggggcttcaaacaacagaaacttattctgtcacagttctgggggctgaagagtctgaaatcaaggtgtcggcagggctggttcctcctgaggcccccaggcctctctccttggcctgcagacggctgtcttctctgtctcttcacactgtcttcccccattcatgtctgtttctgtgtccaaatttcccctttttgtgagggcaccagccatattggattagaacccaccttcactaattatatctgcagtaaccctatttccaaataaggtcacattctgaggtactggaggttaggacttcaacatatggattttaggggacagaattcagcttatcacaactggtactgaaaggtactgatagttccggtttgtaggacttctattgggatagtgatggatagataagtactgtagaggttctttgctgaagagcagaatggtacgtgtgtgtggacagttcatttcagctctgcgggcctcagtctcctcgtctgtctgacggggtgtccttctgctgtgtgacactctgattctgccttcacaggtcaccagcgccctgcaaccaatggcctccaccgtccaccacctgcactcagcccctgggaacgcctccaccacagtgtcgcggctgctactgggcctgccacggccactgcctgtggctgacgtctccaccctgctgggtgacattgcgaagcgtgtctatgaagtgatcagcgtccaggtgcaaggttgggcttccctcaatcctccctctggggaggctgcagggtggtgcctgaacagccaaaatgcaaggtggacgctaaagccagaccagtcctttgtcttttaaaggaggtttaagttcaggagcaaaagaataactggttcaagtgtgttcatcccacaggtgtgggacccatcttcagctcaccctgtaaattccaagtccccaagtgcagacctctagaacttattttgccccccatttcccgcccctctcctcttccctccatctctcctcggatccctctggcctcctgccccctcggcaggcttctccttccatcctagtggacactggagtgcaaatcccagagccacacacaaagaacttgtttcttcatttctttggtttcctaaatttccctctcgcctctttcccacccttgccaaggacatccttgtactccaaaggctccttcagcacaatttgtctaaagttgaatttgtatctggcaaagcacatagacgtggccttgtttctggaagaaattacctattctttgttgttgttgttctatgtcaggaattggcaagcctcatctaaaagggatcagatagtaaatatttttggctttgcgggcccacgtggtctctgtctcaacgactcagccctgctgttgtagtagtcacagacagtccgcaagcaaacccctgggctcccgtacggcttcctgtacccaagcaggaggcagccaggctagtctgctgctcccagggctttgcaggagggtggctgccttggtgaagcctcttctatgacactgaggaggcacgtgacaatgccagggctcagagccgtgtgaaagctctagtgattgcattgatctcccttcagatccgcacatgttctgcagaaccaagctgcattgctctagtgccattaagcaaagtgctcgttctgtcatctgctctgtcaatgacctttggccagaggttgcaggagcacacctgtgggtggaccagttgagtttattattcgaggcagcgagggagaacccacaccatggagaaccatgtggtttctcagtaggagattgttagaaagaacctgttataggatgtgggttttgactgggtggtttggggagggtctagggaagtgtgattttgttctgaattgaatgccatcagaaaatggaggcaactccacgactgggaatgtcaatacatctaagcaaaagagatgggaacaattgcataaagataagccatagtttgtaaagaactaataatcactcatttgggccaagggaggggcattagtattttgtgggtgacacatgagcttatcgcgctgtctgtacttagacagcattatgaagaggccctgtctgaggctggctgctgtgagatggttctgtttgggaggcctgggccagcctcagaacgtcaggggtggctctgggtttccttgttggcgcagaaaacacccactgatttactttacgcttggggtgggatgttttggccccaccttttcatgaccactcagactcagtccagcccagagtgatttgctcacgtgaggctgcccggtgagccagccgcgagccctgcctgaacgtgggctgctgcttggatgacgatggccagcagccgcacagggccttctaagacgagacttccatagtctcccttgggatcactgcccaaggcacccctcaaccgacgtggcacaaatccgtggcacgagtccacagaggccgtgtgtgtgcaggtagatgaagatgacgaggtagctgcgactgctgagtgtgggtcctgctctccttccctgtagatgtcaatgagtgtttctatgaggagctcaatgcctgctctggaagggaactgtgcgcaaacctggagggctcgtactggtgcgtctgtcaccaggaagctccagccacgtctccacggaagctgaacctggagtgggaaggtaatggctaggctctctcagatggcatgggaatggcttaattcctgtttgccccgggaatactcaccagcagtgcttacagctgcagcattcaccccgagataactctgccatgaaatatcttgcttttattattattttcgcatcactgtggtatattgactttggaaacagaggacacaattctacttatagcattctgcttttagtagtggtatttccatttacaaaatatagtgattctcaatcactgaaaatgtcaaatcctagaaaacagcagtcccacgtgtgttgttaacattgttctcgaacaagttgttggccgacgattcatttgctgaacctgtttttctgaaatagatgattctgatgattcagacagttctgatgttagttctgtttagaagtaattccaagaacagtttttatattttgttttcatattgaaaatcagttagatttgcttcagccccaaagagcttgtttatgtaaaattaaatgagtgccggcagtgagctgccgtttttttcttcgaaacgggaaaagggtgaaggcattttttaaaggctggatggtcttcagaccacagggactcttcttgccaagagggaatggctggctaaccggcacagaatacacttagttctttcagccattattgatctcctagtgggccaccctcgcatcttctttggcttaggaaatgttgatttaggtgctattcactgtgctaggtgctggtaatggaagcatgcagaagcaggtcctaatctctgcctgtctagtggattgtggaaatggagacattttggcgcatgaaagggcaggactgatgtctgcactggaaccacgaggataagctgggaccatccctagcatcgcgggatcagcctggagagcagaagagcggactgggtgttgggggaagcatgtagataaacgtgcccaggtctgtccctgttgggagtggggagggatgtaccagccaggactggcacacgggattggctctgccatcaagcagcttggaagaagaagtaactgtgtaatctgaaatgtaggaaggtgctataaagacgatactctgagtgcaggagtctagggtgtggaaggtggtggagaaagggattccggcaacattttagagatagaacctctggaacttattgattaattcagtgaagaagaggaaaaaggaaagaagacggaatccagatgtcttgactgaacagtggagtagaaggtgtttccattggagaggatggggaagacccgagctgttgttattattgtcaataatagttatagctgagatggagtgagtggcggtgccaggatgctgattgagttggacgcgtggtgctggagcacagaggcggggctgggctgcatacgtgagtccagggtcacctccaggtgacacttaaaccatggtatggctgagagaagggaagaggcctggggcctgtggccagagaaccccaacagtgccaggtcagtgcaggaggagaggctgcagatgacctgggtaaggcaggaaaacagctggaagggcgtgcgcagcaaggtcagcagggaaggctcagcaagccccaagcgagcaagcggtaagctggccggcaagcagggagggtacacgcatgggtaacagcagggcaggaaagtgcctgtgggaactacggggatccggtgcagacttcaggagagcagaagggaagcagccagcagcccgggttaggaagacagctggaggagagaaagaagcgagaatagccgagaatcctgcagggaagcttgactatgaacaggctgagggaaggaaagcctgatgtggaggaggctgtggactcccagggggtctctcaaaagacaggcgaagctgatcccggctctttctattccctgttcctttccaggttttgaccttattgaacgcagggttgagggtttttttgtttttttttttaaaccttatttaaatcctgctacatgtgtaattttataagctgctttcttcagttcctataatgtgtataaagtttccaagaagaagcctggttttcaccatgataattattggtggttgaaaactagtggctttctaaagcaatcatataatattctttcccctcacgggagcacttctgttgctttcaagagtctggaactgtaaccttgtgacaggggttacagggaatctctttatatccaatttgaattcgttaatcatttaatttgcatgttctttttccttaaaagggactcaacattgaggaccatccctttgttcacaataacaccacagctggcagttgcccgcacttcacgcgctctgggctctgctctgagcactctgtgggtattgcttcgtttaaattcttagactaaccccaagaggcaactactctccttaagctcattttttttttcagaagaggaaattgagggggacgaaggtgattttcttgcataagatcccaaggctggtcctctgaagacgcacatgaaccagctgtgtcccaaggctgtcttccctaggagccctctggcggggacctgcctgagagtgtgatgggctctcccccgccctcgggggctgccttttgtcccagtgcactcaggaaaaccgccatgccctttccaaccttcatgagtgcttaggaccaagagttgggtagagctccagaagagttgaattattttatttggcgttctagaacccaactaggaaaaggagtctaaggttctggtttatttatttatttaattaattttattgtttgttttttatagagacagggtcttactctgtcacccaggctggagtgcagtggcgtgatcgccggtcactgcagcctccagctcccaggctccaatctcagcctctggagtagctgggaccacaggcatgcaccaccacagccatgcgccaccacagctggctcatttttaaatttttttgtagagacgaggtctcactgagtagcccaggctgttctcaagctcccagcctcaagagatccttcctccttggcctcacaaagcgctgggattgcaggcaggagaccccgtgttcagcctaaggttctgattggctcttctcgttgtcctgtgggcgaggggttgggggagtggaccagttcccagagccagctgtggatgtggcgggctccagggtcagatcttccccccatcaccaggaacgttcccctcctatcagaatgaggctgtgtggggagagcggacttgccctccacccactggcagatgaatccctggtgccccgcaaagagcaggcactccacaaacgtttcctggatcaatcacggaaagagaggttttcacagtggtcatccccggggtctccaggtattaaaaatttccagcccagctctgccagcaaaacactgagaacactcctgtaccccgcagcacgtggccttgagatccacttagaacttcgcgccacgtccacatcccacggcaccccactaagctctgcagagaactgtctatagattcctgctctgtggcttccagggtgagaatcctgtccctttcgtgagcacagaaggttggaaaacaggtattttccaaatagttatttttaccctggtcagtcatccggaaaaatattagattctatttacggttaggtttgttggcagtcacactctgccgtgttgcttggcacagtgaactgccagattgcgtcaggatacagggccgctcgagcgaccgccaaacacaaagaggggaggctgcgcggccccagcttcacttctaatagggcaggacacactaatccagtgtttccagatcagcagtttagagtgaattccaattgcatattgctaagggaaacagcatccccggcaccttccctgctgaaccagagatgagtcacggctgcccgggaagaaacaagggccagactgtcagacgtggagaacccagggtgctttacccagatagaggcaaagttctgaacttgtgttcctagctgtggttggggagggctgtggagcaagggctctggggcctgaagtttagattatccgcattgccgtggccttgggtcatacaaacccagagtcaagagcatcattttctagggccacatttaagggggacactgaaaagggtccccatttaagggtaaccaaaggagggtgtcctggctaatgaaaaaccaaaaaccaagttataggggcctaccctggaagagaggagtcgggggtagaaggaagatttccagttttaaaataccccaaggtctgtccaacaaaagagagattggccttagcacgttagaagttggttggttggttttacaacacaaagaaaactctccaagctgtgctgtccagccacgggaacagctgccgtgaaatttcgtagatatgtaagtttcccgggtttccctaacaaaggcccatgaactgggtggcttcaaacaagagaaatgtatcctctcacagttctgaggaccagaaatttgaaatagttaccactgggcctaaatcaggttgccagcagggctgtgctcccaggaggctctgggagaatccattccttgcctctctgccctctggtggctgccggcattccttggcttgtggctgcatcactcctttgttttcttctgctgtttttttttttttttttttttttgagacagggtcttgctctgtcactcaggctgaagtacagtggcacagtctcggctcactgcagcctccacctcctgggttcaattaatcctcctagctcagccccccaagtagctgggactataggcacacatcactacgtctggctaatgtttgtgttttttgtaaagatagggtcttgctatattgcccaggctggtttcaaactcctgggctcaagccatccgcccactttggcctcccaaagttctgggattacagatgtgagccaccacgcccagccctactccatcttcaaggtcaacatctttgttttttctctattccagcttcataccgccttctcctttgtgtgtgtgtgtgtgtctgtgtataaatccccccgattctcttttataaggacacttgtgattgcatttagggtgtacctgggaaatccaggattatctttccatctgaagatacttcactgaatcacatctgcaaagattccttttccaaataaggtcacagtcgtaggttgcagggattaggacttgatatctttgaagctcattattcagcctgctactggtgataggaaagcttagtagtaaggcaagtgaactttgctatttcctattgttcagctttgccatttactacctacttgacctttctaggcctcagttttgtcctctgtaaaatggggatcctagaagaacttattacctgggattgctgtaaggactaaataggataacatggctggtgcacacagtacccaggaaacattacctgtaaccatgtcgctgatagcttggctggtttgtgacatggatgtcatgggagggagtactgcagggggctcacaccagggagttaatttatagctccctgcaagttcctaccgctgctataatgcatgctgcgttagcttggacactgtggaccttaactcatcattgttccctcagtgtttatggtgatgctgggtgcatagtagaagctcaattaaaaaaaattgagccataagaaattggtgcccttattggtcaaacatggtcaaatatggacaattccaaatgcttcaaggtaacacactggagaaagggccacacagatattggatgggaacattgtcctcagggataatgcatttctttggattagatgagattcttttaccccaaatgcttgcaatctctcttagttgcaaaagtcactgacggcagcttctgcagatgcctcggagggcttcacagcatttgaaatgccaggtttgcaggtcccccatccagtgatccaaaaaccccctggcatcttaatttaaagagtaaatatacttattaaaagaggtaaagcatgcattgccagccccgtaccctgtgagacttctttccaaacaccattcctctgcgttcttttcaaataagtacgggtgcccttttaattttaactctgctccgttcagaagcactccttatagaatgcgtttttaaatggcctgtaatctgggtgggccatctgttgtcccacccatgtgctctctcgctctgcgtcaagtttgatatctgaatggcaacaaggaggcaaggttggagccctgggtgtgggctggggggctgctgttatagctgctgcgcctgctcgtggccgccccactttcctgtttgcagggcgttttgctgtcacaccatcctccaccaacgtggattaaaaaaatgcttggggctgtgtcctgactgtacaaaaatagaacagtcagtgcttttagcagactttttggaaaagaaattgtagcccgcccttcctttttcagtgagacatatgttcccaaggaacagactttaagaagccgggtggttgttagaaggccaggcagtgagtggggggtctttttgattccagggttctggtgaccctggagacgggggtgccacccacaatctcaggtcccaagctttgggccaccctcagttgaagcatttctgcttttcttgccactaaagaaaatatcataaagaatgaatccatgtctgtttccctgaccagtatgccgaaaatcactggacaatcctgtaaaaagtatagatgtgtcttttaaaaaactacattctaccccacatcctagaagtgttattaggacacatcagaatttggatggatgtcactgatcctgtctgagtgaagcctgtccagattccagtaacagatgctcatctgctgggaggtggagtggcaggttctcagtgagggagctcacctacacagggaccaagattcaaaggaggcagctcagtctcaggttggaaggaggagacagcagggctatgtcgcgtggtggtgactgggcactaaattggattctgagcctctcagcagccaaggcgcaaagggaaatgagttggacagtgttgggttttttttgtttttgtttttgttattgagagaaagcaggcacatatgtctaaaagcagaattcttttcatgatactagaaagcatatatcctaccagtccttacagaaaaggctttgggaagccacacattataaaattattattttctttaccatggttttgcaaaatatatttttaaaagttctttgttgcttatttttatagagcttaaattctgatgtgaaaattttggtgcgtagactgggggccgtctactttttatataattcttactgcccagacacttgctgtacagccagaatgtttttaaccaaaaaagagcttcgatgctatttgagcactagaatatatataggttggtacatcagagctttgctctctgaggcatggatttcaataggaaagcataaaaagggcaataaaggaagctcagcctgatttctgagtccggcttcctgatgaggccattgtttatggagtgatgagtcagcccagtgcagaagttctcgtgcaaatgatcaagtgcttgtcatgaatcagagcagcccagggcctcaggagaggctggcaaggcagtatttgtagatgtggcacagaaaccttacactgtcgtggccattgctacaaatgttttctgtacgatgactgtatacgggtccccagagagactgttctgactttctagtaaccaccgattccggatcccagagagccccacgactcaatgctgttcactgtgtagacagaggcacacttggatgactcccaccctctaacttggctcagtgatagagaggctgggatttcaacttcagacctcttgcttctccatttcatctcaaatatccccatcacctaatgcaatcctgagctaccttccaaaattactcagaagcctagagagagagaagattgatacctctgttttgaatgaatgggttgcatttattattggaaaaaaaaacagtgagtgggtcaggtgcggtggcgcacacctgtaatcccagcactttgggaggctgaggtgggtggatcacgaggtcaggagttcaagaccatcctggccaacatggtgaaaccccgtctctactaaaaatgcaaaaaattagccgggcgtggtggcgagtgcctgtaatcccagctactcgggaggctgaggcagagaattgcttgaacccgggaggcagaggttgcagtgagccgagatcgcaccactgcactccagcctgggtgacagagtgagactctgtctcaaaacaaaaaacaaaaaatagccagtgctgttctggatgggtcaacttgatcaataaatcagtgagaaccaagttgagatgaggctctgttacctgcttcagaagagaaagccgccctcactgaccctttgctcatcttctctgtctgtgctttcgtagattgtcctccagtcagtgactacgtggtcctcaacgtcaccagtgacagttttcaagtatcctggcgtttaaattctacacagaaccacactttccatgtccgggtttaccggggtatggagttgctcaggagcgccaggacacagagccaggcactggcagtggctgggctggaggctggagtgctgtacagggtgaagaccagctaccaggggtgcggggccgacgtctccaccacgctgaccatcaaaaccagtaaggcccccagtcagagacccacgttagcttgcgagcttgtctttctatcccaggtctgtggccctagcatgtcgcgttcttcttcctataaccagggcaccagaagtcactgaccgccctgcacttcctccctcccctcccagtcatcccactgcctgcccggcattgcaccggcccgctggtgccttcactggctccctcgcttccctacatgtcgtcctgttaggggttcgttctgccgtgtgaggggacaacatgtggactcagaagcaccaataaggcatcagctagggtgaagcaaaggaacaaaataataataataaagcagaaggcggcagctcctggcaggcagatccggaccctgcccgcttacccagcagcactgaggccgtctaagttccctccccgagaggggagcatcgctgacgttttcacgccttgcttcactcatgatgcatgtaaagcgaatgccatgcccaccacattggtgctgggacaaaacgttttttctttttgagacagggtctcgctctgtcacccaggctggagtgtagtggtatgatcacagctcgctgcggcctcgaccccctggactcaagtgatcctgccacctcagcctccctagtagctgggaccacaggcacacaccaccacaccaggctaaattttttatttttcataaggatggagtcttgccatgttgctcaggctggtgtcaaactcctgggctcaagtgatctcaggaggcaacttttgtctccaaaacacacacgacacacacatgaacttggggcttgtgtcaggaaggcagccggtgtggcccatctgggtctgtcccgggcagcccacttggctctgcccgtgtcttgctccccacttgcctggtgcccgtggtgcctagacttggtcagatgaggcctggctggtggaagttctcccccaggctggcatctgtggctgtggggtgtgaatgtggggttgctggggctccattctggttctgggttccgatgtgtgtccctgacgtagagccagtgggagccctgggctgtgggctttgggcttcatgtctcagcagagcgtacagagcatacaagttgctgcatgaagaccatactggggcctttctcactcacaggggttaatgctagtgacagtgagtggtggtggagaatgaatggcggaatgagcgaccttctgtggctcggccctacacccttttcaaactgatttggggcggacctcaagctaagtcctcatagcagccagcacgggcatccagaaagccctcaagcaccccggccaccctcgacacaagccctccactgtgcacgcggcatcccattccaagctgactccacctcatcttctcatttcatttccaaagtacaccaggactgaggggagggacactcttttccctttttggaaactgaggcctgagaggcagttccattacagaaccatcctccagggtacaaaattgatctctattgggaaatgcaataggaacttgcagctccctccccaccccagcaaccccgtgccctcctcaccctccccaccccagcaaccccatgccctcctcaccctccccaccccaccaaccctgtgccctcctcaccctccccaccccagcaaccccgtgccctcctcaccctccccaccccaccaaccccgtgccctcctcaccctccccaccccaccaaccccgtgccctcctcaccctccccacccaccaaccccatgccctcaccctccctacccaccaaccccgtgccttcaggaaaaaaaatacctgcattccaatgtcaggcacagataatttggaagactctagaagactctagaattaccaacctattccacttcccagccttgattttctttccttttccagattataaaaatgccctttttttgtagagcccttttttaaggagcccaatttgctttaaaggccttgtctaattccaccttgtcatgagcctgtgacaccgggaggcagcagggcaggtgttacggtggcagcggatgcccagagcctccagggagtccaattcccagggccctggaggaggccgccagtccacggggctctgcgatacgtcggggcctgagaatcggaggccacatggagtgctcctccctcttgctaagatgggagattcacaggggccccaactgggaaatatacaatatataacattggtggcatttctgtggccttaagtgtggcgtgcataggtgacacactctgatggcccgtagcttgccagctgggagagagccagggtggggcacagctgcaggtggctgttagataactagagaaacatgcagaattgccgccgacctgctcctgtgcccgccgacgcttgggttgtgcatgctgggtttcctttcagtaatgaaagatgaatattcccgtgtcccatcttgaagcttttttccatctttgcttatgccccaaaataacgcaacctcccttgtaagtaagcaaccctaccattttgactggcagagtacgttcttgagaagttggactttcagagctaaattctggaacctcccgggcaggttggaacccattggtcaccctgatgttgggggcctgagtaagggcctcgtcgtgtgagtacctcctgggccctgtggttgtgaatagggcaaaggaaggcagcagccaccccacgggaaaggaccctccatgctctggttgaatcccagttcccgtgggtatgggctgtgtgtgacgtttgtacctccttcctgggatgtctctgccctggacataaaagtgtttgtttattctctcgtttcttacatttatttcccccaattaggatacctcaatctaagattcatgcctcaatctattaaaaaaaattatcccgccaaagagtaggcttcatggaaaacattaacagacaagtgtgtgacttttgaccacaggctaatttgtttcactgtctgtctcagatgcccaggtatttgaagtcacaataaagattgtaaaccacaacctgacggagaagttactcaaccgcagcagtgtggagtaccaggacttttctagacaactgcttcacgaggtaaagccacaatgcagacagaaatcttttcttgggtgttctgagtgaggacatcaaacacaagccgttaattcctgcccagctcttcctctgggattgtggcaaaaatacatgttactgcagcttcaggggaggccaaacccaaatcgcacagtgattagtcaaaagctttccccctgcttttatggggtacttaatccagatactgggccaatccatctttaagatatgtgcctttattcaaatggtgtacaccacttactcctactgttggattttctgtggaaccttctgtctgagggccctggcttccagctatggggtagcttcattagtgaagcatttaccaacaatcatggcatccattcctccctcgtgactaaagggagacatcagcagacagccagggagaagcaagccagtgggaagcaccatctatccacagatggtgcattggagggagaagtgacttcctaaactgccaagaatcacataaagtctgaggttttaccctccctgcaaactaacaagtgagtctgccacagtttcatggatgctggcagaagacacgagactcctgggccagagacggaagactgtattactccagcacagcaggcagcatgcgtgtgctgctgtgccggttccccttcctgcacccgagtcccgcagaggtgatgcagaggggaccaggggcatgaagcacacaaagtgggtctgcacctgagctgaggaaccccaactctagggaacctgaatcttttataatgggtgcaagcactggctccagaaggagacattatctgttacatcagacagtaacaaacctgccctttgctctggagggagccaatatctctccctcccaaggctgttcactatgcaaacatccttggaaagatattctggaacaaaagggcagttagtgcgtctacttgcaagatgtgtagaaatgccagagacccacagagtgttgcttcccaacatttgcctggaggaggaatctggttttcaatgttttcagagaattccctcccttttgaaatgttaactcacttgtgtgtgcaagtatgggttggcacaaaggcagggaaccaggctggtatctcccttgcttgggcatgggtagccctaagcacctggctctgtgtgcgtgttttgtgtgggatacagcctagtaagaggggggacagctccaaatagccataggcattgttccttggtggggcctctccatctatcaatcaatcagtctttctcacacgctcacacaaatgaccttcgcaccagttttcaggacactcagaggggattgtccatctgatgctccacaactgggagcttgattgcagtggtcactgtgagtccccagcacacaccaggccaggcccggccgtcccagggaaagcccagctaaggtgctgtgaacggacttctctgcgtgctctgagaggtcggtcgtcaggtgcctcctcttgattgtagaggagagaaatggctccaagcaccatccatcggtcacacctggaaccctgcttaatggtcgtgaagacgttgatggatgtctgctgttgcctcttcttggctaggtcgagagctccttcccaccagtggtgtctgacttgtaccgaagtgggaagctgagaatgcagatcgtgtctctccaggcgggaagtgtggtcgtgaggctcaagctcaccgtgcaggaccccgggtttcccatgggcatctccacgctggcccccatactccagcccctgttggcaagcacagtgttccagattgaccggcaggggacacgcgtgcaaggtatggcccagccacccgccctgctgcctggtgtcctccagctcagaaatcctcttggtgactttatttgagtcagtctttcctttatttcaaagggtaaagaaatgcaaatccttattctatcttcctccaccggaaccaggggccagggcagtagccctgaataactagctcacctgtgtctcattggtcagcccaggacactgagtgaaatggggctggaaggtaccctcaggggaaagggacaggagttcactgtgtctgtcgtcagggccccccagcacttctgggcagcgggacaactgcccacctgtgggtctatttcttttctttttttcttttcttttttttctttttcttttcttttctttttttttttaagacagagtttcgctcttgttgcccaggctggagtgcaatggcacgatcttggctcactgcaacctccgcctcctaggttaaagtgattctcctgcctcagcttctccagtagctgggattataggcgcctgccaccacgcctggctaatttttgtattttaagtagagacagggtttcaccgtgttggtcaggctggtctcgaactcctgacctcaggtgatccacctgcctcagcctcccaaggtgctgggattacaggcgtgagccaccgcgcccggcctctgtgggtctatttcattacgctgtgtgttatttcattttacttggtgttgccttgaagcaggaggtcatggacacaggacagacacaaagagacagagagataaagagagagacagaaaggcacggagaccaggttcttgctgtcctgcagcaggcacggagttctctcctggctgtgagggcacacacagtctctagatccacaagctccagttttgggctcaatctgtggagtgggcacctctctggtcgtctcccggggtgctgggtcttggagctcagccacgtgctggcttcctgtcccaaccttcccccaccaggaggtgccgggaagaactgggttgggtgtggggggatctactctttgaagtcatgcctggaaacctcggcctggggttactctgttcacttggcactccctaaggatggggatactacagtggcccctgtacctggtaagatcccacctagctgggctgcagggtagggcctgaggttggggtccacagggtatgcccccagcagggtcctcagtgtgtgaccccgtgatccaaccttcaggcggatccagccttcaggtggatgccacccagcccgccctccacacctccctgcctccctcctcccatcctctgggactagggctcaggcgattccagatccctgccaaatgagaacctcggcagcagggatgtcgtgggtagaatggtggccccctccaaaaagatatgttcacctggaacttcagaatgtgaccttatttagaataagggtgtttgcagacacgattaagttaaggatgtcaagatgaggtcctcctgccgttggatttgggttggcctgaagttcagtgacaagtgttcttatacgagacaagaggaggagacacagacacagaggccaagattggagtgatgcagccacaagccaaaggactcctggagccacaagataagacactggaagaggcctgggaaagcccctttcctagagccccagagggagggcggccctgctgacacctggagtttggacttcgcctccggaacggcgggaatacatctgtgctgtttcaggccccccagctggtgtgtttgtgatggcagccacaggagacccgtgtcttgcacctctaggactggatgaatccattgtaagcattcgcagcaccccactccccacgctgttcagtggtcctgcagaagttattaagctccttctgcaggctcttgcccggcagggtcccgggcaggctgtggcctgcttcctccacatttcagagctgaggtgctggtgcgggcaggtctcctgagctggggggtcagctgtgtggccagtgatggtgacgcctcaggccgtgcatggccggggaggcggccctgcctctgcactcttttgactccatgactactggtgtcttcggacgccagagtcgggggagcaaccatggggcaccgcccctgcctggggaggcagcacgaggcctgagcccagcttacagggggacatccacccccgctgagagccccaccttcacggcgaggatctgtagaagaagacatttgatattactcggcaaaaaaaacaagaaacgaaaacacaaaaagagctcctctgaagaagaaaaggtatttgcgctgtggtccacctagaaataatgttgttggcacaactagagcattcctcagtcattcaggagcactccctgccggtgcgtccacatgtcccaaccccgatagatgaggcgctgttcgcccgtggaggggtcaggttgtcgtgaccttatctttacccttaggccgtccatcccggggcctggggtttcctgcgccagtcacggtgggctgtgtaggtggccatgtgttcggtctttccccaggaggtacgtaccatgtgctgggaggcctggaggctgagccgccccccgcgcctatgagttgcaccctcacagcggcggccaaacctcctgctcactttgccccataggaagaggttagagtgaggcggaacgggttggaatcccagctctgacactcactcactgtgggatgctgcacaaatgacttcctctccctgggcctcagtatactcatctgtggaatgagattacagcaacatcccacctcctatggcgatggagtaaattaaggcacaatgcctgtgtgggtttagcccagtgcctgtgcatggcgacagtgcatttctgatggcccctccagcgttcagggctaactcttccaggattaactttcatatcttggatgagagctcatctaggaaggtctcctagcaacccctgggttcccactggtccttccgcctcacggggctcctttttgaacccctcacatcatttccattcaatctcttgctcctaacagcacggcccctattccttctctttcccaacatctgctctcaggagagattctcatacagtgtgcatttgttctagagtgagggtcatcactgggcttctatgaggcaccgctgtgaaccctctgcaccgaccttagccagaggagcaggactcccaccggcatccttctgcgtaagaggccttgtgggtcttctggggctctggaatcaacgccgcttttcctggggccagagtaggtggagctgagctccccaaagcttccagtttgctgcctgctcccacccgcctcgccactgcgcgagccctttccatcccctctgcagagtgagagaagggccgtgagtgaggatcctggcctagggctgtcaccatccccctcacctgctggccaggctaacctactgcaggctgcttcctttccttaggttcacgggtaccgctatttgtccagcgtccatttgcggtggcattaggatgaggtgctctgtgccctctttctcccagtgtgaatctgacacacgcccccaggagagtccgaggggcatcacttctggaggacgccctgggccctgaaagacagctcatggtccaactgaggagcctgcaccttgctgggacagggtggcccaggagatctggggtctgtacctgctcctggaccctctccagcttgttgttctgggtggggccagctcaggaggggcacctgggctgggagtctctgaagcagctgcccccattgctccaggagagggctcagcccttgtcccagctgcggggccagtgggagcagtgtgcagcgtcctgccctgggctctcgctggctctgcgccctcgcctggccagcccgggagggtgcagaggctcactggcagctcttcctgctcccacacctgcctcttcctctgaactggagggccggcaagcctcaaggcttaatgcaagactaaatacagctgtcagcgccttcctctgagctcgcttgggagctgtctggggggacggaggagtgaagattaggtgaatcaccacgccccaaaatagacatcaggtgcttggtggtttgagccagcgtcttgcctggtgcctctgctgtcctccgtggactgcagcccagccagcctaggctccaaccccaacccggagcacccccaggagagttacctgtaggctggaggttgagtagcaccccaggaagaggtgtgggttggcaccagcagtgttctgatggcaaggcagcccccaggccatgctagggtggtggcatagctgttgtggcagctgacgagcttgctgttctccagggaagctgcttctgtggagaccgcaggaagcacaacagaaaaaaacccacaaaacgagcctcagagcactcagcagcagggttttctttgcccagaactgaactggtcctgcatcgtggcttaaattccacctgaattggaacttctctggcatgccgggtgtgggttcgttcccgagcacctccacccgcagctctacagaagcacgcgcagaaggcactgtcacctccagcagggcctggccctgacgacctcggctcagccaccccatgggagctacattgtccttgtcctcaccttcattcccctcaggcgggccccccggtgacatgacatcacaagtctttgggcacaggaggagggacatacctgtggagacacccgggtgctctagaatatggcgcgggaagttcatgttgtactccgctggaccccacccccggcgtgggaagttcatgttgtactcaggctgacccccaccccccccacgagagaagtccatgttatactcaggctgacccccactcctggcatgtaaagctggtgttatgctcagctggacccccacccccggtgtggaaagctcatgttatactccactggcccccacccccggcgtggaaagctggtgttatactccgctggacccccacccccggcgtggaaagctggtgttatactccgctggacccccaccccccatgcggaaagttcacgttatactcagctgtgtccccacccctggctcagttactttcctatttcttggttgagacactaagtattggagaatgttggcacatcaaagagagaggagaaaacatttcaagttttgggtgtggaaacagaataaagaagagagggctacatgcacacccatgggtgctaatatttaaggaatgaacatttcctaatctttgcccccaaataagccaaccaatgtgaaggtgggcacaggcaggccgtaaggttgtcatgagagtgttggacggatgccccaaaatgcccctgctcccggccgttcactgcaaagacggctaggaaggactccttccagcatgggtctgtcttctgatcactctttggctgttttctcatgggttttgattgtgtctccccctggcagactgggacgagtgtgtggacagcgcggaacacgactgctcaccggctgcctggtgcatcaacctggagggctcctacacctgccagtgccgtaccaccagggacgccaccccctcccgcgcaggccgggcctgtgagggtacgtgtcgacccccctgccgactctgggaagaccccctgcccgagaatctgggggtggggcaaagcccaattctccataggcacagggctgaggacctatggtaatgttaggggcctacagaaatgttttcatttcaatttattttaaaatcagaagaaagaaattaatagaaggatagtaaatatacataaaacaatgaatctagcttggattacactcatctctatctaaatgccattataaaatgtaatttttgatagattgttaagtggaggggtgcaggggtccatgaaggccaagttccttgggcccacagaagtcaggatgcagcccggggtcgagggattccttccccagtggcctggagcccgagagggtgtggcctggagcccgagacagtgtggaagcccagagaagctgcagagaggcccgatgggggccgctgagctctagtcctgctgtatcggcccccagtcttttctgtggaccagttctgatgagtgggtcggggatacctgggatgctgaattgagcagcaggaggaggccacgtagggacctaaaatgcagtgactgattagcaatgtcggcccggacacaggcgtggcagaggcgcccagccactggcttgccagcccctgctgagggctttctagctggaaggagcagccgagaccagttccctggggagaatattccttagacactgcgtgtgctgtcctgcttcctaacatcccacaccttgtcttctgtttttctcattcgcctaatgtcctgcaagtcgatgacagcatccagcaccaagtcccacattgagcacaaatctgggggaaattgtcccattttcccagagtcctgatggattaatctgaggcctatgagaaccaagccctgcattcaagcccgggttttgtagccccccgggtggatccctcaccctcaacttcagtttcctcatttatccagtggagaggcgtgatttgccttcagagagccccggggaggctgcaaacatgggcccaggaaacactcctgaacgctggcgcccgcctgcgtccctggccaggtccactccgggatgcagagcagtcctgctggacggccatgctgccctcctgggagggctcttactcgtgggtgggatccagcaggctctgacagtggatgtgtcttggcaggtgacctggtgagccccatgggcggtggactgtctgcggcaacaggggtaacggtcccaggtcttggcacgggaacagcagccctcggcctagagaacttcaccttgtcacccagtcctgggtaccctcagggcaccccggcagcaggccaggcctggaccccagagccctcacccagaagagggggcagcaatgtggtcgggtatgacaggaacaacacaggaaaaggcgtggagcaggaggtgcccagcactgccccgggtctggggatggaccaggggagccccagccaggtgaaccccagccaggggagccccagccaggggagcctcagacaggagagtaccagccaggcgagccccagccagaggagcaccagccaggggagccccagccaggtgaaccccagccagcggagcaccagccacgcgaactccagccaggggagccccagccaggggagccccagccaggagagccccagccaggggagcaccagccaggcgagccccagccataggaacactatcggggtgataggcaccacctcctccccgaaggctactgggtcaacccacagcttccctcctggggccacagatggcccactggccctccctggacagctacagggaaactccatcatggagccaccctcctggccttcccctactgaggaccccaccggccacttcctgtggcatgccacccgttccacccgggaaacacttctgaatcccacgtggctgcgaaatgaggacagtggaccctccggttctgtagacctgccattgacctccaccctcacagctctgaagacccccgcctgtggtgagttcctcgaatggtgcatggggactaggactaataggacccatagcctgtgtgagcctctggggcaaagctcctgcagccgtggagtcgcaggctgctagcaatgctcaggcggcatcctcatcttgtgcgtgtggaaacggaggcacccagcagctggtttctagttgagttaggaagacagcttggtccccttgcctgtcccagatctctcttccccatctcttagggctccctgtctgcagcagctggggcggaggtctgccttcaggagcaggctttgggccttacttgtcgcgttaggtgctggagccatcccctgaggtgttgcccacccccgctgtcctgcctcctagcagaactgtgtcccggccccgatcagtgtgatgacacccccacaacaactctgcaccctcccagtaatgctgcactcccatagctgttctgcacccctcagctgttccgtcaccctgccaagcattctgcagccctgcagctgctctgcacaccaaggtgtgctgcaccccagcttttctgcacccccggctcttctgtactcccagctgttctgcacctccccagctgttctgtatctccccagctgctctgtatctgcctagctgttctatatgccccagagattctgcatttccccagctgttctgcacccccagttgttctgcatctccccagttcttctgcacccccagctgttctgcatccccagctgttctgtatctgcccagctgctctgtatctccccagctgctctgtatctgtccagctgttctatatgccccagagattctgtatctccccagctgttctgcacccccagctgttctgtacccccagctgttttgtacctcccagctcttctgtatctccccagctcttctgtatctccccactgttctgcacctccataggtgttctgcacctccccagctgttttgtgccccctcagctgttctgcacccacagttctgtagttccccagctgttcttcaccccagatattgaacctctgcagatgctctggattgtcagctgttccgtacccccagttgtttttttaccccctaagtgttctgtacccccatctgctctacacatccagagttcctgcaccccccagctgttatgcacctctagtcataccgtaacccccagcaattccatgttacttgtagaagatttagccatcaccaaacccccaggtgacatctcaggagattcacagcaggaatctgtgcaggagttggatctcagccgtgacagccctgtgagcttgcagagctagcctgcctctggatttcatccaaatgagctgtcaaatgtgatcttcctcaatgcatttcctctgctaagcagcacaggctctaagactaaactcttagcccatgtaagtcagtattaccgagggacctggggtcttcctgtaagaatggctctctagccagcattgtcaccaatgtcaactcctagttggaccctgggtaaatccacccaggggtcaagagtagacagtccatctgaggcgccaccaagaacctgctcaagaggccttcattttggggagtccaggggcctcagggatgtatatgaaccatctgctgaaacaaaacaaaatcagaagccatttgctatcatcccaaggaggggcaaggatgcaggcccaggaagcccgggcttgggaggtttgtacaggatcctactcacccatcacctcggcggccatcacctgcaaatcgctcatgtccccatggtgatgaatttgatttttggcattgggcgaggcttcttttctcctagaaatggcttgattgtaattttggtgtttatattccacttcccagttcctgtctccattgggaggatcatggtctccaatgtgaccagcaccggcttccacctggcatgggaggcggatcttgctatggactccaccttccagctcactctgacttccatgtggagccctgctgtggtcctagagacctggaacacgagtgtgacactgtcggggctggagcctggggtcttgcacctggttgagatcatggccaaagcatgtgggaaagaaggtgccagagctcatctgaaagtgaggacaggtaatgggcttccatttgtttttaaagagaggaacaaaaagtatgaaaaagactttctgtgggttaaggcttaagagagctggatttgtttatgggctgctaggtgtcattgttcttctcagcttagggacatccggctggcttcagcaggcgtgcaatgacggccagacaggaggtggcttattcaggaaaaggcattaggcagcccacgggtatggaggcggcagcagagtgccatagactgcgcctggaaggctgcgggtgcggctcacccatgtcctccgggggaggcagcatggaaaatgcatgcggtgctcatctgttgagctgcatccactccctctgatctcaacagtcctacagaggacttggctttcaggaaggacatcaacagacaatcggcagtcacatggatgatctgtgagcagcctgccagagcctggggccacaaagtaaagaattgagcaataatgaatcaaacatagactccactgcgttccagctggacagtgacaatattacacatatttggatgaaattcctcttttcttttcattagcatcgctacctgggtattttcttatgtgtaccttacctgggtagtcaagagcgtgtctgatgttgcaagctggttttcacgccatgggcagcttcccaagcgttgatagcagtggtctgcacggtggggcgcacaccccttgagggaggtgtaggatggtttcacactgtgggcagcattgatagcagtggtctgcacagtggggcgcacaccccttgagagaggcataagatggtctattgggatgcaataatagaagttgagaactatgtatgtgctttaaagtactaatcagccatggcctgagaaattagagaacagatggagtgcatgacgtgaattgtgcacgttcacgagcagctggagaggagggagatcagtgctggctggacagtcagacagggtggctctggggtctgagagccagagttgggcctctgaaggtctcagctgctctggacgggacaggctgcacgggggaccccaaacctgtgggtgcacttatacctgctctcacctgtgcacctgtcctgctactgatggctttcagactgggttgctcatgccagccatggagactgaaccagaagccctcaggggcagcaacaacaatgatctcaaggacgtagagtttggggttcgcccaggaatgcatagcagaatggctctgtggtttgtcttaaacttagtgagaagctctggggagatggactctaagccccctgaggggagagctgtgtctttctccttcactgtctagaatgcctctggcgcatggcaggcgctttgcaaatatctggtgagggactgactgaacactggggtggctgccatgccagggccaggatgggatggcgacattcctggaccacatttatgtgccacatactcctagaagccctctgcggagggaaaagattcagatggaacagatgatgccaaaacagggactgcccatagaccaggggaggtggggctgctgggggaggaagaaggactggctccaaacaagacccctgggcaccctgtggccacgtggactctgagcagaggcctggccagggccctaagtcctgttatacctgggacagcccagtttgcacccgtagccctggcaaagttatttaatggtgcctccacatgcttcaagtcatgccagcttgctgggaaattgtctgaaccccagcatgggggaacggcagcaaggaaggaaggctatgtgtggtggggagacagttgcaggggcgagctggctctgtggcctctggaaggttctcccactgtgttcaggctgtgttctgtgtcctctggaatctgatgggctgtgtccctgagccctggcactattccttctttctagaacacgggttggctttggtgtgatgctcttcctggacatgaaaatacatttattaatattgaaatgttagtctgttatctaatacagcaccaattccaaatgtgcttatcctccatcctgcagcagcccggaagctcattggaaaggtcagaatcaaaaatgtcaggtactcagaatcctttcgcaacgcaagcagccaggagtatcgagatttcctagaactattcttcaggatggtgagttggtgatatcagcccttaattcctttcaggagggaaagggtggaaggctgatagaattctaggttaggcacggtggctcacccctgtaatcctagcactttgggaggcagaggcgggcagattgcctgagctcaggagttcaagaccagcctgggcaacatggcaaaaccccatctccaccaaaaaaaaaaaaaaaaaaaaaaatacaaaaaatgagcctgtcatggtggcgcatgtttgtgacctcagctactcagcaggctaaggcaggagaatctcttgaacccaggaggcagaggttgcagtaagccgagatcgtgccactgcactctagcctggacaacagagtgaaaccctgtgggaaaaaaaaaaaaagaattctagtctcatccaactaggaatttgacctataggtcctatgagctcctcatttctgaaggaagccaggacgttaagctctggcctgactccctgagtgtccctggatctgccccggcgaagacacggttagcagacaggaggcacaactcttcctctgctgcatccttacttcacacttcactttctgtccagtgaaacctgtttttcagttgtggaacctatgaagcagaaagtccctccacggttttttttttttaaacctgtaaaaaatgagatttatttcacagaccataaaatctacttttaaactgtacaattcagtggtttagactattttgcaaaattgtgcaaccatcactactaattccagaacattttcatcacccaaaaagaaaccttatacccattagaagtcactcgcagctgggcatggtggctcatgtctataatcctagcactttgggaggctgaggtgggtggatcgcctgaggtcaggagttctagactagcctggccaacatggcgaaaccccatctctactaaaaatacaaaaattagccggatgtggtggcgggtgcctgtaatccgaggtactcaggaggctgaggcaggagaatcgcttgaaaccaggaggcagaggttgcagtgagctgagatcttgccactgcactccagcctaggtgacagagcaagaccccatctcaaaaacagaaaaaaaaaagtcactccctctcgccacttcctccagctcctggtaatcacttatctgctttttgtctctatagatttgcccattgtggacatttcacagaaacagaatcatacaatatgtgactttttgtgtctggcttctttcagttaaaatgaggttttctggtttcatccacgtggcagcatgtgtcagcactggattccttgttatggctggggcataacccatgcagtctcatccattcattcaccgagcgcactgggcggctcccgccttctgtctgttataaatagtgctgcaatgcccctgcctcagagaaagttcttttcctgctctttcctgcattcctccctgccatcccctcagcattctccaggatgctatctgttaccatttagtgacatgccttcttgtggactttttgaggtatagggagtgcccttgtcataatctagtgattttgtttgcacggaatctcacattgtagatttcctgagtctgagctcagcacagagagggtttgacattgccacctagtggcctgtcgtggtaataccgtagcagggctgcaaaccccagcgcttcccccacagatgagaagattcgacagcctttgggaacggcctagctcattccctgctcctggtttgtgcattcaacagttgttgacggtttgattaataatgtgatttcattgataaggttaaatagtagttagaatattaaacaacaaacactgaatccttccacctggctcgagtggtcaaaagaggcagctccgtttccttcccgagtttcttgattaatctttcctctttgaaccatttcttcctttgcccatttttggggtgttgtttttctgtttgcctagaatttcaggacagcaaataattatacaacttaatcacagaagtaggatgttaagagaaatttcgggggtttcacttgctgataaccgcagacgtggatgtcaggaggtgttggctgcatggcttggtccctggctcttcaccacttcctagcaaggggcctggaagtttgcttagaggttggtttgaaatgcagctaaaagtcacattaatccaagactatgccagattcctctgagagaaagagagagggaagaactgattgtgaagatggtcacgacaacagtcatctactgagccaaccaagggcagctgtggtctccctggggtccacaggctctgagagggacaatggatctgttcaccttggtggcccagaagccgggaagtgagtccatgacccaggccttgagccatcgcacctgtgaggacaaaccctggaagtacccataggaggtttgcactgaggatgattgaagctcattataagattgtttgcctttctgagtgctttgaccatgatgggttagcatggaatcaatcatatagcgtgtggtgtgtgactgtgtccaaagagacagagtagaaagcagggcgttcgggggcaggaaccccctgtcctaatggggaagttggaaatgctcacaggaagcagtctggggagaggtagggaggaagaatgaaaggggacatgttctgcagtgccaggagcaaaagagctgttccagagaaggcagcgggaagtggtctccctccccacgaccctgcactcagccccctgccctcggtggctgcaaaccaggagtattaggttctagaagcccttgtgagcccccagcaaattttaagccccatgaggtagggtctctgcctgtgcccccaagtcccaccctcgccccacaggcatctttctgaagccgtttactggtttggggggggaaacaagggctcttctcatatcacagacactcccaggcgtttgtgctgggcttgaaaacacagcagacaggaaaggggcccagaaccaacctgtggcttttactttgtgccacgggccagccctgctgctgggcagactggcaggaggaaccgccttgagacgggcatctgtttcctctcagcgtggggacctcctcacatggcctctttccccgcaggtgcggggctccctgccagccaccatgtgtcagcacatggacgctggtggggtcaggatggaagtcgtcagcgtcaccaacggcagcatcgtggtggagtttcacttgctgataatcgcagatgtggatgtccaggaggtgtcagctgcatttctcaccgccttccagaccgtgcctctgctggaggtgatcagaggcgacaccttcatacagggtacgagaggctgggatggagcctctcccgtgttctggaaccagaggcagccagagggcagccaccacccttcgcttttgaaagatgtcgtgttgtgcccatgtggtccttcttcccccagaattagatgaagatgtgaaatagataggaccctgtctgtccctcttattgtgattataattgtgtaaaggttgaagtgttgaaaacatctttgggtgaacctgcagatccccaggggtgctgctttctttccgggtcgactgccccctcgctgcttgtttccatgggctgagggcagatgcatccctctctgcagccagactctcccccaagcatagttcccaaggagatcccagtaaagataattaacgagaaaagcagggagaaaaagacaattcagattcttttctcctatcatacttgaacataaatgatgaatggcttatagttacatgtatcagaaacaaaagactttttaaaaattggagattcatattaattttttgatttttagaataagaaggacttcctaaagaaaatacgatttttagaggaaaacgatgagatgctgactgcatgcagagataaatcaaaataaaggcaccattttaacgcaaagtaaacaaaaaatttttcaataatttggtgaagtgttagtatcccaaatatatagagagatcatacaaatagataaatattaagaacctgatggataaatgcacgaaagctctacacagacaaggtataaaagaagaaatatgaatgactaacaaagatgtggtaacccaagacatccccattagaatgcattgcactgtttgcccatcaaattgcaaacaaaaggtctctttactgctgacatgaatactggtgaaagtgtagtgaggcaggtgtttgcacagattgctggtggcagaaggatttgctcatgcttcctggaaaccagtttggtgacataaatcaaacgctttcaaagtggccatccacttggattctgaaatatcagctctacgactttgtcctaaggaatttgatctgtttggaccgtagtttaaatacaaagatgttcatcttcagtgttactttaaaagccaaagagttggaaatcaccaatcatccagtaacaaagaaggtgctaagttaccaggtgtccccgccccgggctgttatgcaatgatgagaatagcggtttgtggatttgcatggagctagttggtggcagaggcaagctatgctctcagagcatgcctgcattttaaaaggctggaaggaaatacgtccacatgctaacttgcccctggccacgcttttctggttcttatccatgttctgcagtaaacctgttttgctgtcaacaatcaacccagcatcatggcgaaaggcaaatggcctgagggccttctgcccagggttgggcttgcagcctgggtcccttgggctggaccgaggtggatctgggggcctgtgcatctcctggttactcccgggaactgaagggatggccctgctctgcccagatccccctcccagccctgggccagaatcctccttccagaacagcccctgcagacatacttagccattcccagccccagcttcaggaagcctcctgtactttccagaactggtgagcttgactgcagtctgctgtggctggagtttccagctttgtctgtgagatgcactctcccccaaccaggctgctgtgagaccacaagcccccagggatgttcttctgttttgtcttctaaatgttgtgcagattacgatgagtgtgaaaggaaggaggacgactgtgtgccggggacatcctgtcgaaacaccctcgggtctttcacttgtagctgcgagggaggagcccccgacttccctgtggaatattctgagagaccctgtgaaggtaatgtcgtcagagtttcttcttctggaatactgtatcataatcggttttttttaaggacattcacgtgcaaagggcttcttgtccctctgaggtcatatttttatgtcctggggaagtttcctgtgtgtgatgtgggtgcacgtgtgtgtgtgtgtgtgtgatgtatgtgtacatgtgtgtacgtgtgtgcatgttccttcccattctttcatatgtgtccaggcttctgggcagtgccttatctctccaagtgctagctctgatatccatggagagaaaatatacacatacatgaggtgtgaacgtgcagatgctgagcgaccgtcttgtgaaacacgcagccgtgggacacgcgacacaggggaatgtttcctcttggccactctttccacccagctcttttcctgctaaacggggtcttagtggatttaacactgaccccacgttggccactgctatccaggaatctgcgtcaagtgaagggaggtgggcatttataccagtgagtgtggtatccggggggctatagaacgtgtcctgcttgaggtagaatcaggaagcacagaggaggctaagttgcttcagtccagtgagtgtggccagggagggcttcctggaagtggtgtcttgaagctggtcttaatggatagctaagatggcacccagcagggagggcagggcatggtgggtgggtgccgtggtgagaacagagctggtgatgggcgtgatctcacatgcagggacctgcaggagatgggtggcagagagcgagaagcaggctgcccagggaggcgggtgaggcagcagccaactgtgaagtcctcagcaatggtttggactatggcccagagacaggagtgagctgggtggagctgcagggtgctggggctgggcaagccccactctgagataaaagaaggcacaaaccaggcccacagatgatggagccactgctgaaggagggtggagggcacgtgcggagctgtgtctggggtctgcttccatatagaccaccccgagaacaggtgggtggattggaaagctttccgggccccttgttctcctaggcattgaaactgaacctgctctgggggcaagaagggagctggagtgggaagtttgggcacaaggacctcaagaggaggcatcattaccccatcttagagaatagactcagggctctcagggcagaagactcaccctgtatccactggcttggcacatccccggcatcaggtccctcggtccttggccctcgggggcccatggtgagcctggatccctgagctggtggaaatgtgcaacatgtgcatgtgtgcgtgtgtgtgtgtctgcacgtgtgtgcgtgcgtgtgtgcatgtgtgtgcatgtgtgtgcatctctgcgtgcatgtgtgtgcatgcacgtgtgtgtacgtgtgtgtgcatatgtgtgcgtgtgtgtgtgtgtgtgtgcacgtgtgtagttgtggctggaacatgcggttcccaggtgtggctgctgcagagtgcagggcagctccagtctgctccttacccctgcccctccatgccaaccccaaacacagagccactctttgccttttcctccttgtgccttgcaggtgactctcctggcaatgaaacctgggccaccagcccagagaggcctctcaccacagcagggaccaaggctgcctttgtgcaaggcaccagccccaccccccaaggcctgccccagcggctgaacctgaccggagcagtcagggtgctctgtgagatcgagaaggtggttgtcgccatccagaagcgcttcctgcagcaggaatccatccccgagtcctcgttgtacctcagccacccctcctgcaacgtgagccacagcaatggcacacacgtgctcctggaggccggctggagcgagtgtgggaccctcatgcagagcgtaagaccaggagagccaggctcaggatgtacactagggcgcaaggggctctaggttacatgggcctcgatgtgggagggccaggcaagactctgcaccccgaggggaacccagcaaggggggttcaggacagggttgagttctcaaccagggaccagcctgcaccccagaatcggaagggagctgtgagtccacccaggagggactctggtgcagagtgctggggcaggcttcagagtcacggcttaaaactcctccctgcacagacaggatgagaggcagtgggacaggaagaggcaggaaagccaaggagtcctgtgtgatatgagagtgtgtgtgtgtgagtgtacgtgtgtgcatgtgtgcatgtgtctgaatatgtctgtgtatgtgggggtgtgcatgtgtgtgaatgtgtgtaaatgtgtgaatctgtgtgtgcgaatgtgtatgtgtatatgcatggctgtgcttatatgtacgtgcgtgtgtgtgtgcatgtgtatcgcgtgcttgtgtgcgtgtgggtgtgcatgcatgtatgaatgtgtgagtgtgtgaatgtgagaatgtgtctatgtgcatgtgtgcatgtgtgcgtgagttgagcatgtgtggatgcgtttgtccatgtgtgagtgtgtatgtatgggtgtgtgtttggggggcattggatggcattagtcagaactgctctgtcggagggactgtgttcctagcgaacattctctatttcagggtcctggatgggctgtggggctcccgggacagagggagcccaggtggggaaagtgggttttcctggcctgaggccttcgcacctctgtgtgcacagatgggctctggcacctccccttgcaggtgactctgggccagtgcgtcctgggtctactctgagcctctagtgtgtggcacccatgaggtagctgacctggctccaggtcctgcttcttcccagggtgcctctgtgtcacagcgaacgctcccatgcaggcccttgttcgtctccaaccccacttggccacatggagcacaaaggcttcgtgttcagggccctgcttgggggacaagaggaggggagagccagcaccttccaccagctcagcctggtactggacacaggggcctgggccgcatgggcctgggagtgcagggtggatcagggaagctgcctggaggggccggcggcttcagagggagcccgtgccggctctgggttggggaagtggccttctgggaaggggctcgacctagaaaggaggccagcgtcgttccaagggtgagtgagagagctgtgaatgtatccaagggccatgccgggggtggctagatgagggaggctggaaaccatggcggagttaagagtctgtccgagtggttctggtcaggtgggcagggatggaagggtggacactcatgggcagggtggggtatgaggcctggtgggaaagtggggctgtggatggggctgagcagggagcagtgcctggcctaggagccagggccagaaggctctcctaatggggacattgtcctcatcgggagctaggcaggaatggtggttcctggtcgttggcgggaactctgggccctgggcttctgtccctcaggacctttgagcagtccaaggcattgcattctaaaaaaagggattggttggggtggtgccctgaaaccaccgtggacctgcttggctgagagttctacatgcatgatgatgtttagtcccttagcgaccgcatgggtcaggcatcatcatccacgctctgcggctgagccctgggtgctcggcagggtccatgggagttcagggtcaaagtcaacctgacaccgagaagcagccccgtccctgtggctctgcctcttgaggagccttgagggggtgctgcttctggttgggggtctggacacactccttagtggggacagggcggcctctggcactggatgggtcaaagctgtcagatgaaacccagagtcctggcatggggtgtcaatgtctgggagccgacaaagtgggaaccgggtggacgtcctgagcaggaggctgggacatggaccttggggctgagtaaggagctagccctggggagcagaggccagaaagccccaggggctgagggatgaggtggggaggtggggcataaggtgattccatggtgtggagcctgcttggagcctggagctgggactgagggtggccaggaagctgagggattcacgtggacgcgtcggaggccattgcagagcacaagcttgcctgggaggcacagctcactctgccgagctcattccgccccctcgggggctcttcagatcctccctgggctgaaggagtaacctgcactgtttcaacagctacaaaaccttcctcacccttcagcccctcaaatggcacaacttaagcagaactgcccagaattagttttctccctcaaagcttcttagacggccacctggaggccgagcgttggcagcaggggggtgtctgcaagggggatgggcggtgatcagtggctcctgtggcttctcggcagtttccctggtgagggaggtctggggtgagaggtgcatgtgggccgggccacagcggcatcctcaagcctatgcagggctcttgcagggctgcggggccaagtggaggggctgagggtgcaggacagcctgcctggtgctcagatcgccacccacacagcggcagctccagtggagagacagcgcctcccaggactggggccctgggcagagcctgcagccggcagctccctctgtgtttttctgaaccagaccaatgcttggcttgattattaaatgcagcagggtttggggcatgttgaaagaaaagggaatttgtctctgatgactcacccagtccctgaaatccacaagagctcttgacggtttttgacacttgtcaaaaactaagtttcccagaaagacttatttgtgcagctgccacggaatccccacaggttcaggtgctgcctcctctggtcaatagggaatgagcagaggccgagcccttaggctcttaggcagtttatggttgggagaatcgccaggatctcgatgctgctggggagaggctttagagaagaacccccatccccccagcacctagagccgtggcccacagcagggcgtggggggccggctggggcctgggagctcctcatgctccgctttgtgctcagaacatgacgaacaccgtggtgaggaccacgctgaggaacgacctgtcccaggagggcatcatccaccacctgaagatcctgagccccatctactgcgccttccagaatgacctgctgacatcctccggcttcaccctggagtgggggtaagggagaaatgccccggctgccccacagccacgtgcctccagaccacctgcgctttgagagttctttagggtgtcaaccacttaaggacccttccttgagatggaatatacaaatgggtgtggcctggctgctccccaaattttgttccctcttcccactcagggctagccagagaaggccaaatatgtcccgtggccaatcccatgggatggccccacttccagtgagccactggcaggccgccacccaagcctccatcaggcaccactttttctataatggaccccccaccttccactgagtctccacctatacaactgagggaggcaacccctggaccagccagccctgaataaatggcctccaagtgctctcgtttggggttgagggggtcttctcgttcatttgcacgttcctctggagctgtgttttaggggagaagtgggaatgggaggggccacgataatgcgcctcctgaaacatgcctcctgcaagctgcttcctcttgcagggtttacaccatcatcgaggacctccacggcgctgggaattttgttaccgaaatgcagttgtttatcggagactctcccatacctcagaattatagcgtgtctgccagtgacgatgtcaggatcgaagtggggctctacaggcagaaaagcaacctcaaggtggtcctgacggagtgctgggcaaccccgtctagcaacgcccgggaccccatcaccttcagcttcattaacaacaggtagggctcaggagtgcaggcacccccatccagcaatgcctggggctttattaacaataggtagggctcaagaatgcagacatccccatccagcaatgcccagggcttcattaacaataggtagggctcaggagtgcaggcacccctgtccagcaatgcccagggcttcattaagaacaggtagggctcaagcaggcactgccattgcctggccttgctgtgtggccagctctgggctctgcaggatttccaggcgagtgctgtcatggacctgggttttggggaacaaatgaggtgcccggtcctcgacttccacggagcctgtggaatctgcgagtgtcgtcagatgtagtcgtgagtaaactcatctgagaacaaggacagcggggctcgctgacaagcaaggagtcccatttcctctcttctcagctgccctgtgcccaacacatacaccaacgtgattgagaacggcaactccaataaggcccagttcaagctgaggatcttttcctttatcaacgactccatcgtctacctgcactgcaaactccgcgtctgcatggaatcccccggagccacgtgcaaaatcgtaagtgttttttggttttctaaacgtttggttggattcacgttccttattgttacggttcgaggctctgttaataaaaacctagggctcgagtggctcggggccaacctctgggaggagtcgctgtgcctgtcctgcagactccgcgtctgaaatggtatttccacggcaggcagcccttggacggaggactcatgtggactggtgggcatttcccatttctcaatggctgagctgagttccttcttgaggccataatattcaaccggctgtcgcgtcagcactgccttgccatgatacctagtgcttctaaggtgatttataggtgtaaaaatattttttaaatattatttttaacaacattgatggaacatactaaatatcagacactctgttatttaataaagttttttcccctttcctttgttcaacaatcatgcagggataattttacattcctgttttccttagatttttgaatttgaaatatgctttgtaatcctgaggtttgaaaactgtgctttatatcacagacaagtacatgaggttcccacatgttggtcgcctgttgtctgaggcaggggacagcttagggagctccgctgctttttgctcagtgaccgaatgcttctctctcctcggaggtagtgcttgttcctgctctcatctgagctgttttcctgggtgaccaagctctgagcgtctgcaggacgtggatagagaagcaacacaaggaaggctgattctgttcatgtctgttttgctcaaacactagatcttcctgagcaatgggacagaaggaacctcaggtcctaatgacagcaggctgagggccacacacgaggagcctgcccctggttccactggagcctcagagatgacaggagcacggacagccaccgccaggcttcgtctctgcagggagcggctggctctcaagttctctacaagagaattctttacaagaggagcggcacacagtgtgtttttcaagctcctttaggatggatagatagtgtatgagctttccgggctgctgtaggaacgtaccacaaactgagcggcttaaacagtggaaacttattgtctctgttctggaggcaggaagtccaagatggaggtgtcagccggctggttccctctgagagttctaaaggaaggatctgtcccaggcctctctcccagcttctggtggcctcgggcgttccttggctggtagacggcatttgccctgtctctcggtgttgccttccctcagtacacatctatgtttgtgtccaaatttcccctttacagagggacaccagccatagtggattagggcccaccctgatgacctcagcttgatgatctgtttccaagtaaggtcacatgcacaggtgctgggatttaggacttcaatccctttttggaggacatgttgcagcccatctcaggcatctagtgagcagatcccaccatgtcactgagccaggcagtcttttttgtaaggcaaaggtgtaaaggggaacaaatggctgcagcaacctttggagaacacagagggactctgagggctgtgaccaagacacagtcctcaagggacccaaggaagcagctctagcaaccaaaagcagctcaaggggtcttctccagcctgctgctcttgcagacctcacttccttccccgctgacgcctgggcctgcctcttgttgcaccaggacccaccaccctggtctcaccaggtctcccactcctctgtctaaactcagcccccttgccttgcaacttctagcaggataaaatcgcatacatcacattagcatccttgatagtagctcctttctcataaatgttgttcaattaatttgacgtttctcttcttggaaaaaaaaaaacagaattgcaataactttcggttgctgcaaaatagtgaaacctctgccacacaccagatgtcctggggacccctcatccggtctgaaggtgagttgatgacttggtttagacaatgaaagaaaagatgcaaccgattccttttcaccagcatgtaaataaaaaagtaactgttgtgaaatgcagaactcttgagagacttctaagaggcttatcataacagaaatactcatagttagtattcactgagagctgctacgtgtcagcctggcactaagttctttacatgcagaatgtaatatgctcctctcagcaaccctatggagcatgagctattaccatacccatgctacagatgaaaagactgaggcttcaagaggccaggcacaaagttacataatgaaatgttttgagctgcataatatcaagctggtgaagttttctgacactgggtaaatacatccagtgggctgttaagagataagaactcaagctataatcaggccatgtcaacgtgtgtgtgtgtgtgtgtgtgtgtgcgtgcacacgaatgtgcatgcacaaggaaaagctattttattcaaaagatgcaaaaaatggcatatctgttccccctcagtttaaaacttccattagccaattacattgcatgtattttcaaaaccccacatcaactttccagaaaaacattttattttctatatggtccatcatcttattttgaaaaaaaaatacattggtttggggaaaattgtgtgctttgggtattaagagagaaaccgctagttgtcccgtagtatctgttctcctcccctttcatagaaatagcgtccccaggttttgctggtacatggctgccaggaataaaaactgtaattccaacctcctggcagctaagtgtggccatgtaagttctgaccaatgacacgtaagtggaaaagtcatgtgacaacttttagaggtgcaccctccttaaaagacgtctgtgcctaccctctgcctctttcttctttagggctgtggggcccagtccttggagggatctggcttcccaggacaccatgggcaagtggccaaggcaggcctgggttctgacctccacttttttttttttttttttgagacggagtttttctctgtcgcccaggctggagtgcagtggtgcgatctcagctcactgcaagctctgcctcctgggttcacaccattctcctgcttcctactcagtcccgagtaacagggactatgggcacccaccgccacgcccggctaattttttgtatctttagtagagacggagtttcactgtgttagccaggatggtctcgatctcctgacctcatgatttgcccacctcggcctcccaaagtgctaggattacaggcatgagccactgctcccggactgactcccacttttatgacagaaggaaagaaacttccatgtcctttaagccactgctattttgatttttttctcttgcttgctgctgagcctaatcctagttggttttcctttttttgttgtttttttccctaatcttgatgaccctctcccttctctgtctttccctgtatgagaacttctggggtttggatgcagggtgtgagccagaatctgaatgctgctcaggtcttggccatgaagctggggaacaggaggagggaggtctcggccatgaagctggggaacaggaggagggaggtctcggccatgaagctggggaacaggaggagggaggtctcagccatgaagctggggaacaggaggagggaggtctcagccatgaagctggggaacaggaggagggaggtctcggccatgaagctggggaacaggaggagggaggtctcggccatgaagctggggagcaggaggagggaggtctcggccatgaagctggggaacaggaggagggaggtcttggccatgaagctggggaacaggagggaggtcttggccagtgactcaactgctggttctcatttaaagcatttgggaaactaaaaaagtagacacaggtcccaggccacaccccaggcctacacacagaatctctagagttgggtcccaggcccctgagctggtcatcaggtgactgttggtcaaggtgctgggacaacctgcttctcctcactcttcattttcttaatttcctgggaagaacgggtcagcctatttctttcaccctataagaaatagcatatgtgtgaaatatgttctcattaatagataatgtgttctttcatgaatagaaattaaacttcctccttcattcattgatatcatagggaatgtcatgactagggggtgaaaagcactagacttggacttgggacacctgaatttgattataggctctgacacttatgagctgtatggttcatccatcatccacccatacatctatctcatctttccatctatcatttttccgtccatccatccatctacccattcattcatctatccatctatcatccatccatccattcatccctccactcatctatcatccatccatccatctatccattggtcatccatctatccacccattcattcatctattcatctatcatccatccatccatgcactcatctatcatccatccatccatgtatccattgttcatccatccatccacccattccttcatccatctatcaaccatccatcatccatccatccactcatccaaccatacattcatctgtcatccatccatccattcaactatcatccatctatccaccatcatccatctatcatcatccattcgtccatctatcattcatccttctgtcatcccttcattcatccatccatccatctattcatccatccatcctccatcatccatccatctgttcattaatccatccacccacccatccatccatctatccatccacccatttattcattaattcattcatctactatgtttcagatactctgatttttctttgcaacatgccctccctacctcataaggttgttgtgagtgtctaatggtaactaagaattctttgtgaggctaagatttgtgaggttgaaactaggctccctggattcacaacttggctctggcacttaataattttgtggctttgtgcatgctgcatatgaattgtgccttattttcctcatctttgaaaagggaataataataattcctacttcataaagagcctggcccatagaagttattgaataagtgctacttttcacttgtaaccagtagagcactacactggcataaccaaagcaggaagcacggaatgtaataagggtgtaatttctcacgttcaagaacaaggactgtaaatattcatgttgttcaacattctttctcattgtgttagtagcttttgtttgatctatgactatcatacaaatacacagcaaaatcatttagacacatggaatctcccagttggtggggacttggctgcattttaatagtgtatattaacagaaacactgttggagactgcagagatgagaggaggctggcagacaggttcctcaggacctcaccgctatccgcggcctctgagatcccacgctctgtccctgccatcaccatcacctccgtttcagggaagaaatgagaacaactcagagattttagggaatgtgcctaagctcacacagctggtacctgcacgagctgggcctgcgagtgcagatccaggctgctcataacccactctcctctctctgtctcctggggactgagctggcttcattttgaggcttccctccaccccagccctcacatcacactcacgatgtcttggcaccaccacaacaaagtcccacagcctgggtggcttgaacaacagaaatctgttctctctcagttctggaggccagaagtccaaaatcaaggtgctggcaaagccacagtctctcgcaacattgtagggccaagtcctcccttgccgcttcctcgtttctgctggatgtgcccaatctttggtggaccttggcttgcagctgcctccctccagtctctgcccccgtctgcacatggccttctttttataaggacaccagtcatgttggactaggggcctatctacctgcttaactagttgcacctgcaacagttccatttccaaataaggccatgccccacagtactaagggttaggatttcaatatatctgttttttgttttgttttgttttgttttgttttgtttcgttttgttttgtttgagacagagtctcactctattgccaggctggagtgcagtggcatgatctcggctcactgcaacatctgcctcctaggttcaagcgattctcctgtctcggcctctagagtagctggggctgcaggtgttgtgggccaccacgccaagctaatttttgtattttcagtagagatggagtttcaccatgttggccaggatggtctcgatctcctgacctcatgatctacccacctcagcctcccaaagtgtcaacatatctgtttttgcagggggtgaggggttcacagttcaacacataggtaaccctgtatattgacaatttaagaaagaatccattcgggcatcttccctgaatgtctgccaccaacaaatagtacatcagcatgataatttttgcatattcagttttcggaactcctccatggcctttcttttcctagctggcccacttatttcacattcatgagcatgtccctgtgctaaaaggccaagaaatttcgaggatagtgtccagggagtgctcaatgtcccagcaggaagggcctggagcaattactgtagctgctcagcagtgaggagactgaggcggtggctgagctggaactcaaacccctggaagggccctgtttcctctgaacgcgggttcttttttaattttttaatttttaaaattagttaattaatttatttatttttgagacagagtctcgctctgttgcccaggctggagtgcagtggtgcgatctcggctcactgcagcttctgcctcctgggttcaagtgattctcctgcctcagcctcctgagtagctgggactacaggcgcgcactaccaagtctggctattttttttttttttatatttttttagtagagacgggggttttaccatgttggccaggatggtcttgatctcctgaccttgtgatccgcccgcctcagcctcccaaggttctgggattataggcgtgagccaccttgcctggcaattttttattttactttaagttctgggatacatgtgcagaacgtgcaggttgttacataggtgtacatgtgccacggtggtttgctgcacccatcaacccatcatctaggttttaagcctcacatgccttcttccctttccctcactgggttatatccccctttacaaaagcagccattgctgaatttcagccgtcatttaaatttcccccgcatcgtggactgacatgtggtccaacggtcacgatgcatacacagctcatgccacacgcatggagcctccctgaacagggagatagatgccctgtttggcaggatgcctcaccagtggctgtgggaaattaccatccacagttttcagggcttgctctccacttctagctaatctggccatggggagtaaccattcctggactttggtgtcagtcagtgggcagcactggcctgtggaccccctgtggccagccctgagctagtggttcagttcggagcacacagctgcaggtcacagaaacctagctggagaggtggcaactgaacagggatgggtctttcccagggctgagagtccagggccattccgggctgcaaagggccagcaggagcgggtctccttggtctttctactctgcatcctcagggcggcacccccccttgtgctggcaaggtggcccgtcactcgaggcccaggaggaaggtccactacagagcccctgggggctggatttagtgtccatcgtgatttaggagttgtctggggaagtggccggccgggatctgggggcctcggtttcttggggagggtggagtcactttggctggagggtgggaggtgttccctgtccctctctctggaggagggatggtgtggttctagctggcttatgttcagcaccccagggatccgacagtgccattgttggatggctttgctgatggtgacgctccatgctgttccctgggggacacacagcagcgtccactctgggcagactgcccggaaatcaatacagggaatgaaaatgggatctcagatgctcctggttgcacagaaaggctgtttccaatgcagaccttcctgatatgtggggatgaacaccctgagatggaggggactgggtggtgcaggatgtggctgtgacctggctatagacgcccttgacaacgaattatacccacacacggtgggcagagggtcacatctccccctgggctcataggggccagccagagagccagcaggcagctggcatctttctcaggcagcacagtttttaaaaaattaaactgagatgaaattcacgtaacctcaagctaactgtgttagagtaaacgactcagtggtgtttagtacattgagagtgttttatagccaccaactccatgtagtttcaaaacattttcctcaccctaaatgcaacttcatacgcatgagtccctccccatccaccttccccctgtctctgaaagtcactcgtttgctttctgttcagttccgggtagttcctatgaacagggtcatgttattggtgcctcttgggcctggcttccttcactcagtgctttcactcagcgtgacatcttcaaggttcatttacgttgcagtgggtcagcgctttactcctttcacggttgggtcatgttccattgcacggtggggccacaatgtatggattcattcacctgttggtggacacttcagttgttgccaccctttggctggtgctgtgaacaggggtgtacaaatagctgtttgaatcagttttcacatcttttagggtccgcactctgtttttctttttttttgtttcttgtttttttgttttgttttgttttgttttttctttcttttttgagaccgagtcttgctctgtaaccagtctggagtacagtggcacgatctcagctcactgtaacctccgcctcctgtgttcaagtgattctcctgcctcagcctcccgagtagctgggactacagacatgcgccaccatgcccggctaatttttgtatttttagtagagacggggtttcaccatgtgggccaggatggtctcaatctcttgaccttgtgacccgcccgcctcagccccgcaaagtgctgagattacagtcgtcagccactgcgcccagcctgcactctctattttttaattgctcctctgggtctggggatggctcattcctctgtgttgtggagcctgtgtaggcccaacccgtgtgtccatgcagggaatctgactgggctctccccctcccaccaggaggacctgctggtcccgcgcagccccaccctcaaggcccaggcctccccaggctgcgctgtccttactgcaatgctgtcctgggcttggacaccttcctcagctttggtaacccacaggcacacgggtgcacacgtgggccttgcattccccgtgcttcagatccatcagccccggatccgggtggagggcttgctctatcgcattcctcccgtttgtgcagatctctcacctgtgcctgtctcctccccgaggtgagcctcctcatgcagaagcaggcctgggtgccggttatgtggtccttattgtggtggccatcttcgtgctggtggcgggaacagccacccttctgatcgtgcgctaccagagaatgaatgggagatacaactttaaaatccagtccaacaacttcagctaccaggtgttctacgaataggaggcgcaggctgacaggaaggtgggtgcggagtggggtgggaggtgcaggctgacaggaaggtgggtgtggagtggggtgggaggtgcaggctgacaggagggtgggtgcggagtggggtgggaggtgtaggctgacaggaaggtgggtgtggagtggggtaggaggtgcaggctgataagaaggtgggtgcggagtgggggcatctgatgtgcatgtcctgccttgccatccatggtgatggggacggccagcaggattcagccaagggtagatatgtgtgtgtctgtgttttgtggccctttacggagcgtgcagcctcccttctgaaaaagcaaccaggagcaggcagagaggggaaactacaggtaggttggtgaaggttcgatcgcttcacacacccactggactggctccacgataccagcggcagtgctatatgggtgaccacaggacccaggggcccaccacaaatcccatctctgccacccactctcttgaccacccgggcaaggtcctgagcctcttggtgcctcggtttcatcatttgtaaaagaaaccatggtaacatttccggccacgtggagggtgtgagatttaaatgggaagatgcccaagaggccccgctatggggtctgacgccctcaattgctggtggatcctaacgatggtcctcggccgagtgtccctgaaacctggtgctcgtagggattgtcacgtgtggtgtggatgccacagtggaccccccacaccttgctgctcatgcccgcagccccgacttatgtatgaccttttgaggctgaagatgcttctctgatctgccctgtggacttttgtttttcctgggcctgcacatagttcaccacaaatgaatgacaagcattatggagggcagtatggttagtataaaccttcagtgggaaacaccaagactgggacttttgtaaagattttcagattttttttttttttgagatggagttttgctcttgttgcccaggttggagtgcagtggtgcgatcttggctcaccacaacctccacctcccaggttaaagcgattctcctgtctcagcctcctgagtagctgggattacaggcatgcgccaccacacccagctagttttgtatttttagtagatacagggtttctccatgttggtcaggctggtctccaactcctgacctcaggtgatccacccgtctcggcctctcaaagtgctgggattacaggcgtgagccaccgtgcccggccaaattttgagatttttctaaaaaaagaacatgcctgtaatcctagcacttttggaggccaaggcaggaggatcgcttaagcttaggagttccagaccagcctgggcaagatagaaagactccatctctacaaaaaatacaaaaataagccgggtgtggtggcacacacctgtggtcccagctacttgggaggctgaggtggaaggatcccttgagctcgagaggtggaggttgcagtgagccgagactgccccactacactccagaggggaaccctgcctcaaaaataaataaatactaataaaagaagaagagaagcaatcatgaggcttatctggcagcgtgtgagactgctgactccaaatgctgtaagggaagcatgcggcttcggcttctggggaggcctcaggaaacttacaatcatggcagaagaccaaggggaagcaggcacgtcttccatggctggagcaggaggaaggggttggggcaggtgctacagatgtttaatcaaccagatcttatgagagctctatcgtgagacagcaccaagaggatggtgctaaatcatttatgaaggatccgccccatgatccaaccacctcccaccaggccccacctttaatatggggatcacattgaacatgaaatttgggtggggacacagacccacaccatatcaactgcccaccctctcagccaacaggagaacaaggaaagacgagaggccaattttccctcgatgttttaatttcaaggagggggacatccagcatgacccagcaccgacccaccagatgtccttagaaagctagtgggatagtgttggcctcatcgctgggattcgcatcttaaatattaagtaaaaggcactgacatttcctcgtaactctatctagggaggtgactggtctctagcactggtcccgtctatgctgtaagggtcctgagaccccagaatactgcgcatgttagttaccaggagtcctggcaggagagacgggaaagacaaagctaacacaagcgtccccctcacatgggcagaatcacttccacaagcgggtggcgttttctttgaagttgcccagcaagggcagcatggaggttgccttttggaaacgtgtgctgtagtctgggctttgctggtgacctgggaggattggcttgagttctctgggccccatttcctcattttaagattggagccagtgtctactacactttgctgagttgtttcaaaaatctgttatctcaagaaaataaggacctgagcacaggaaagatgggctgggctggagaagctgcctgcccgacgaagagggggtgggctgatgttgacaatgtctgttgtttcccaacatccccgtgaggttgtgctgttattagcatcctgtgttatagatgggaatccagggcagaaagggatagacgtcccaggtcacgtggctaggaggtccagggcaagaagggataggtgtcccaggtcacgtggctaggaggtccagggcaggaagggatgtgtcccaggtcacgtggttgggaggtccagggcaggaagggataggcctcccaggtcacatggctgggaggtggccgagctggggctgcatgggatttccgtttggctctggggtcagctctcttagctaccaagcttagagcctttcttacactagtgttcacatgactgatggacccttagaacaatgccccttgcctttccccttcatcagagacccggagaatttgtattttagcagctgtgcaaggggatccacaattcttaattcttgcagtggggacaccaggtgtcccagttgagaggcagcaactgttgtggttacagggaaggagccttcccaggacccctgagcctccccgggaggcaggtgctgctgctcaattgtggtctgggtcctcagccacctccggggatcccaaaggggcagggaacaacagcgaagtttcagttcaactttacactctaatagtgaaaaataaggaagcttcctcagtttggtagcttttggcctctggtttggggcccatggggtttgggccatgaagaccccctcctcaccaaccccattgcctcccatcctgggcaggagacattgtcaataccagcccgccccctcttcgtcaggcaggcagcttccccagccaagcccgtcttccctgtgctcaggtccttattttcttgagataacagatttttgaaacaactcagcaaagtatagtagacactggctccaatcttaaaatgaggaaatggggcccagagaactcaagccaatcctcccaggtcaccagcaaagcccagactacagcacacgtttccaaaaggcaacctccatgctgcccttgctgggcaacttcagagaaaacaccacccgcctgtggatgtgattctgcccatgtgagggggatgcttgtgttagctttgtctttcccgtctctcctgccaggactcctggtaactaacatacgcagtattctggggtctcaggacccttacagcatagacagggccagtgctagaggccagtcacctccctagatagagttacgaggaaatgtcagtgccttttacttaatatttaagatgcgaatcccagcgatgaggccaacactatcccgctagctttctaaggaaatctggtgtattggtgctgggtcatgctggatgtccccttcctcgaaattaaaacatccgagggaaaactggcctcttgtctttctttgttctcccggggctcctgtctttcgaagtgagaactgtctcaccagttctaaagttcctgcagacatctgctctttgaaaaccatcagccaacccacccacccccaccaggtcgacccttgggcagccccactcagagatgttcccagagtcctggtgggttctccacggatggtgcaaaggtgcaggggccccagctgtgctcgtctggctcaggtatcttcaccagccacccccaccagttggcgtgtcaggagcatcgctcacctgagggcaggcacagccccatggtccccgttccactgggcactctgggagtggctgccttttcattaggggcttgatctgtccctctccagtaaacatagacgccatgtcctcgggttggtgtttcctccactacccctcctcctggggttttctgtattaactttacctttcctgcgtgcaagctgacccaggtgacctcttcctccacacaggtcgccgtgagtcaagctgcctccagaacctcagagcttccctggtgggctcccccgggatccccagtgtctctctgcacctccacccatccctcggttcttaactcttcaagccttaacggaggtctgctctgacgggtgggctctgccagagcccgggtgagcccagaaaggaagacagcagccaccgtctgtcccgaagaggcaggccgtcctgtaggtcctagaggagccacagcccaggggcagatgaaggggctgcggaagacgggggcagtcctgggggtgctgcggctacaccaccacccgcgcggcccccgcagcctagacctcccaggcctgtgaccctccacaccagccctcagaaccctcctgggcttgccctcccttggcgtccgtcaccctttggcaaatatagaatatttcacattctcagagagacccgaccgcgctcttgatgctctttcgaaaataggtcagtcttagaaatacactgctaatgttatttttagtggatgtttatgctgtttgacttttctcctgtgtaccaaggtattgcttttatttacacgacagcgactcaaaaggcactcgattaatgtgacaaccttttcaataagcagaaataacgtaggtacacatcactctttacatttttctaagcattttcacagccgtttcttcatataatccgaccacagtgggaggtgtgatttacccattacacaatgagaaaccagaggagccgatgagttacttaattgaggtcacagaatgaattagcaagaaaatggttctaaaatctaagtattttagtctagaattttctccattacatcatcctaagagataatgctctgtacttcatttgaaataaactggaattgtattagatagctcacacctgaaagtagagtgtttttcctcagtgaacttagaattataacatggccttagttttcaacccatgatactaattttgttgaatataattaattgtcattcatacagaacatttggggaaaggagtattttgatttactggatattctcagagtcagtaaagaatgacagtgggtaatatgtgtggatcacagattctgatcaagtagaatcaatcgcataagacactgaaatgtggctggttgtgctggatgctccatttgggatggtccatcacaggctcgctgagcatccaacgagggccggtgctgtgttgggcacgctggggaggccagaaacgcatctctggttcttcccaagtcatgtcccgctgttctgatgtcagctgaggagctttcacttgcctttcttggaagagcatgacacatattcagtaaaaccagctgttgagccccatgactgtgtggctctttggatttcagataaagtcattgacatatatttaaaaaccctgtctttcaaacttcatctacagttttcaagtaatttttttttttttgagacaaagtctcgctcttgttgtccaggcgggagtgcaatggcgtgacctcggctcactgcaacctccacctcccgtgttcaagcaattctcctgcctcagcctcctgagcagttgggattacaggctcctgccaacacgcctggctaatttttgtatttttagtagagatggggtttcaccatgttggccaggctggtctcgaacttctgacctcaggtgattcacctgcctcagcctctcaaagtgctgggattacaggcatgagccgctgcgcctggcctcatgtaatcttaatacatgtgccacgtctgttcatttgtgttttctgtaataatgaaaacttggtttcctgtcatcctacctcccccatccaagtctattcttcgacaaacacttcctgagcactcacagtgctccaggccctgagcttagcgctctgggcgaagtgatgagagggacagaccaagccctgccctcacagagcacacggtcttgtgggggagggagacgctgaagtcagatgatgacagccatggtaagtactgagagtgatgattgcatgtgtgctgtgagatgcccctgacctggtcccttcatccacccatctaaccatctaaccatctacccatccattcacccaccgacccaaccacccatttgtccacctgttcacacatccgctcgtctgtccatccatccacccacccacccatccacccattcacccatccatctgtctgttcatccatccaaccatccattcatctattcaaccatccatccattcatccactcaaccatttatcgatccattcatccaaccactcacccatgcattcacccactcatccacccctccatccatccatccacctccatccacccatccacccaaccatctgactgaccatccactcaaccatccatccatccatccatccatccacccacccatccatccacccatccatccatccatccatccatccaaccaaggaatgtgtattgagtcccagtttatatactgacatgaggaagacaagaaaaatgaggcagagtttttgccctcaagtattcacaatccatctgaagaaaaacccctgtggatactataatacgtgcagtaaatacagggaggcctctggtggaaggaagagagagaaacagaaaaatgcacgtctatgcatatggacttgtgcacctgttcccattacttcattggaagggctttgggatgctgctgtgtcatgactgctgtttaagaatattatcagcatgcatattgcttgcagcttaaaccctccgatcctagactgtttccactggcatggcttaagggattaaatccaaagtgtatggaaacagaaggaggaagggagggcccctgggtgacccttggatgtctgtagaagttgttcactgctctccagtgcagatgtcaccccagggttgtgcagtgcacaacctgtaaggccagacttcagggccttggagacttcccagaagatctcttaacagactgagtgggcaactcaaatcctcctgtctgtggaagcggggaaactgacatagacatattctatacaagcctcattataagccctccacaaatgattgttctcactgcgcagttgaggaaatggagacagcaacttttctgaagccaaacagctggccagtgaaggaactgcaattcaaaccaagctcattgggtgtaaagttcatgccaccctctgctttctgtgggggatgggaaggagggtctttgcaggctttagaactcagagtacctctgagatgtgggaagagggcttaggggttccccaaggccagtgggccttgggctcctggggttctgggtccctggaggttctcatgttcagacactattgggatctcaatcttcctggcccaggatcccaagctgtgaatcactggaaagtggaagatctgatggaggtggagggtctgatggaagagaatctgatggaggagggtctgatggaggtgaaggctctgatggaggagggtctgatggcgggggagggtctgatggaactggagaattactggggctttccatgggccctctggcccaggttgcatctctccatgctggccactagatggcgacattagctggagtccacgctggaaaccgaatgtcccctgagtttccgcagcaaccacatccctgggttctcttgtttgttctctttcactggatttgagcctcttgcgtgtctgaaattgttctgcagacctgcaggctccggggcacatgtgtgcaaaggtggtgccctggaggccctgtaaatagctcagaaagtgaggctggtcttcttcagagactgagtgattgcgaagtgcaggacaaatgagtctatgtgggggccacagcacggatgtccaccctcccatctggatttcccaagaatgggagacatcttttccctcccttcccgtttctgggaggacaggggcagatggacaggcgagtaagacaggtggcagggagccagcagccctaggagctggtgctggggaggcccaggtgagatccctgtggctcagaagaggacctctgcatgtggaagggacgcccgcaatgcccagtgacacctctctctattgtggagggtgacggagtctgctgaggtagccacataagcacctaaaccagaagtgagtatctaaaacggccttgcatgccataagtcatcagataagaggggctggacaggggctccccaagcctgtcctcagctgtgaccaggtggctagcaaccctctttagtttgagcacctgctttgtcccagagagggagtattaaatgtccgctgttcaccccccacgccccatctctgtccctcctggggaggaaggctgtggtgggagtcaaccctcgcatcccatctctgtccctcttggggaggagggctgtggtgggagtcaaccctcgcatcccatctctgtccctcttggggaggagggctgtggtgggagtcaccccccgcactgtgtctctgtccctcctggggaggagggctgaggttggagtcaccccctgcaccctgtgtctgtccctcctggggaggagggctgcagtgggagtcaatccccgcaccccgtctctgtccctcctggggaggagggctgtggtgggagtcaccccccgcaccctgtctctgtccctcctggggaggaggggtgcagtgggagtcaatccccgcatcccgtctctgtccctcctggggaggaggggtgcagtgggagtcccaagatgcaggctcctcccagttctctgctcacctgtgctgaggctctgcgatctgtggaatggggccgtgttgcaggctcttgtaaggatcagtgttgcccaccgagggcccagcacacaggctcctaaggtgacgaagcacacatcctgctgccaaagtcacagcagcagcggcgccctcagacgggcccgtgggcctcctccgcacagtgtcgggtgctgagtgcctcttgtgggctctgggcttcgcgtccagcactgccaaagttgcccaggtttcacgggaagctcgcggcaggccgggcccagcagccttccgggagaaggacactacgcatctgcggccctgcatgcccccaggagcccatgggctccagcacgggggtgggcaaggggcgagagtctggcccctcatctcctggcagatttcaaagtgtggtcagaaacatagctggactgggcaactggctgaagtggaagtcatcattcagctaatgaggcttgatcttttctccatcccctgctactgctggtgtctgtgctggcctggagctcaccccacctcacccgggcagagcaaaggcccttggctggcagatgctggagggtctgtaaacttgctggtgaatgcccggctgtggacacacagcagatgcctgtcaagggagaaggagccaaggagagccctggggattcccaagagctttagggtgtagggaaaatcgcccaggcaggctgattctgcgaggcttgtccctatagcaggagatggcctgtgcgaagtgggactcctgggaaggagcgatgaggactagagggaaggggcagcatgactccacaggctctcacaagggacacagcatggacatgcttctgcctggatgcccctctgagtcgacagagatccatgtgccctggcatcaaggtcaggcaggggagacgtgcagggagtggagtggacaccagaggggcaagcaccacggtgtggacaccgaggggagccatgggtcctgggggtggcctgggactggactgttgagtcttgggtgggcagaaatcgttcccctcatcaaggactgtagatcctcacttgcgacacccaggacaccaaagcgcttctgttactggataaaaggtcttgactgtgtgtcatccaggctctttgtgttgaacaaaaaattgaacagaatgcataaacaaagcaaaaaagaaggaagcgacgaaagacaaagcaacaaaataacagtaaataaagtgcaggtatattgaagctaaagtacacttcacagagtgggagcaggcttgagcaggtggctcaagagcccccattacaatgctctttagggtttttataaagctcaaataatctggtgacacccctaggcaccctttagaagcctccaattagtcagaccctatgaaggattggcctgtgaccaatcagaagctgaagtggaaacttctgtcttgttatcgctggagtgaggatgtggcccgtgtgctgcctaatcttgcctagaactggctgcacctgctgttcttttgcttatcccttaacccttggtcaccctaatccctattctcctgtctcagttctgatggaaagaaagtgacagatgacctggaggttcctaacccagggaatagctagagttcgcatcccacaaactagtgttagactgtgggaggctaagggtatgggctttgcggttgtgagagtttggaggttgaatctcagccctcctatgtggggcatgtcacccaatctctctgagcccctgtttcctcatatttaccccacctgtgaattgaagctgttgctagcattggttagggaactttgggcaacaagcaatggaaatgtcaactccaacagtctttaaggataaagtcaatttatgaccccttgcaagtgagaagtccaggccagggtggagctcaggtgtggcttgctcctgcagctctcaatggcccagattttgtctgccttttgctctgcgttccatggtattagtttaacccaaagctccctcttagctcccaaatggctgcgagcagtaatcaggactaattgctcatttgtgcatgtccagctgaagacagaacaggtcttcccccaactacggattaaaaggctgggttaggcggggcgcggtggctcacgcctataatcccagcactttgggaggctgaggcgggcggatcacgaggtcaggagttccagaccagtctggccaattggtgaaaccccatctctactaatgatacaaaaattagctgggcgtggtggcacgtgcgtataatcccagctactctggaggctgaggcaggagaatcgcttgaacctgggaggcggaggttgcagtgagccgaggtcatgccattgcactccagcctgggccacagagtgagacgagactcgtctcaaaataaataagtaaataaataaataaataaataaataaataaataaataaaattaaaaaaggttagcattatctcttgattgaaatgtcctacgtgattccccgactccgagcctgtcgctctggccaggaggatgttgggtgctcctgataggctgaggcctgggctatttgcagtgtcaaagggaaaggcctcatgctgttggttcattagtgagaagccacaggaaggtgacatgccagggaaagagactaggctctgtgttttgggttcacagcatgcaagcatgcacccaaacatggaggaggggacttgagtgtcttttgaatgggtctacactgatatttgcttctctgacctccgaaggctccatctcctaggacgttttccgggagccagggaaagcaggatagcagagcctggtcacgtagtgctttgagaatgcgctgggtgggcgagcggtgccttcttattgggttgttcttgtgaggagcattctgattcctacttagaagccctgaatgaaggtgggagcccctgacgatggcagaggcaggtatgtctagggtctgggggcacctggtgtcatctacttgagtcctctttgaactctgcatttggcagctgagcgataccgaggaagtcacttcccctcagcgtcaagcacctgtgctcatcctcaaaggggtcaatgacgcttaggtcacactctccagggcccagagctgctgagctgcacacatgtacgtttctccatgagaccatcttgggggacaagtgctggcacccccacatggtaggacaaagacagaggccttgagacattagtaacctgcctcagatcacacagctggggccagaccagagcccaggctgcccgcggtcatgtcctaggcaccatttctcataggcatcgttgagtgggagtctgggctaaacaagaccacactggttttgatgacggcattttctgcccctgtaccgcatggtaggccagggcctccctcccacctggctacgctgcgcctccaccttcactctcagtctctgtaaagacatgttttgagtgcttggggcagtcgctgagaatattaaagacataatacaggggcgtgcacgatgtggggccttggtacaggttggtacaggttggatccatgcctgccctggctctgggaccctcctccccaggatagagccaggacaggtggggagggggtcactacctggcatgatccgccaggagctggggcagagggacggagcctgcctggcaacagccatgatccaccaggggctgggcagagggatggagcctgcctggcaacagttccagggggggtccttactgggacttccccttcccaggaccgccagtcccccaaacacagcgggagccctggtcagggaggctggtaacctagggggaagccagcgctggagctctggctgaggatggagcaggcactctctgttcaaccctccaggaagccagcatcaccaggtggctggggtggcttctggcctccactgtctgcacgctgtaccctggagctgccttgggaaggtttcggctcctgcagctcccccacgccaatgcagacattggcctcattcagagcaggtccgctcttccccaggggcaggcccctctcatgcggcccgctttcactttatcggagtcacaatgatctgacctcctcctattgatcacgcacagcatttcctgggactgagtttaatttctaatatctgccccatcaggcccctcctgggcaatcctcttccttcctggaaggtacattaaactctgaggtttcacaagggctggctgcatccctgtgcaggcagacaggaccccacacacccaggcgagccctccttggcggcctgttcatctgcagggattcttccggttccccctctggacagccccacggcccagatgccttggcttcccagccacagatccctcattgacctcccctccttgctggggagaggcaggcgctgggtcatccatggggcatgaaagtgacagctacaccctccaagcccgctgggtccctctgccgggtgcctcccatacctgcccctctgcagttgagcaggtgagatctgctgggggaggaggtggccccaggatccctgtcgccgtcccggcctccccgctgccctgcactggctcctgggcttctccttggccctcagttccacggcttcctggctccagcctcctgcctggggctacccagggccgtcaggggcttagttgttccaggaggctgttgtacacagaaaacaccttcatggctgcttgaacatttaatatataatttattgaggttaatttaaaaaaacaattagttttccttaagtaaactcaattcatgaatcttatttatttgttttatattcatctgggagcttttggcaatctctttcagagggacttttgattaatgtttgaccaactcagttgaaaaaaaccctcatgaacagtcaattctgttaattaaattccctcagacatttacactgaacttagaaatttatttgattttctttttaagacacttcagctgcctgacccaagtacttcagaggactctgagaaaaccactgacacctttgtaaacaggcagctcccagagtccaggaaacattccaattctacttatatatctagtttgttttgctcacacctttcaatttagaatcactagtctgtagagaatggcacattttaaactagaatcagctgttctggggaataaactaggaaagtgtgtgctgtgggagcctctagtatgcctcattctcttacacactgtaaacactttcaaacacatacacagactgtttcagaacacagcaggaaagtattaatatgataggtttgatttacttcatcatctgcaaacaatggtaaaccttcctggagttgaagtgctttctccactgtggaagcaatttcctgtagcaagaatggggttactttctctaagtgtgcgtgatttcggtctgggcttgagacctgggatcataggccttctggatgattctgtgatgccactgatgagaactttggaagctgccctgacacagacctccacatcctccagaggggccagtctcccaggcatgacctggttcagataaatcattcccggatccttccatcagattagtctgtgcccattgcccggtgacttcaccactgattagattcaatgtttctgcttcttctcgagttattttcaagctcttctgaactggagaagtacaactgattagattcaacttctctgcttctctttcaagttattttcaagctcttctgaactgcaggggtacaactctcacaggcagagtctccatgtcttttgtgctctgcccagctaggtggttcctgggctgtgatgctgcctggtgctctgggctgccccttgatctgtttctgatttagcatctggctctagctcctccactgtggtcctggccctacctgtgctcttgcaaggagcgtttggcctattcaaaaccaaaccctaccacccagtctgtccacgtgtacttagagagtgtggcacaattggttggctgtgtaggactgtgagctttagagaccttcatacacatttgatcattgatcctcacaaaggctgtgcaattagcaggcatcctcccaggttcataggtggggaattgatgccaaggcacgtgaaggggcctcatcaaactgcataaccagtacccttcgaacctcgatagcaagagcggatattgatcggttctgttcttagagctggatgctgtactaagaagtttacatacatgatctcaatgatgccccccaagaatagcacggtttgggaactgttaccacccccgtctcacaaatgggcactcaggacctcacagaggatgagcagctcggtgaggctgagattccagctgaggcaccctgaccccagagcttgagcttagcctctgcagcgctgcgtttcccctgacatcagccccggcatcgccgcctgcagtgactttggacacagttataggtgccctgcttaactgcacctggaggaggcagggtgggtgagctctatcaggacaaatcctgggggtggccccagctgcaggcaggactcgttcctcagcagagtggccactgtacagaaggccacgtcaagtcagagggcgcagggtggcactgcaaggaaggagtgtgtccaacactcagcacccaggctgcagtggagggggcagcagcacagctttccgggcaggcaggcagctggggacacctgtccaggggcagcactgtccactgccaggctggctgattgggatgcaggagtgagactctattccctggtttgggcagaggcaaggtttcgaacatgaatgtttgttgaacttttattatgtgctgggtggtgaaccatgcacttcacagagatgaggcccttgaatgtgctcttggcggcaggaagcgttttccttattcttcagccagagaaactgagcgcagagcgaagggagcttggccaaggtcgtccgtgagcggtgtcgggcctgacctagcacgccacacctgggcaggtcaccaaggctctgtgcttcaggaaccaggctggggagccccggcccagcagcaggagcagcatcaggctgtgtgggactaagccctggaacatgggacaggagagctgatgccctgattctctggagcctgagccctgggacccgagctgggctgagtgtgtgtggccctctctcaggtctcagtggcaggggaaggaggtcgtggggactggggaccagtgcgtccttttattcatcacctcatagctacctcccaccaaaccccattaggatacagtgtgtcaaatctcagacagcaaatccttctctcataaaggggcaggatcatctccatcctgtttgttccaacagaggctgtagtcaggggcagtttatggggtaagaaggatgtgctgggggcccccaggaccacgcttaggcttgatgcttctctggaaagactcacagaccacagaagtcacagtttcttacagcaaaaggaggcagattaaaatcagcaaatgagaaagtcacacagggtggggagggaccgggtgcgagctttcagctcccctcgcagtggggtcaccagtcagcacccgttccctcagcgttgatgtgtgacaacactcacggtgccttgccaccaccctgggagccctgagccttggtgtccacatttttattaggggtcagccatgaaggcgtggagcacccacatggttgcccacggcttctcagcccccagcccccaagaggtcaaaactgtgacccaggaccccagaagaccaagccaaacctttaccctaaatcccctggttagggtaaaccgtccaacagggccccaggtcccaggtctacaaagacatgcttgtcgggcgggatattccaagggcttagaggtcatcaccaggccaagcaggagccagtcctgtggaatgtgcagggtctggacacccagccccactgagtgagcccttccccgcacaggggacaggtggtctggaagggaggggcatgagtgtctgagggtgcctgtgtccatggagccgccctctgagcactgacgtctcataaagacgtgtcccggctgttgggggtcagcccctcctgtgtctggctctgatttccctgcagggtggggaaattgtcccaccccaggcactcaggtgcagctggactaaaggtcaagggggcattagctcaagctcagagctccttgacttcagctgtgcagaaacgatgagcgcctgctggagggacaactggtgcatgcagctgacggcacgcagctgagaggagacgcccctcattggttttggatgcatcatattttacgcatctccaaaggtgtttataattttttttttcaagtagcagaaatcgccatcaacccagcaaaaataaacatatcagtaaccatggtgacttcagccttccagccctgggcagaaatgatctcaggcggacacagaggggcgcaggcgtggttctaaacgctgggttctattgaaggtggactagatctgattgaaactcttcacagctgctggtggttggaattccaggctccctgcaggtgtctgcccttcccctggaagcctcaacagtgacaggggctgtagctgctggtgcccgggctggtctcctgaggccaccactagcttcctagggaggggctttacccaactaggacacagggccgcagacctgggcaccgctcagccaggcttccttcctcgggcctggacccactatctgcctgggcttctgttgcacagcgatgatgccaggaagcacacatattccagcgttcaccagtgcacaccaccacacatcgacgctgagggaacgggtgctgactggtgaccccactgcgagaggagctgaaagcttgcgcccggtccctccccaccctgtgtgactttctcatttgctgattttaatctgcctccttttgctgtaagaaactgtgacttctgtggtctgtgagtctttccagagaagcatcaaatattccaacattcaccagtgcacaccaaaattctctctgtggattttgggagagcgagagcgagagagaaacaacagcaacaaaactctaaggaactaacggtgtaaagaaataaattaacatgcagaaaatttcacataaggtccatccgcatggcctccccaggcaaagctttcaccttcttcctaaggcccagccttcccctggagaaaaggccattcacccacctgctggcgagggagaggtggcccccagattctcacacacagggtcacggagcttgtcctccctcccaaaccaccttcacttcggatctgcctggatgctgattagactggagagaggaacagatcagagacactagaccagggtgggcggaggaggggccaggaggcagatgcaaaaaggggagcctgccaggcgcagtggttcatgcctgtaatcccagcactttgggacgccgaggtgggcagatcacttgaggtcaggagttcgagaccagcctggccaacatggcaaaaccctgtctctactaaaaatacaaaaattagctgggcgtggtggcagtctcctgtaaccccagctactcaggaggctgaggcaggagaattgcttgaacccgggagatggaggttgcagtgagctgagattgcgccattgcactccaggctgggggacagagcgagactccatctcaaaaggcaaacaaactaaaaggggaacctgagacccccagctctggctgccctcggtctacactgctggcaacaagtccagtccatagttttttcagactttgaggcccaaatctttgatctggaaggacctgggattgccaacttggcagggactagagggtaaagggtggagtctgtccaggcgaggtgtggggtgccctggacacagaagactggattttgggtctttatcccttattgtctccccagatgcttttgtgaagacaggtctgctcttcaggtgctcccctctgcccctgggtcctgagggcaccagccctgcctccccaaccttcttccaggtgagaatgcaggtcaggctggaggcagacacctgcagatcctcctagaatgcgggcagctggggactccagatgtgggagtcctgatacccacagtccagctgtggccgagaaaaggggcattttctactttgctgatctatttgaagggaataacacccaaagatggctttctcccaagtcatggacagacaaaggcaaacacgaaaacaccatcagcctggctggctccgggccatgaagcctgcggggctgagcagacttctgctgcatctgttgggaaacaatgcacagtggcccttgtcccgaggacgcaggctgcctttcaatcactgctgtttctggaaaaagagagcccagtcttcccagagaagcgggcttaataaggacacaacccttctgtactcatgataatcacagctcacggccgtggagagcttcatagcgctccatcctgtactgagccctacacatttataatctcatttaatcctcgtaacaatcgggcaaggtcagtatcgccgtcactgctccccttcaggaagctgaggaactgcccagggccctaggatagatcggcatggggcagggtcagcccgagactcccagcccttagcccacagagcctggggtcacagcggtgaaagaacgggacatacaaatgcagagggctcctgctctagggtcctctaggtgctgtcacagaggaccacacaattggtaatttaaaacaatgcacatttattctcttaaaggtctagagattgaagtccaacacaggtctccttgagctaaaatcaaggtactgcagggctggttcctcccagaggctgggtttagggagagtccacttcttgcctttcccggcttctagagctgccctgaggccttgaccctcggcccctcctccctcttcaaaggcagcactggcgtggaggccttctcacatctcatcccctgagctcctcttccgcctcctctttcacatttaaggatcttggtgatcactttgggcctaccaggataatccaaaataaactcctgatgttaaggtcagtagattagcaattttcattccacctgatgccttaattcactttgccaggtaaggcaaccgagtcacaggttccaggattaggaggcagaaagggcttcagccggggttgacgcattcagatgtgtgctctctatggcctttctgtgtcttggcctggcagtcctcctggagtcgtccctgctggcagggacaggtgctggagtcagctcacgccggcttctgagagcccagtggggaacggctgaaatgtacaattaataaattgcactaaaacaaaggtaacttgagttttgagcatttgttacctttgttttaatacaatttattaattgtacattttatggtattattatgatataattttacgatcatcatgctgtggcagttattacctctgttgcatctgtatggcagaaatcctgtgtaacaggaggtttgctagggcacaccggtctctgcattgagcttcgtcgtgtccacagcttgaaccaaccatcgcaagagcatttacgtcacggaaatcagcatgtgctacaaatcgaggcttgattttatcgtcttattgattatctagactcaaggaaatgatgaaaatcttcgatgaacgcagattaatctacaagtgtgctatggtcataactgttacactgtaaatagcataaaacgttgtcaaatcgtagttgaattgcagctataggctggctacaaatatgagagtttggccaaaatcaacaaaagcatctgtgtggaccagttggctctatggaatttatgataaaaagtcctgtatatttattatttgtaaattgcgtgcttcctttgcatgaataaaacttagagtggactgacgtacagatgtttacacacacgtcttttctgcagagagcctgttgttaaacatttgccagcacaccactgcctaccccctgcaacccccaccccgccagcctcaccttcccggccccacactttgtgctctcgtcctctgagccacgagcactttccagagctctcctgctgcaccgatgccctctgcccagcatgggatgacccatcccaaccatcctctccccttgcctggcccatcctactggtcccccaggcacggcccagcagttattctctccaggaagctgttctctccaggaggctgtcctggcttctgggttgggtcagtgcccttctgtgttctgggggtcctgggttttcccccattgcaccctgtgggaatcgtgcttgcttctctgtgtttaggactggcccctggctgcctcgttggtggggccataaaactctccgtttgtgccccagaatctagcacatttcctacgtagtagatgctcaataaacattcactcaatagaacaaacagaatattcacttaaggagctgggattgttcttgactgaatacagagctaggtctcttcccagacacagaaggaaacagacaaaggaagggaaagctctgatggatacatggttctgaaggggccctgggtcctggcacatgaagacgcttgggcacatgggtggggaacattggggaatgccacgtctcagctcctatgactggagggccctttggaccgttttggcttcaatacagcaggcacctgacatccttgacagaggagtttctttctgcagatgcacgagggatgtggaacccaggactcagagggggcagattagtgttccccccagggggccctgggagccacgatcctgcagccgggggtgctcagaggataaacaggtgaggcagttaatcgggaggcagtcctctgggagccccagtgcagtcagcaaggcatggaagccgtctgtgtgggcttccatcatggtggggcactgggggccatgtggggttccttcacttcacgtaggtgcagctcatcatgggatgacagtggggggttggaggggacaccctacgggtcccagagatgccaagtgaggtcatcgtgatgatggaggtgctggctggtggcctccaaaggcaggcaggggcaggccctttccctgtgtccaagtccacatgggcactctcagggctatgcccatttgacacgagtctccacgcctggtgaatgttggcaccagcacagccattccatcgtggccctgaaaccaccacagaatactccatatcatgatcgtaaaacactcagtgccagccgcaagctcctctgacggaggctgtggttcccacggagcccgggcgcctgtggcaccctctgccctcctgctccatccggagccctggtggctgtgaggcgggggctcctctcctgtccctgccacccccaccaggtggtggcaccccatcctgggaggcccccgcctcctctgcctcttcttctacttggagtgtgaaatcagtggacacgcgctggggcagagtgcagcactgacccccgtgcttgctcactctgcaggcgccgtggcaggggctgggtagggggctgctgagccagcgtgagggccctccccacatcctcacctcggaaggaaatgccctccctggagccgcggggcagtaactgaggtagcacagctgttgagtgcgtgtccggtgccaggccaggggggcaacccgtgttggggacatgttggatgcctctctgagtcctggagcctgagtggctctagcccccagacgttctccaggaagctttactggcctgagggtcgctcgggagcagagatggaggggagagatgggcccttcccactcggcctccagcagctcagcccggcctctgccccctgccaacccccctcctgccaacccccctcctgccaacccccgttttcaggtctccttttggagacaacaaggtcactgtggcacaaggacccacagttccttatagtccagagaaatttagggcggtgggcggtaagctggggcaagaactgttctcaggcagccccggctggaaacatcacagatttgtcaatgagtttgcaaacatgattgagacatctccgctcaggagccttgggcttcaggtgacaatgactcactggcatgggctaccaagtgtgtgtgtatttgacctcagcgggttacacatgcacaacacacagacacacaaagacacggacagacacagatacacacacagacacacacacacacacacacacacacagaaatatacacaggccgggcacggtggttcaggcctgtaatctcagcactttgggaggctgaggcaggcagatcacttgaggtcaggagttcgagactagcctggccaacatggtaaaaccccatctccactaaaaatacaaaattagctgagtgtggtggtgcatgcctgtaatcccagctactcaggaggctgaggcaggagagttgcttgaacctgggagaaagaggttgcagtgagccaagatcataccactgcactccagcccaggcaacagagcaagactccatctcaaaaaaaaaaaaaaacaaacgaaacacagagagagacatacccaaacatatacacagacacacacacacgaatacacacagacacacacagagagacacagagagacacacgcaaacacatacacacactgacacacagacacacatatacagagacacacatatacagagacacacataggtacacacagacacagagaaacacacacacacacaaacacacacatacagacatatgcacagagaaacacacacacagaagacatacagacacacacacagagacacacacagccacatacagacacacagagcctcacacacaggcacacatgccgccctgaggccacacaggccacactttgtacgcagcccccaccttccacaggcctctctgtttgtacaaacaccgccaaacacatccccctcatcagcccctttgagttttcaaaatagttacgatatcctcactccaacaatatctggaggaaggctgcctttccccaattttatttttcttagacaaagaaacaaagagtccaggagacgcctgagagaagacagaggaagtggcagagcgggggaggggagcagagcatccagcagcccagagaaggggagcagggagggggggacccagtggaaggctcagagccaccggtgaggtggaggaccatcacagccacggattctgtaggcggacttgtcaggacagagtggagtgagggtgagtgaggggcagattcagatggctgttcaggggcgagtgtggggagactcgtggctgtgcgggggtgagtcgggggagacttgtgtggctgtgcaggggtgaatggggggagacacatggctgggcagcagtgagtggggggaggcttgcatggctgtgcaggggtaagttggggaagactcccatggctgtgcaggggtgagttgggggagacttgcacggctgggcagtggtgagtagggggagactcgcatggctgtgcaggggtgagctggggagagactcactttgctgtgcagggataagtgaggaggagactcaaatgtctgggcaggagtgagtgagcggtgactcacatggctgggcaggggtgtgtgagagagggagactcacgtggctgggcaggggtgagtgaggaggagactcacaaggctgggcaggggttagtagggggtgactcctatggctgggcagaggtgagtggggagaggctcccatcgccgggcagggatgagtgaggggagactcatggctgtgcaggggtgagtgagaaagggagactcccatggctgggcaggggtgagttgggggagactcatgtggctgggtaggggtgagtggggggagactcctatggctgggcaagggtgagtgagaggagactcatagggctgtgcagggataagttggggggagacttacgtggctgtgcaggggtgagtcggggagactcgcatagctgtgcaggggtgagtgggaggagactcacgtggctgtgcaggggtgagtgggggaagactcgcatggctgtgcagggataagtgagcaggagactcacatgtctgggcaggagtaagtggggtgactcacatggctgggcaggggtgtgtgagagagggagactcacatggctgggtaggggtgagtgaggaggagactcacatgtctgtgcaggggttagtcgggggtgactcctacggctgggcagaggtgagtcgggagagactcccatggctgggcaggggtaagtgagaggagactgacagggctgtgcaggggtgagtgagagagggagactcacatggctggacaggggtgagttgggggagactcacacggctgggtaggggtgagtggggggagactcctatggctgggcaggggtgagtgagaggagactcacagggctgtgcaggggtgtgtgagagagggagactcacatggctgggcaggagctagtgagggtgagactgcatggctgggcaggggtgggtgagggatgaggaatggaggcaaagagcagattgctccttagggacctgggttgctaatggtaagaggctgctgaggaggctcctggttgcagagaagggtttgttttcgccttctgcaagatgggcaggtttgtgggctggagggcaggaggcgaagacacagcctggatgagggggaggaggaggggcttgggaagcaatggggaatgggtcgctgtgagcagagggccctgccagcttcggatggaggggcagtggtgaaggagggaacgtgagtggacagatgttagggctcagtggggggtgcggggtgcagggttgggcccgctggtggagtggaagtcggtcatgagggatgtgccaggtgcccagtcctcagtgcggtcagaggtgagccccaggtcagagtgcacggcctggggagtgtggtgagtagttaatgggtgcgagcctgttgacttctgccattaaaatctctttattttgagataattattataagaagagtcgataagatacactgcactccagcctgggcgacagagcaagactccgtctcaaaaaacaaaaaacaaacaaaaaaaagaagggtagataagatagtagttatcagaaataatacagagagctcatgcgcccacctcccattgcccgtggtagcatcctgcctgactcgggactctctgccctgtgttctggtccctgggctctcctcatggtggccatgcccctggcattcctgtcctggatttctaagccatctttgacctaattagaaagcctggcctaccaacctgcagaccagctgggagaacccttagccctgacccagtgtctggcatgggcctctgggttttagaatggggctagtgatcagaggagctagtcaaggtctttggttgcaggccacagaatatgggctgagaatccaagaggccagggtatgtgggaacttggagccgggggaatagctaaagaaccaaccaagaaagagcagtttccaggtagctctggggatccacgtagttgagtctgcaggtcactgccctgggaggaattgcttttgacagtttcacctccatccctccatcaccctgatctgggtttcaaactagagtctccttggcctggcttgtatcccagccccacacttggccaggaggtggagctccttgattgacaacctctaagcctgcacacagggtcaaaggcagccgtccaaagtcaggcaactgtggccagaggaaggagaaagaaacagactaatttgacccccagatcttggttcgatgttgggtcaaattatggctggcaccagagcccagaagttgcaaggacactcaagtgagaacgtttgggtgtagaggtgcaagacaagtgcatctgagagttcgagtcccagtgtggacgtgtctggcattgtgtagataggcagactgtgctgaaacacgtgtagatcagtggcagagaacaaaaagacctttagttttctgggaaactgtacttaaaactagttatgcatcttgccgtcatgaaacagagtcacttattgccagtaatctccctatgagagtctactcaaactcagatggtttattttttataactttaacctggggactatgatgtttgttttacttacttgtgtggagaaattatatttactcatgctttgttcatttataggaaattggacttacttcccaaccatattacattaacctatggactaacttgttttaataacccagcagcaatataaaagaatggccatagattctctttgaataaggaaaacatctgtttttcttcttaaatagaaaaaaactcagtaagtctattaatgatgattaaagctgatttaaaatacacagcaagactttcagtttaaaaacagtgttctaggctggacgcagtggctcacgcctgtaatcccagcactgtgtgaggccgatgggggcggatcacctgaggtcaggagtttgagaccagcctggccaacatggagaaaccccatctctactaaaaatacaaaaattagctgggtgtggtggcacatgcctgtaatcccacctactcgggaggctgaggtaggagaatcacttgaacctgggaggcagaggttgcagtgagcctagatcccgtcactgcactccagcctgggaaacagagcaagactccatctcaaaaaaacaaacaaaaacagtggtctaagggcagaatttcccccttaacatctaggaagacccgcacacaacaagaggaataagaaacatgagctctatctgtaatgaaatctgggtgtacgtgagacctcaagccatggaggtggaagagatatcaaaagcagcagctggccgggcccagtggctaaagcctctaatcccagcactttgggaggccgaggtgggcggatcacctgaggtcaggagttcaagaccagcctccccaacatggtgaaaccccatctctactaaaaatacaaaaattagccgggcgtggtggcgggcccctgtaatccccactactcgagaggctgaggcatgagaatcgcttgaacccgggagtcagaggttgcagtgcgccgagatcacgccactgcactccagcctgggcgaagcaagggtgcaggaagaaatggagacagaatcttgcagccgcacatttcagaaaaggccatggaggatcgcatcacgaaggcaaaagctggtatgcagcagggagatgaggtccgtgcgcaggcagaggggcacctgcacctgtgttggttctgagaagtggaggatgtgtggctgaatgaagaattacccagcaaaccatacgacgaggaagccgtgtgttgatgttgtaccttttcattagaaaaagagaaagcgtcccatgtacacgtacgagagaaccaagatcaaacgcgtcaggtcatttaatataaacgagataaacagaagaatcaaaaactcaatcccgtgcctgtccaggagagagtcctaaagctctgtgactgagagagcttgtaaaatgaaacgatgggcgaagaacggatggacagcctcaaacagaaacgaagctgggtttatatccttaatgtcaggtaaggctgagttcagggagaaacacaccaaggaagaccagaataggttctttagaataataaagaatgcaactgacaacagatatgtcccaactacaaatatttatgtaccaaaaaggtgcttcaccatgcatagggtgaaaattgtgggagatacagtgaggtacgtgtagggccacgatactaataggagactttaaagaaaataactgttgtaatgtattcaatttctttttgtattttccccaatattttactatgaaaatgttttaaatacacagaaaagttgaaagaattgtacaagaaatgcccacatgccctcctcctatgtcaggggtcagcaaattatagcccgtgggctaaagctcacccactacccgttattatatgggctgcaagctaacaatggtttttctgttcttaaatggttaaaaagtcaaaagaaaaaatatgttgggacacataaaaattatatgaaattcaactttcaacatctacaaatgaagttgcatttgttttacaacagaacccaggcacactcatcatttgcatagtgactatggctggcttctaacaacaatggaagaagagtcgagccatcgtgactgagattgtctggtccataaaatctgcaatatgcattcggccctttataggaaagtgtaccaaactcttcctagattctaaaatgaacatttttctattattgctttatcacatatttgccaattcctctgtcgacaaatccactggtttttcggatgcattttaaagtaagttgtagacaccaatgcacttcactttgcaagcgcttcagcatgcagatcattaattggagttcattatgagtttataattctttttttaaataaaatttacaaacagcaatgtgcataacttttaagtctcatccaaacctctctcacaatgcagaacgttagccgagaatcccctgtgacctttcccaggcactatggaaccactaaggcaaccacagtgttgaattttcttccctggggatgagctttgctggctctagaccttcatataaatggagttgcacagtctgtactcctttgtgtaagatttctctcacatggcatggtgttctgaggatcacactgttgcatgcaatggtaggccaagcctttgatggatgagtattgttccactgtacaaatgcaccatggcttgtcagtttgctctcctggtgacagacacacaagctgagtccaggatttgctttgacttgtcttgggtaaatatctaagagtgggaggttaactcatggggctgttgcatatttaattttataagatcctgctggacatttttccaaagtggctgtgccattttgccttccaacgtgtgagagttctcatcatactacatctttcccaacaattggtgttgccattctttctaattttagccgttctgttgtgatctctttgtggcttatgggtattttcctgatgttgatgatttttgcatgtgctttttggacatcatgtatcttccttcgtaaagtaaaaagttagatgggctcatgcctgtaatccctgcactttaggaggctgaggtgggtggatcacctgaggtcaggagttcgagaccagactggccaacatggtgaaaccccatctctactaaaaatgcaaaaattagctgggcgtggtggcacacgcctgtgatcccagctactcgggaggctgaggcaggagaatctcttgaacctgggaggtggaggttgcagtgacctgagatcgcgctactgcctgagcgacagagcaagactccatctcaaaaaaaaaaaaaaaaaaaaagattagatggattcttgtcatctaaatgttcttgtgaacatttgtgtatcaatatttgtggatttgctcactgtgaacctttgtgtatttgctcacagatgagtaagactaagaataatagtcttgaaacattcatctgtgagcaaatacacaaaaaacaatactggaataatcagtgaattggttaaaaataaacagctctttttaaaaaattaactttattgagatgtaatttgcacattcaacaatgcacccgttgtaagtatacagttcaatgcatatgtcctgagggaaggtttgaggttcctttttcttgttctcatatggaccccctgttgttccagtaccatttgttggaaagactatccctccttcccccattcaattaccttagcattttttgtcaacaattaattgagagtatatttctggactctctgtcctgtcccatgagtctttatgtctatgtttatatccatactacaatgtcctgatataagccttaaaagtatgtagtggaagtcttctaattttattcattttccaaaaaacttttggctgttctagatcctctgcatttccatattaaatttttgagtcagcttatcaatttctacaaaaaaagaatgctaagctttttaaagagttttgcagaattaatgttatttctgcctaaaatgtttagtagaattcaccaatgaagccatctggggctacagttttctttgaggaaagcttttaactacaaattcaatttctttaatagatacaggaatattcaggttattgatttttttcttgagtgagctatggtagtttgtgtttttcaagaaatgtttttcaattaacttgtcaaatttattggcataaagttattcataatattcctttattaatcattcttttaaagtttgtagtatttatagtaatgtcctctttataatttctgatattggtgacttctgtcttttctcttttttaaaaatttttttattttcctgtctagagatgtattaattgtgttgatcttgtcaagtaacttggttttattttcattgatttttctattccttttttctcttctgtttcgttgatttccaccctcaggtttatcattttcttcctttcataatttgaatttaatttgcttttttcttccttcttgtgttgcatatatggataattgatttgaggcctttgttcttttttttacataaacatttaatgctaacaacttcccattaagtgctactttagctgcatttcacaaattttgatatggtgtgattttattttcattcaattcaaaatattttctaattgcctttgtaatttgttctttagcctatgggctatttaaatgtgtgttataatttccaaatacttgaaagatttttcacatatttttctcttattgattcctagtttaattatcttatggttaaaaaacaaatactacataattcaaaccactttacctttattatgatttgtttaatggcctgggatatggtctatcttggtaagcatgctacatgtacttggaaagaatgtgtatttatttgtcagtagttgggtggagtgtcagtaattgtgaactgggcaagcaggttgatagtggctagtactttgttcctgagtaaggaacatattcttactaacttcctgtctacttgttctatcaattactgagaagaatgtttaattgccaactctaattgctgatttgtctgttccttctttgagatctgtcagcttttcctttatgtatttttggagttctataattaggtacattcacatttagaattgttatatcctcataatacttttcttcctttatcattctgaaatgtccctccctatccctggtaatattccttgttctaaagtctactttgcctgatgttaacatagctatgccagctaatttcatgcctagtatatgcatggcatattttttctcatgtttttaatctttaatctatctgtgtcattatgtggatttaaagtcagtttcttgtagacagcataaatctgggccctgctttcttgtccagtttgacagtctttgtcttttaattgcagtgcttagcccgtttatatgtgagataatttgggtgtggttgagtttaagtctactatcttgtaatttgcttcatttgtcccatcatttacttgtttctttttccttttttcctctcctattttgatcaattgaatattcagtattttttttaaatcatggtaaaatacccataacctaaaatttaaattgagtgttttttagtgtttcattttatcgccaaaactggctcgttggttgtactttttttgttatttagtggtcgctctgttgctttttagtatcaggctctagggcatcttcatttgtcacaggccatctccaaatcacaggacacctcttccccatgtagcataagaaccttacaactataactgtgtactttcatttccccaccctccctttgtattattgttttcatacattttacttttacacatgtaggatacacatgagccctacaatacattccacatcatttttaagcacttcttttacgatcacaacttaacagaaaagtaatttttaaatacaaatatcattaacataagatgtcaaaatgacacagcaactacatggcttcttcctcttgcttctagaatgtactgtttgtacttcagttgcagcatttttatgctgttattatttatttgtctttctcttgcattagacaataaggcccttgagagtagaaacaatatctattcatctcgtaactttagcacaatgcttggcacttggcgggaggtcaacaaatgttgtaccatcacggatttcctgactgtccaagtgactgactgactgaatgaaggaatgatgagcctgcggaaacacacataccacacgcaggttggggcaggctctagcacacgcaaccagataagcacccgcccccttgataacttttatgtgcgcctcctcccctctgtcctcacctctcaatgttcagcttctcatttaaaatttggcaagaggaaagaggaaatcatggaccatcaaagagtgccttaaagagaatagacttttaaaagtcacaaataggactcaggtggaccctaagtttggctgcctgccaggagctgctgaacgtggccctgttgggtgcgtcattgtgtctggaggccttgggtgtgtctgtattgtgaacaaatgtgactgtgggtgaggtctggaaacagagagtgggtcactctggatccgtgttctagctgggcctggaaactgtcccagagcccatgcttgctcctgatctcattgggcaaactgagacatcttagcagcagcaccaactgcaaatcattctctgcaactaaagcggagcattgagtgcttaataatgtgggtgttaattgtttgggatataaaaatttcatgcctagagctttaaagttgtaccccaaatgctttctaaagcggttgtgtgcctcaggaatagttaaagctgcctcacagtgtacaacagtgttctcagttctaaaaatgaggatgtggaagtatttctcttctagcattttgagttcagaacaatgatagcattatgttatacttcactctgctttactgacctttctctaattttttaatccttgaattgttggaatgattagaaaaatgttcacaacgtgctttaataaaagtttctacataaataaacaaaaaaccaaaaataataaaataatactctccccctccccagctagttttttttttttttttttttttttccaagacagagtatcactctgttgcccaggctggagtgcagtggcgtgatctcgggtcactgcaacctccccctcccgggttcaagagattctcctgcctcatcctcccgtgtagctaggactacaggcgcccgccaccaggtctggctaatttttgcatttttaatagagacggggtttcaccgagttagccaggatgacctcgatttcctgacctcaggtgatccgcctgcctcggcctcccaaagtgctgggattacaggtgtaagccactgtgcccagcccccagctagttttaactttctattgaagacgacttatttcatagagggatctttaaggtatatataacattatttaaaaagctaaagaattttctttcaaatgtaaaattaaaattaagttcaacagccttcctgtttcatttattgagcacggatttcttttgcatttttgatggggagaggtgggttttgtcatccgtgactctgatagaagaccgatggggtgacttgcttgaagggaggcaggaaagtctccgccaagtgatcagcatttgctctcaacgtgcttctgtgtttcccacacgtgtatggatcggactcatgtagaaatgcctcctgccactgcatcacggaaccagcaaggccttgaaggccacgcgccacggcgcttcaggcgttcttttgtagcccagcggcctgctgtgcagtgatccaagtggagtcgcaggtagtagcagtggggcagggctcatggctctgcctcttaccacctccccgttgttctcccgagacttgggcagtgggcggtggagaaccactgacctcggctactgccttcatttaaacaaggggaaactgtggctctgtgagcttccgtggcctgccaaggtcccatgcacccctccctcgacccttgccgagacagagctggcctcgatgggggtcttctgactcctgggccagcgtggtctcccttgcacccgcattctcggagagggcagcagtggcggtgtggaggagagggcatgccttgagaagcgccggcacctctgagcacgtgggtgagaccccggccagctgagcagaggtgacccgctgaattagtggccagggctgccagcatccagggggtgttgggacccggaacctctctgagcttgaaggctaaggctaggatcccgcgagtaagcctgttctcggtccatttgggccctggccggtgtggagacgtgccaggtgtgatggcacgggagaggggacctctcgtttagaggttgcccagggaatggcagtgagcccaggagatcctccaaggggaatcgggacaggactttttccgcagaaaacaccccatgtggctcatcaaagaggagaggcaacccatctgttccagaacattccagatcatcatttaagacccccaatgactctatcacagaagatagggtcagtatctcctttgcctttaaagaggtcatcacccctagagcttagagttttctagaagtgttcagcctgattcaaccaattcaaaaactactctaagaaagcaaaccaggtattgttttagaagttccatgaactcttccaaaatgatcaggtaccatttagttaatgactactctggagtatttaatgacattccagcacctgagaacgttggtttcatctcataacactcgctaaaatgtgtgttggtgggagagagaaggagagagacacagagagctagtttggagaaataatgtataaatgcaaaggtttctctacacctctaaaatgctgctcattcctctctcggtggcctgaattaacagccagttctgtttctattttggggaattattagctgtagtttctttaaaatgccgtttatcactccattatggttaaaggttgtattagtctgagaagcagccgcctcaaaccggcctaagcaaaacagggagtcccttggctgacacaaatggaaagcccagagtgcacccaagcggcccttggccaggctttaatgatgtcattagtctcccccagccccttccgatcctcttacctttcaaaggtgctttctgggccaggctggagaggaggcaggtggacccttgggtttcacattctccttggtgcaacacatcaatgaagggagagagcttttcccattggctcagtgctggtcaggagagagtctgattggtccagcctgagtcacgtgagtgggcttaaaccaataccatagccaggaggtggggtgctctgattggtcaggtctggaccatatggttggcaagatgtcagccccatctgggccaggtggaaacgatccctcttgggaaaaggggttggttgacatcagaaaggcacgaaagggtactgtacacacaaaactcaccagcccctgtttttctggcccttagttcatgtcttaaatgaccttaatcttgacagccctaggaatagcgccaatgataccctcctaatcctccctggaacaaggctgggtctcaatacataaatgtataactatatactgttttattttaaaacctcgttgcctgctgtctctgtagttactgccttgattgtgtttagcttttagtctggctttatttcttcatatataggccatttgttctagcaatatacatttcaaactcgatttcaagaattctgagagaccagacacagtggcttacgtctgtaatcccagcactttgggaggctgaggtgggtggatcacccaaggtcaggagttcaagaccagcctcgccgacatagtgaaatcccatctctactaaaaatacaaaaattagctggatgtggtggcaagtgcttgtaatcgcagctacttgggagtctgaggcaagagaattgcttgaacccaggaggtggaaattgcagtgagccgagatcgcgccattgcactccagcctgggcgacagagcaagactctgtcaaaaaaaaaaaaaaaagaaaagaaaagaaagaaaaaagaaagaaagaaggaaggaaggaaggaaggaaagaaagttccgagagatttagtgaagtcatccctcaatgcctctaagtagtgagttttttaacactggaaggtcttggcaatttctactgttccacgtactgtccttggctatttgaattgcttaacagactgaccttcaacctgccaggaatgcctcctgcagaggagtcccatggatgtccttactcttcctggcaatggccttagaaatgtcaaaccattttcccagtggccctcaagcacttctctgcaccccttcacccaagccacttgcctgcaaagaagcctcccgatcactccaacttcccttcgaagcttctcagcttcttggctccacgtgctttctcttggctaccatgtggatttttaaaatctgattattttagtaagaaatgacctcagaccacagttatgaagttggctttatgaagcactaacaaaccactttagatctttagggtcagggaacctaaccttgctcctttgctcacttggccatcggctgagtggcttcttccctacatacatctgcaagcggatggccaagtgagcaaaggagcaaggttaggttccctgactctaaagatttaaccccaatatagacatgacacactcctctcttccatccagaaggtgtcctgctccatctgacagcaagttctgtctcctgtgggcttctgcaaaacatggacatttgatcaaacgctgcttaaatgtcggccatgttttggatgctcgagtggccatgcgtgttcgtgtgtctgagcgtgtgtgtgcaagtgcacagaacttagctccattaattagcctgtcaacccgaggttggagaccaagttttccggagctttggattctgcacggtgccttcctagccagcactcaataaacacttttaaatgaactcaagacctgcttcaagatttacaaaggtgttttccttctgttccactcccgggtctgcaccttgccctcacagatctgaagctcacaggacctccagcaccagcctgctcttacacccgctcagctgccagagccttctgggggtttttgatggccacacagtcacagcgggagacagggcagctgctttggtgtttctttctggaacctcaaaatggtgcatgctttaagattgaagatctgaacatgcaaaacccaacactgaggtatcagtgcatgccctggaagagctgaggctcaccagagccttcctgccgggctgccaatgcgcttcccagagctgaaaaggatcacaaggtgactggggagacatgatcgccaaagcctaacctcaaactcacagtgaaataggggaaaagccagaggattttcctcacctggagaaagcggctgaacatgaggattcccatgttccttcttttttttttttttttgagacggagtctctctcttgtcacccgggctggagtgcaatggcgcaatctcagctcactgcaacctccacctctcgggttcaagcaattctcctgcttcagcctcccgagtatctgggattacaggcacctgccatcacgcccagataatttttgtacttttagtagagacagggtttcgccatgttggccaggctggtctcgaactcctgacctcaggtgatccacccgcctcagcctcccaaagtgttgggattacaggcgtgagccactgcacccagcctccacattccttcagctaaaaatcttagggacacaaaacacgtgggcaggattggtgagaaatcatttaaaagcagccctttacatgattcagcccttataggatggaacaatccaatttgacttcgtagaagcatggatttcctccagcaaaacacatttggtttctttttggaaaacaggccatttttaagtggttgaaatgttcttggaaacattctcacatgattgcactgaatactttgtgttagcattaaagctaaaaatacacccagtggttttttttttttttttttttgttcttctccgcttgtaatattgacatcccttgtatccacacactcaaggagctaacatttgatgattagattttccatttggattaaacactttggaagtttcttttttataagttatgagaaaacaaaccatgagatcatgagagtgaacaaaacgtggacttgttaaaatgtccaaatgccattagagattgatcttctcacatgattaatctccttgttttgagaggcaggggtgcctaatgggcagaacagagccctggatggagctgggcactgccatgcactgattttgtaatcttgaccacctgcgtcctttcctttacccttaaaaggaccagcttacagaggatatgcatcctcaaattcacccaatgtcatgaacctgccctccaaagtggttgtaccatgttattctccaccgagaatgtgctagaaatcctgttatctgcatgcttgggtacacttgttgtcgacaggctcaaaacgtctaaacatgtgaatgagtgtgacatggtctgtcattgttttaagttacagctccatgtttactgacaaatttgaacatctttttatgtgtttggtggatatctgagtttcttctgtgaattttctattcatatccattgcatgtttcaaatatcagttttttgttttgtttggttttgttttgttttgagacagggtctctgttgcctatgctacagtgcagtggtgcaaacttggctcactacagcctcaacctcctgggctcaagtgatcctcccaccccagcctctagggtagcagggactacaggtgcaagccacctcacccaggtgatttttgtattttttgtacagacttggtctcactttattgcccaggatgctcttgaactcctaggctcaagcaatcctccagccttggccttccaaagtgctgggattacaggcgtaaaccaccatgcctggcctgaatttcttatatagtctagatattaaatctttttggttgaattgtacatgtatattcccttaaacttatgctagcatcttaaaagcgttgctatgaagaatagtgttctaccaatactcttcgaaattgatttcagggattctgagagatttaacatttttataaatgctaatgtatgtatgtatgtatagcataatttgtgtatgatgaagataatctatttcttgaggatttgataaaaactcatctgaaattctatctaggatctctagggaggtgggagagttttgattaccaaatcaatgtatattaatggttataggtttttccaggtgttcgatttcttctcgattcggttttggtgatgtttacttctctgaagatgatcccttccattgctgctttcaggttcattggacaaggttattcatagtatctcatagatgtgttttaaatttcactgccattaaatccccttttcattctcattagtcataatttattctctttactccctcttcctctccctctgtcttttctgtcccctgcctccctttctgtgtcattctggctgatgcttgtctattttattagtttttacagaaaacccacttttgagtttgttgattttaattgcttctaggggtaatattcatctatgacaatatgacgtgttcttgccatccatccattcaggtggagctggcatcccctaactcaaatgattcttgggttagaaattgccatttcctaaccccagagtcatttaagaggacattttaatttctttctttctttttttttaatccagacggagtcaggctgcagtgcaatggcgtgatcttggctcaccacatcctccgtctcccggattcaagtgattctcctgcctcagcctcccgagcagctgggattacaggcatgcgccaccacgcccggctaattttatatttttagtagagatggggtttctccatgttggtcaggctggtctcaaactcctgacctcaggtgatccgcccacctccgcctaccaaagtgctaggattacaggcgtgagccaccgcacccggcccttaatttctaacatacttttgaagtgcttgtattgttgatttctaacttaattgcattgaggtctgagaaagtgctctgaatggtggtaattctaaaaacttgctgaaactttttctaaaactttatttacagttatttaacctggtcccatgtgcttgaaagaattattttgtttcttggatgctaaaatgtttgccactgctctgagcaattgttgatttttttttcttgaccctgctgggacctactgaggagggcatggaattccctcagacttctttgtccaagtaacaagagagggccgtcagctggcagaggatggagcccccatgcagctgttggctgaggccacagctggaacaagacaaaaactgcatagatctgagctgggcacaggggcctggtgcagtcggctttctaatttatcattgtcaatttggtatttattattttcttccttctgatatttttgtgcttatttgcttgttctttttctaatttcttacgctggaagcttaattcattttttttttttagcctatcctgttttctaatgtaagcttttagggtttcaaatatcactttaagaaacatttaatctgtactctttaagatttaagatagtttattagggctaaactattattttctaattttcttttttaaaaattttactttaagttctgggatacatgtgcagaacatgcaggtttgttacataggtatacacgtgacatggtggtttgctgcatctatcaaccagtcatttaggttttaagccccgcatgcattagatatttgtcctaatgttctccctccccttgccccccacgccccgacaggcctcggtgtgtgatgttcccctccctgtatccatgtgttctcattgttcaactcccacttatgagtgagaacatgcagtgtttggttttctgttcctgtgttagtttgctgagaatgatggtttccagcttcatctatgtccctgcaaaggacatgaactcattcttttttatggctgcatagtattccatggtgtatatgtgccacattttctttatccagtctatcattgatgggcatttgggttggttccaagtctttgctattgtaaatagtgctgcagtaaacatatgtgtgcatgtgtcttcatagtaaaatgatttataatcctttgggtatatacccagtaatgggattgctgggtcaaatggtatttctggttctagatccttgaggaatagccgcactgtcttccacagtggtcgaactaatttacactcccaccaacagtataaaagcattcctatttctccacagcctcaccagcatctatcgtttcctgactttttaataattgacattctgactggcgtgagatggtatctcattgtggttttgatttgcatttctccaatgaccagtgatgatgagctttttttcatatgtttgttggctgcacaaatgtcttcttttgagaagtgtctgttcatatcctttgcccactttttgatggggttttttttccttgtaaatttgtttaagttccttgtagattctggatattagacctttgtcagatggatagattgcaaaaattttctcccattctgtaggttgcctgttcactctgatggtagtttcttttgctgtgcagaaactctttagtttaattaggtcccatttgtcaattttggcttttgttgccattgcttttggtgttttagacatgaagtccttgcccatgcctatgtcctgaatagtaatgcctaggttttcttctagggtttttatggttttaggttttacatttaagtctttaatccatcttgagttaatttttgtattattttctaacttcaacatagtttcttttttgacccatgagtgagttagtgtatttattaattcctaaacatgtgctccctctccccagttatcttttgtgtttaattattaattgtggataaataataaaatgttcatgaaaccaaatttttaacattttttgggttttgctctgtgtcctggaattaggtaaatttttgtaaatgttctgcttgtgcctgaaacatgcctgtgttctctcatgtcacagatgcggctggtgtcacctatgtctctggggctctgtcattttgggatgttctgtataactcgcaactagcagtgactgcatctctgtgttagaaggcatttctggaaatacggaaggcagggcaggccagaagtacttgggaattgacattcctaggaaaagccatgagacagtgaggatgagagctggggaaaggccctctcctgtctacagacatgtttgttttactgtcctggtgaactgaagctttgtcattgagtactgacactctatttattgctcatggttttgccttacatttatttttctgatatttacatgtattctttggttaatgttttcttgctatttctcttctctctttttagttttttatatggaaatgtctaaacataaaatagagagcttcgtgtaacaaactacaatgatgcagcttcaagaatcagcagaaaaccaacttttgtattttaaacctgtttttaaagaactaagttggcttttgaattttctctcttggagatgtttttcaaagaaccagaccattcatccattctacctatgtctgatttctaactcagggacttctacttttacctatattaattccttctttttacttttttttgccaggtataaggtttgttttaaacttcaattattctacccttcattttcaaaatttttaatgtgattctctttttatatcttttttctttgtttaataatttcttctgcttcttttacatttgaataatttcttcagtatttccgccagaatgtcctataaaattaattctatttgatgtgaatgcatgcttctaatgtttccaatgctagttttggggatcggtcatttgggctggaatccaggtctgctggccctggttttcagatagctcttcactcagttatgtgactccatggcattaaaaaaggctttgaaaggccaggtgcagtggctcacgcctgtaatcccagcactttgggaggctgaggtgggcagatcacttgaggccaggagttcgagaccagcctggccaacatggtgaaatcctgtctctactaaaaatacaaaaaattagctgggcgtggtgacacgcacatgtagtcccagctactcaggaggctgaggcaggagaattgcttgaacccaggaagtggaggttgcagtgagctgagatcactccactgcactccaagctgggtgatagaatgagactccatctcaaaaaaaagtggggggagctttgaaagcctcacaaattaggcagacaactgtaaaaacttaaacaaactattatgaaggcttagtaaggtattcaaagccagtggattgttagacgtctccatgtgttttagaattgtggtttgcaagctcatgttgcatgagaacttgagtttctgtttttttgtcccccaaccaaggagcagctctgggccccctctctgccagctccctcccatcccaaggctcacctgggccagcctccttctccctaggggctggggcttgtctagcagagtctcagcactgccatctgtgaaacccatcccctcccttgcccacagtgtccttggccaaggagccctagcccagcccagcccagccagcggcagcagcagctttttctcagtcactttcaccagcagggctggcctgacccctgccctgctttaagcagggagctgtctccatccccacctcactcctgaccctccagcacctgcctccagccccagagcccagccagccatcctcagccatgggcatcccaaacctggctttgggtatggatttgttcttctaggttttatgtttgaggcagcaccatgtccccacaccaccctgcctattcgtgaagaggtctggagaggtggtgtgactgcacagcatcagggactggtcagctgagggatgagggctggaatccaggcctgccggcccgactctcagggcacacatcactctggcaggggacttcatgacattaaacaaattaggcagacaagtgtaaaaacatacaaactattctgagactgcttagtagataagctattcaaagccaatggtttattagaagagggaaaaatatatgtgtgtgtgtggtgtaagtgtgtctgtgcggtgtgtgtagtgtgtgtatgtggtggggtgtgtgtgtggtgtgtttgtgtggtatatgtctggtgtgtggtgtggtgtatgtatgggagatgtgtggtgtgtgatgtgtggtgtgcatgtagtgtgtatgtagtgtctgtatggtgtgtggtccggtgtgtggatgtggtgtgtggtgtgtgtgatgtatggtgtgtggtacactgtgtgcatgtgtgtgtgtgtggtatggtgtgtgtgatgtatggtgttgtgtgtgtgtgtgtggtatgtggtatatgtatatgtgatatgtgtgtggtatgtgtatgaggtgtgtggttgtgtgtgtgaggtgtgtggtgtagtgtgatgtggtgtgtgtctgagatgtgtggtgtggtgtgtgtagtgtgtgtgttgtgtggcatgtgtggtggtgtgtgtgtgaggtgtgtggtgtggtgtgtgtttatggtgtgtgtgtgtgaggtaggtgttttgtgttgtatgtgttgtgtgtggtatatgatgtggtgtggcacggtatgtgtgtgaggtgtgtggtgtatgtggtttgtgtgtgtggtgtgtggtttgtgtgatgtgtgtgaggtgtgtggtgtggtgtgtgtcgtttgtatgtgtgatgtgtgtggcgtgtgtgcacacatctgtgtggtgtgcgtgtagtgaatgtgtgtttgggtatgtgtgtgttgtgtgtgtatggtgtgagtggtgtgtggtgtgtatgtgtggtgtgtgtgtggtgtgtggtgtatatgtgtggtgtgtgtatgtgcctgtgtgtgtggtgtgcatggggtgaatgtgtgtttgggtatgtgtggtgtgtgtgtggtttgtgtgtgtggtgtatatgtgtggggtgtgtgtgtggtgtatatatggggcatgtgtgtggtgtgtgtagtctgtgtgcatggcatggggtgtgggtgtctgtatagaaaaatgaagaggagctccctgagttaacatacctgggacccactggacaattgagcctcatgtttttttaaaaccttaatggttagaagactgggaaatagtttttttttaaaccataagcaatttctgtgcccagaagtgaggaattccttgggtggaatatttcgttgctctggtaagcctcacagtgtcattggtgtgcgtttggccgtgggggaagaaaaggaggaagaggtgatggctccagtgaaactgcagggacttggcgccagtggagctggcagtggcctccactggccagtagggaccaatcgttaaacccactcttggtccaaaattgaattattttaaaaccaagagtactaaatcctcaatcctcaaaccttatcaattcctagttatgttatcccattttattctgtcagttccggaggttgttgatggtggaaatactccacgacagggtgcagctgcacctctcttcctgatgtgtccagggaagtcatattgggcacttttaattggtcagtggtaggagcattgacaccatggaatttggcaaactctacaagccagggagttattttgaacccccaaatctgattgttcagtgtggatcagtataccactgcttaaagccgtggctttttggctttccaggttgatgaggcctcactctccccttatatcggtcagaatagttccttagcaatacgggaagctactctcctgttaagatctgttaagatgtgagtatggccgggtgtggtggctcacgcctataatcccagcactttgggaggccgagacgggcagatcacgaggtcaggagatcgagaccatcctggctaacacggtgaaaccccgtctctactaaaaatgcaaaaaaattagccaggcatggtggtgggtgcctgtagccccagctactcaggaggctgaggcaggagaatggcgtgaacccgggaggtggagcttgcagtgagctgagatcgcgccactgcactacagcctgggagacagagcaagactctgtctaaaaaaaaaaaaaaaaaaaaaaaaaaaaaagatgcaagtatctcagtatcttaggacagccagggataaaaaacatggtcattcaaaaacaaataagcccaagttgtttcaaatataagaggaaaaaataaggtaaaactgtcaatttcttaaaaacaaactactagttaaggaaaaaccatgactaatagagaagaatatattattgaccatttctagaacatgcacacaaaagacaaagctagagttgccagtattagtattagcaggaaaattatgccagtaacagtattagcagaaaaaaaaggaagcaaatttcatgttcctacatcagagaatagctgaataaattatggcacttacaattcaaggaaagatgatgtggctaataaaataatgggtacgatctgcatatatggccatggaatgctttcaagatatggaaaaggtaacatgattagtacaattccatagtgatttaaaaggaaaactacctcacataaataatgcacacacacagacacacacacactcacaattacttatgtgttatgatcagaggaagttatggaaggatgttgttttggtctgcttggggtatgatagggtttggctgtgtccccacccacatctcatcttgaattcccacgtgttgtgggagggacccaatcggaggtagttgaatcatgggggtaggtctttcccatgttgttctcatgatagtgaataagtttcacgatatctgatggttttaaaaaggagagtttccctgcacaagctctcttctcttgtctgccgccatgtgagacgtgcctttcgccttccaccatgattgtgaggccttcccagccatatgtaagttcattaaacctctttcttttgtaaattgcccagtctcacgtatgtctttatcagcagcatgaaaacggattaatacaggatgctataacacaacagcatacagtgggtggcttaaacaacagaaatttatttcttacagttctggaggccacagccttagtgttctcttctgaacatggcttctcattttttacaacatagataggctgagatttttccaaatctttaagttctagttctgttttgcttagcaattctttcttcaatccattatcttttctcacatttcactataagcagtcaggaggaaccaagccactccttcacgactttgcttggaaatattcccagctaaagatcccatttcatcttttacaagtttcaccttccacaaaacactagaacaggaacacatgtcagcccagttttttgctactttataacaaagatcacctttcctctgctgtcccacgccatgtttctcatttccccctgagacctcacccacatggcctttggtattcctaccagcattctgctcatggttgtctgtgtgtcctctgagatgatgaatgctttccctccagctctcctctcccctttctgagccctcagcaaattgactttagtgcttccttcacagctatctcagctttttctagcatggacccccaaactcttccagcctccactcatcaccaagctccaaagctgcatccatatttgtggttcttggttacagcagcatcccactcctcagggccactttctgtctcagtcagcttaggccgccatggggactgggtggctcaaaagcaacaggctcccagttccagagcctgggaagtgtgagatcagggtggtggcagggtcagggtctggtgggggccctcttcgtgactggccaacagaagacttcttgctgtgtctcccatggttagggttgagagagcatgaacatgctggtgtctctctctttgtatagggcaccaatccaaacatgagagccccaccctcgtgaccttatctcctccccaatgcagcacctccaaataccaccacattggaaatcaggggttcagcacgtggattttgggagtccatagcagaaatacacccaatttttaagtatctgatacgtgcattgggagtgaaaaaggctagaagcattgtttcatatatctttattttgttataatttatcctattttttcgaaagagatcttccgcttctttttgttttctgaataatttggtcctaaagtcatgaggtgggctgagcaggatagggttctattctggcatggacagggcagtaccctgagtcagaggaggtgcaggagtttgagcagggtgagggtcgtgctcatggaggggaggcctggtgtagaggtgagagctgggggagattgggaggcatcctttggtgggggcagctgactcagattgtatgtaccccagcaggggcaggtgggtaccccacaggggggctgaacgctgcagctcatgtctattccttatgtctttcagggttcacccagggcccgaaagcttgtgtctggaccattgagaaagacaactggaccgttctatgtggatacgaacatgcaggaggaagtccatgcttcctagcacaggccctagaatcagagtaaacgaggtcagaagtcagctgccccactggctgtgtgccctagacaagccaggggctcctctgtgcctcagttacctcacctggaaaatgggaatcactttggagggaccaacttgtcctggttttagcactgaaattcccactttccaggaactcctctcccctccttcccagtcctggcaaagccaccctaaataatccccacagtgctaggctgcgctgagagtaaagtgctgagcgcggggcagtcacttggtaacaggtagttactgctttcataataatggaagcagtttacagacatctgcttgggagaaagtatgaaactgtccaccacccacagtctggaactgctaggcttttagtttgtggaggcctcgccgactgtctccttctcttctgcagttagagaagggctgcaggagtgttagcaacaactcagccagaaagagaaaccagtgtatttcctgtgatcaagtcacacagcctaggctgcaacagcgagacagccagtagttaagaagttggctctaagactgagcaaccaggaagagctttggctgtgggctaagatggaaaccacgagcggaagtcagacatagcccagggagaagggggctgggcaaggcatttactcatttagaaatctatcatctctctctctctgcctacctatctatgtatctatcatctatctatctctttatctatctgttcatcattgattcattccttccttcattcaaaaagatgtcctacatatggttgcttcatattggttgagctcagttatgttgctaaaaagatttttttttcaatttaagaggcatggacattttgcagtggatttcagtggaaagttgatgtttgtgggttcagaagtcagtccttcccacacgagctccaggcccaacacttgcatctgctgggaagcaggttgcaagccctgtgaatgcttccgggacaacagttccctgtctcagcctctgatatgagctgtgccatggtgcacactcttgcaatggggtggcacgaatatcgcagtcagccaagatcctctgctatcctagaattcccaggaaactccccttgagagctttaatcatttgtttgcccttcaataactgcttatggagaagttcccagactcactgacacctatcattttaggggacagttatgaatgaaaaacactttaaattgacaatgattgggctgggcgcagtggctcacgcctgtaatcccagtactttgggaggctgaggcgggcggatcacctgaggttagaagttcgagaccagcctagccaatatggcggaaccccatctctgctaaaaatacaaaaaatcagccaggcgtggcagcgcacacctgcagttccagccacttgggagtctgaggcaggagaattgcttgaacccagtaggtggaggttgcagtgagctgagattgtgccactgcactccagtctgggtgacaggagtgaaactccatctcaaaaaaaaaaagaaaagaatgattgaattgttacatttcagttataatacatcttttaaattatgttgtaaatcagttgacaatatattatttaatgtcccaaaatatattagtgtctatacaactttgaagagttatgaagtatggcaacataaaattgcagaagcaactcaagtgcaatatacagtggctgtaaatatactttgtagctaagtttttctggacacggaagtgggaaacattcaactttttaaaactagtgatttcagctctctagactagacttaattttgtgtacagaaaacaaaaccttttccccagaacatgactgcctgctttttccctgacattgcatagatgccatttggcatagaacatttttagatttatgtgcccaattgtagaatccttgacaaataatgcttctggtatggacttctgaaaatgaccccagtgtcagcttgcatttaagagcacatttttccatggggaattctaaaagtatggcaggtactgactttcccagtgaagatgtggccagggttggcaaattcccagcacagtgtccctgccccgttccgtggcagacatcactaaacaatcagagcctcaggccccgctgagtgtgggcttggctccacaggaattaaggcagtgacagccgtactggcagatcggactgggcatgtaagatgaacccgaatggcctcctcctcaggtgagatactttgtgctgacgggagctctattggtgttcgcttcatcagcccttgctacacagtttagaagccatcggagctctcaagtctcaaccctcagaaatgactgtgttaaccaatatcctgtcatctccatctcacctcctcggccctggggttgtccccctggccaagaaccaccctgtaggtgatgctgggccatacttgcccctgcacaaaaccccgcctggatcccagtggattcctcagcacctgtgtggctgtggcatgtgggcttccagagatcttgtgtgaagggaagaccaagcctatagccctggaggccaggggccaaatttggaatatttttccaacacccacagtgttgcagagctctctatactgagtcctacagtttggtaccatgaggaattacagtgaggcaatctatttacaaatgaaacaaaaacaggcttttatggactggcctgggaacctcacccttgcacagatgggaaaatgcattctcactgctgaacaataagcccacgaaagcactggctcgcctgggactgccaacacgggatggtgtgcgctgcctacagaccagagaagtggacagtggcgcctgccgcaagctgctggggcacccgctgcagagctgcggctgagggggaggtgggcttttagccccagcaactttaaagatcctgtctccagtgctccatcaggttttataaagagatctgaatattcgaaatttttaagttaagatttcgatggtttctaaagacaaaacctttgctatcagggcacatttgtacacagggcccccagtctgacttttaaagagcgcagccaggagccaggaaggctgaaacggaatcacactgttagtccctggccgcctctggctctgctctgctggaagggccctgcccactgtcctgaggagctcaggatctcatgggttccaggtagcaggtgagctttctgtggccccatacaccaggtgttccatgccaccttgtgcaacccactccactcagctccgctttccatccccagaccccctgccatcagctggagacctgaaggtagggaacagctgtccacatccagcggtgactgtgggaggttcacagcacactgaggaggagcattcatctagaccccgagctgtccaacttactgcctttgaaaccctctgaaccctggggaggcactgactagctttgcttttctgtcctctcggctcccatgaggcacaaatggcctttcggttttcctgcagccactgggactgtcccagctatgtgggcagcacctggactgtcttggtgagcagatttgagatttggtcaacaacagtctgtgatttctatcaaatggcagcctactacacacatatgcctttcaactccagctacatgagatatttttatgtggtttttccattttccacatcctgcaattatttaataggtgttgtggctgtaagattctgccgctgacagttgggaacctcttaggagccctcttcccgtgttggggagcaaaatgctctgccccaacgtgactttctatgttagttttgacggcgctatttcattttctgtcccagctcatgcttacctggcctgctgtggacaggcctcatcctagcagctgcttctctgtagaaaacacacaataaacatcccactgccaacagcagcgtacatcccagaactcatcggccaccggagcctgagacatttgttaacatgacaaggccaacggcagtgcagaaagtgaaaatctttgaggaagcaggtgcggccagtctgcattcgtctcaagccctcccaagtttacaaatgaaatcatgaaggagcccagttctctccaagtataagctcccaggagaggggttcccactaggggctatatctaaaatgggtcattgttcttgcagacaaattcgcctgcactgtccagtaaaacagaggggcatacattccaggcgtgccttcacacatcactgtggctcgtagccacgtgtcaatgtggttcatagccactcccgctcactaaatcacactgcctgggcaggttctccaaagatcagaatatggaagggcagcacagccggcctcagggcaaagcagtgaagcactgggccctgtgttcgctgtctttggacctggctgtccccttcttccctcacgcaccttctccccacacctattgtacagaaaccaccatgtgtgacaatttgtgacctgttttccctgttcccacaccaccccctctgcctgcctacggtcaaatccaattcccctggcttccttcttcgtgttcctattcccaaacccttctccctttttttttttttaacacctttccagtttctctttttggaagtgggccagagtcagcgatcagggcagctctttctgtgaattgaaaaggacaggtgcgtcaagccggtgtagatttgctagactccccacagggtccttcttcaaacccctccttatttttattaagaagaaaaatcccccacatctcaagctctccctttcccagcttcagcctgccctgcccaccgaaggcatttgcagttaccctgctctctcctgggctttctccctggctcctgcccagaatattctagaatatagactccaggaggactagaaaaagcaactcagtggtttaaaaaagactgctttggagaatgacatctttaatgctaaaaacgctaattgtcattaacttcattatcttcgttattctttattcatcaagttctttacatggaaaggaccatgtttcctccaggactcgtagctgacaccaccccaccccccattagacagcttcctccactgctgccagaatggctttaaatggcagaacacagttccacagcacacagcacagcttgaatacaaacgcccctgagaggagcgagggccaaacagctggtctcagatgccaagagcaggttctgaaaggtaaggagaggatgactgagctcaaggacaccaaagatgcagaggggtggtgaccagaggaggtccccgcaggaggctccaggggggccctcagagacacagctcctgcccttcccagcatggcccagggtgctccagcagggtgaagcccccgcgggtaagccactcccttgcctgtcatcatcccagccagccaccacgccacagtctccacgccacagtctccacaccacagtctccttgctgttttgtggttctcagacctgttgagctttcagcagagcaagaaaatagtctgcggcgtatttttcagagtgaatcatttcttatcctgtggttcatcaggaaaaaacaaagcaaaaccctcatcctcatgtcctcgtggcctgagctcatacacaaatcctgcctgcaatgacctcagactgcaccagcaggtgaggccggcagtgagggcagcctgatgggcttagaccagcagaccaggttaggaaagcagatggccccttgcagcaggggtgcaaagcccctgaggtatgtgtgcaaggggactggcaaagcgttgtgaaagagacggaggacactgaccatcagcgttgccacctccagtggctcaggactgacccgaggcatggctctcaactctggtcacccactggagtcccctcttcctggatcccacaccccaagctcctgccttatgggtcaggggtgacagtcactccccaggtgattctacagggcagcctggcttcagaactgtgatggcatcacactcagtcactgtgcaagaggcagggaggcctggccagtctgggtggggctggagggttaggtgttcatgacagatggggagggagttggcacgctctgccagggctgacgttacgatgataccattttcaagaaggaatacagaagtgatgtgggcacttagacccaaggagctggttcaaaatgtgcagcctcggccgggggcagtggctcatgcctgtaatcccagcactttgggaggctgaggcaggtggatcatgaggtcaggagatcgagaccatcctggttaacatggtgaaatcctgtctgtactaaaaatacaaaaaattagctgggcgtggtggcaggcatctgtagtcccagctactggggaggctgaggcagaagaattgcttgaacccaggagacggaggttgcagtgagctgagatcacaccactgcactccagcctgggcgacagagcggccctccatctcaaaaaataaataaataaataaaaaacaaaatgtgcagtttcagacctattgagtcagaatgtggccagtgtgttgggcaaactctggatgattcttgcacacattcagtttcaggtgttctctgtctgggaggcagacttgaatcgcctgggaagatgcccagtctcaccccatcagaatctctgagggatcccaggctgtgggccttgccataggcaggaggtggggcatggagttagatcatcgggaaagggctgcggggagggattccgggagctggagaccccctgggccaggtccctgcaggggaacaggaggtggatttgagaagaaggacactgcatacctggggctggagaggcacgtgccatcatcccaatgcctgaggcaatggagcaaagggaaggaagggacatccctccgctccccacgtctgtgatgctgtggctgggctcacaggtgctgggaatgccccatcatcacactcagctgccacacaggaaaggacagtggcttgaatagagaacagagaccctcagtgtttggccctccacctctcaggagtgaatcaagcacacctaaaacgagttaatgtggctggaggcactgatcacccccaggcagccccacactcaggcctttcccacccgaggcactcgttagaggcgctggcagcctcagctgccccggctggagaagccacaggagccagccaagggcaggcgctgcaggagcatgggcggatgacaccgatgatgggcttcatggagatgcctgcagacaatgccagcagctaagggagccgcactgatctcaggctgcaggaaaggtgctgtctcagaagtgggttctgctctcctctgaggggctcaggcccctcaggagagctgggggtgggggagtcacaacttcttatggggggagctgagaaatccaagtgcacccagaggtaggtggccagagagcagtggctgaagggcgtgtcctgctggatgtggatgggctgattcaagaaaatgatgaaaacaatttttatgtgtagacctgatttgcccaagacaggttcccaagtcgtttgtggaaaaggaaaggcaccccctgactgtcagtcacaggccggtgacctcaccactgtttgggtgattgcattgctgttattatagacgggttgcaacattcagctcctggcctggttcctggaaatggcatgctggggaccctaagaaatgatgcacacgtgggaagacaaagctgaccccagcagcaggctgtgggtgagaggcagcgcagctgtgggaggccagcctcacctcctcccctctggaaacagctgtgtgttcaggggccatgctccagagaaggaagtgagcagccaaagactgggaagtaatgcttgtaaatatgctaaaaacagaagaaaagatggacatgaggggtgcaaagagagagcatcccagtggagaactggaatctgcaaaagtcaccaattaacattccagaagcacaaataactatttgacatgagggtattgcagatggctttaagagcaggctgcatctagccgaacataagattaatatgcttcaagatggatcaatagaaaacatccaaagcaaatcatggagagaaaaaaatggtagaaacagaacattatgttgatatagtcaatgccaacacaggtgtgactggagtcctggagaaagggggagagtggggagggagagggagggagagagacagggagatgcaagatttgaagaaataatagataaatattttctaaatcttatgaaagacagcaacccacagagtcaagaaattagatccaagccagatgaataagttcttaaaggattatactcaggcacaacatagtcaaactatctctaaacaaatctatcaactgttatcattaataaataatcttagaaaattcactaaaatgtgaaaattaaacagtattctcttaaataaacgatagttcaaagaagaaatcacaaaggaaattggaaaatactttaaaatgaatgaaaataaatagaaacaccacataccaaaaggtccaggatgcagcaaaagcagcactgagaggcaaatctatggctgccaatgcctgtatttaaaaaaaaatctcagataaataacctaaacttcctcctgagaacctagaaaaaggagagcaagctaaacccaaagcaagcagaaagaaggaaataaagattagtacagaaacaagtgatcttagcaaggttgcgggctataaagtcaatatacaaaggtcaatactattttttatagactaacaccaaacatttagacagcaagactaaaatatatcatttacaatgagataaaaaatattaaatacttaagaataaatacaactcaagatgaacaagaactcaaccctgaaaactttaaaaatctgcagagagctgggcctggtggctcacgcctgtaatcccagcactttgggaggccaaagcaggcagatcacttgagctcaggagtttgagaccagcctgggcaacatggcaaaacctggtctctactgaaagtacaaaaaattagccgggtgtggtgcacgtctgtagtcccagctacttgggaggctgaggtgggaggatcacctgggcccaggaggttgaggctgcagtgagccgtgattgctgtactccagcctgggtgacaggagtgtgaccctgtcccaacaaaacaaaacaaaacactgcagagataaattttaaaagacaaataaatggagagctattctacatttatggatcaggacatttaatgtgttaagatatcatttctcctcaaattaatctatgaatgtggcgtagtcaaaaccccagtatgcttgttttcttctttctctcctgctcccttttttgaagacaattgacaaggtgattctaaaatttatacagaaataacatccagaacagccaacacaaccttgaagaaaattggagaacttacactatcatatttcaaaacttagttaaaaactaccgtaattaagatggcgtggtgttggtacaagtacagataaacagagcagtggagaagaacagatggttcagagatttaccttcctcccatatacggccattggttacatcaaagagccagtgcaatgaagacaggagggcgttttcaatccctagtgctggagacactaagaaagcatttggaaaaaatgcacctttcagcctacatagaaattaattcaagatgcatcataaacttaaatctgaaaatgaaaacagtgctgcttctagaagaaagcaaataaatgtattttcatattcttcatttcttcagagatttcttaaagaaaacacacacatactaactataaaagtgattagatttcattaaaactaagaacttctgtcatcaaaaaacaaagacgaaaactgacatcattacaaaattaaatggtcagccgggcgcaggggctcacgcctataatcccaacactttggcaggccgaggcaggtggatcacctgaggtcaggagttcaagaccagcctggccaatatggcaaaaccccatctctactaaaaatacaaaaattagctgggcatggtggagggcacctgtaattccagctacttgggaggctgaggcagtagaattgcttgaacctgggaggcagaggttgcagtgagctgagatcatgccactgcactccagcctgggtgacggagtgagactccgtatcaaaaaaacaaaaacaaaaagcaaaacaaaacctaaatggcaaactacagactgagaaaacatattcaaaatccatctatgtgacagagggcacctatttagaaatattaagcaattctacaaaccaatactaaaatcaaaacaatacaacttaaaaaaaatgaagtggcacatcattaatcagtacagaacagcaaattaaagccttgatgatatgatcatcacattccaatcagagtggctacattttacagaaactgacagtgcaaagtgagggcaagcacgtggagccactggaactctcacattgcaggcaagagtataagtcggtaaaaatttggaaaactggttgatagcatccactagcattaagcacattcttgtcccataacctggcaatttctctggtagatttcactcaacaaaaatgaatgtttgtatccaccaagagacagatacaagaatgctagtggcaactttatttataatagccccaaactgagaacaacccaaatgtccaccaataggagaatgaaaagatactctctcacataaaagagtaaactatggactcaagcactaacgtgcatgaatcacaaaaacatatgaatgaaagaagccagacacaaagtagtaatactgtattccaattatataaagatcaagaataaacaaagctaatctatggtaattgaagccagaataatgtttacctgtagagacagtaattggttaggaaatggaagaggaacatttttacacaatgcaaatggtctatatcaggatctggatggtgaatgtacaggtgcatagacatgtaatattcatcagactttacagaaagatttgtgcactttacttaaaaagcagtccttacaggaaggaaaaaaagggcagcttctggagccacacccacctgttttgactctggaattgggtactttcttgctgtgaccttgagcaagtaaaataatctgtgccttacttccccactgtgaataataacagtgtctggctcatggagctgtgatggggattaagtgagttaatggatagacttctcagcacagagcacctaatacagccttcattccattcgtccttgttaccaggtttctgctaagctcccttccagggctgagatctcagaggcttcaccagctcactttcccccactttgctgcaataatcattggctagaggtattgtgatatgatgtcattaaagttaatctagacgaaaatttgatttacctaaaactattacactgtagacctggaggaatttcagtttttgccgtaattgttttcaatgtgtgttataaaaaataaattccactatgttcacgaatgtacaacttataatctgaccaaaagtgagagatgggtagattttcctacttgggtccttctgtggacaggtactaggtgctgctttacgcccagtgacttgtgagggaacagaactgccctttagtaaccctgctcacttcctgttttctgcagtaacaattacattaggcaatattattacacatggaattgcatcatgctgattttaaaacaatcctccctgtagcattacacagacactgaatcatcatttgtagtttggggggctttacatgcctgcagtggtgaaaactgaaattttgtcccacttaagggagtttcttcttccctttattaattgcaaaataaatatatgtcacttcagagggcagcagctggactacctatgtttgtgggtaagtcactgacaaaatgctttctagtaagaaaatatctttaaatataaatgtatggaataagtgtaattaactagatgtagattaagaaaaatgtaagccacatctcctagttcaggcagcaatcatttgtgacttaaactgtgatgtaaagtatctgtgacctataccagtcagacaccaaatattggtgagctgcctggatttgggagatgcagtgagaatgagtcagagcccacgacatgagggagagaaagggggaccctgaggacttggggtccggtgtgaggatcctgcactcggtttctgtgatggtgtgtgcaggggagtcacaagttcaggtgggcctgtggcagggctgcccatggcccctggtgagcatgtgcggccagccgggccatgggggtgaggccggcttggtggcttggattgcctactcctctgcagggtcccaacgggtttctagatccctccagagaagcctttgggtacatcccatggcttcccagcctccccctctcagcctgtgaagaagaattctgatcaagtgttgggcatgaatacagtcttcctggaagtgtggggctttgatttgcaacctttttacgtgcagtcttcatatatcaggggtccccaaactttttggcaccaaggactggtttcacagaagacaatttttccatggtttgggggtggggtggagggatgctttcgggatgattcaaatgcaatacttttatgttgcactttttttttttttttagacggagtctccctctgttgcactggagtgcagtggcatgatctcggctcactgcaccctctgcttcctgggttcaagtgattctcctgcctcagcctcctgagtagctgggacaacaggcatgcaccatgacgcccagctatcttttgtatttttagtagagatggggcttcaccatgttggccaggctggtctcgaactcctgacttcaagtgatccacctgcctcgacctcccaaagtgctaggattacaggcatgaaccaccacgcctggcctactgtgttttttgtattttgttttattcttattttattgtttttcatttttcttacgtcccgaggtacatgtgcaggatgtgcaggtttgttacataggtaaacgtgtgccatggtggtttgctgcacctatcaaccaaccacctaggtgttaagcccagcatattgtgcttttttttttcacctcacttgccactataaagcctgccaccagatgtagcttaactgtcacttgccactcactgatagggttttgatacgtgtctgcaagcagttgatttattatggtctctgtgcagtcaaacctctctgccaatgttaatctgtatttgcagccactccccagcacgagcaccagcacctcagctccaccttagatcatcaggcattagttagatttagattctcattagaagcgtgcaacctagatcccttgagtgctcagctcacaatagggttttcactcctatgagagtctaatgccgccactgatctgacaggagggagagctcaagccataaagctccctcgcttgccgctcacctcctgctgtgtggccccattcctaacgggccacggactggtctgcagcccaggggttggggacttgtcttacatgacagggtgagctaccctgagttaatctgagtgagcttcattctgtcgaccttcttccactccaccacagcgctacaccaacctgaacttcgcttcctgagacctaagattcagccccgtgctcagcagacatcagggatcaccgactctgtgccaggagctgttcttgatgctgggaacgcaggggtggacaaaacagagaaagccctgccctcaggtgtggtcagaagagacagggaaggatttggaagctaaagctcagatccagactgggcttgtttcaactcgttccgtgggcctgatgtagtctagagatgattcttggtgtgggctgtgggagctcctgcggtgtagtttggtgaggggccagcccgaggcaaactggggacctgtgtctccaaccttcagcacttctgcccttcagggtcatccctccaggtgccccaccctggggacttgaactctgcccttgtcccccaaaccaccttaccctaatgctgtggttctcctggtccatgcagggcgcagtgtcctgctgagtgtgcaggtgcctgtccctgccctctgcaatgtcatctccatgcagcagcagcgtttacccacggatggatccccacccctggaccatgcctgggtacaggttttgttccggttggtctgctattgagtatggaggccagggttccactccagacccctctgactcccctcaccaggctgttcccagagacttgtgagggaagttgacaataaatatgtaaattcagatgggtttcatgttagtgaaaacctgaatattgaaatattacaaacctagggttgaagatctcaggctggtgggagtgcctttgtgcatgtatccacccacttttccttgcagaactttctacacaacaattcagcacaggaagcatggaggagtaaagccatctggggagagatgagcagtgaaaaccgggggccggcaggttagaggaggggtgtgatctcagggtgcaacgctgttgaatgcacgcctccctccccccatccctctctcggcagctcccaggcaacttagtcacccccatcttaatcttactcaacagtcacaacagtctctctccctttttttttttcgtttgagacaaggtctcgctctgtcacccaggctgaagtacaggggcgcgatcacagctcactgcaacctctgcctcccaggctcaagcgatcctcccacctcagccacctgagtcgttgagactacaggtgcccaccaccacgcctggctaatttttaaaattttttatagagatgaggtcgcaccctgttgctcaggctggtcttgaactcctgggctcaagcgatcctctggcctcagcctcccaaagtgctgggattacaggtgtgagccacaatgcccagacttcaacagtcacagctatctcttggtgtagactgtttgctattggcaaaaggacagacacaaagaccaatggaacagaatagaaaacccagaatcacacccactcaaagatacaaagcaaatcagtgcaggaaggacagcttttccagcaagcgctgctgatgcatttgggtatccacgggcagaaaaaaagaagaacctggacttaaattttcttatacaaaagttaactcaaaatgcatcatagatgtagaacattggagaattttgaaagttcttcaggcattatgaatcctaatcctttgttggagatgagatttgcagatattttctcctggtctgttattaacacttttcgtcttcttaacagggtctttctcagagtcaacatttttcattttgatgtagtcccgtttatcaatttttcattttatgggtcatgcttttggaactctttggctccgtatcctaaagatttcctcctaatattttttccctgaaaggttatttcacatctatgatgcattttgagttaacttttatataagaaaatttaagtccagtttctttttttctgcccgtggatacccaaatgtgtcagcagcacttgctggaaaagccatccttcctccagtgatttgctttgtatctttgagtgggtgtgattctgggttttccattctgttccattggtctttgcgtctgtccttttgccaatagcaaacagtctggattattgtagctataaaataagtcttgataccaggtaagctgatttctcctcctttattctttgttttcaaaatcgtttcaactattctaactccttggcctttctttaaattttagactactcttgtttatatatacagaaaattttgctgggattttaatagcaattgcattaaacatgcatattttgttgatcattgatatttttactacgttaagtcttccaatctataaacagtatttctctccttttttctttagttctttttttacttcttttatcaggattttgtaggttttagcatacaagtcctgtacctgttttgttacatttactactaagtattgaattttgtttgagcagttgtgaatggtgtcacgtttttaattccagtgtccatgtgttcattgacagagcatagaaataaaatttatgtatgtttatcttgtatcctgcaaccttgcttgaactcacttattgtttcaggagtgcttttgtggatagattgggatttcctaggtagacaatcatgtcatttgaaaatagaaacagttttgcttttttttccctttccaatctgtctgccatttatttccttttcttgctttaccacactggctggaaattccagcatcatgttgaataagagtggtgaaagcaaacatccttgcattatttttgatattaaggaggaagcattgagttgttcactattaattatattattaactgtagatttcttgatgctgtttatcaagtggaacttctctattccgatttttctgagtgttttaaccatgaatgggtaaagaattttgtcaagtgctttttctgcatcaattggcatgatcatgtgatttttttcctcttttatctattaatatagtatattacattgattgactttcaactattgaaccagccttacgtctctggaataaacccaacttgaatgtggtatataatttttaaaatatattcctgactctgtctgctagtattttgtttgggttttctgtatttatattcatgagggccattggtctgcagtgtagtagtcttgctgtgttgcccaggctggagtgcagtggctattcacaggcatgacaattgtgtactaaggcctcgaactcctgggctcaagaaaccctcttgcctcagccaatgatcaactatagtattttttaaaaatattatatttgtctgattttgatacctgggtatgctaactaaataaaatgaattgagaagtatttcttcctcttctgttttctggaggagattgcctagaattagtgttaattttttaaaatgtttgatagaattctccagtgatatcatctgggcctggagaattaggtgttgtttttgttgtttttttttttttgagttttcaaaactaaattcaatgttcttaatagttatgagactattcaaatagtctgtttatattcagtgagttgtagtttgcatcttgcgaggaagtggttcatttcatctgagttgtcaaatgcatgattgcagagttgtttgtagtgttcccacattgtcctttggatgcttgtgggatctgtagtgatgtcgcttgctccatccctaatatcagtaatttgtatcttctctgtttttcctttgctcatcttgctagaggtttgtcaattttattgattgtggccagacatggtggctcatgcctgcaatcccagcactttgggaggctgagaagggcagatcacctgaggtcaggaattcaagaccagcctggctaacatggtaaaaacctgtctctactaaaaatacaaaaattagctgggtgtggtggtgggcacctgtaatcccagctacttggaggctgaagcaggagaattgcttgaacctgggaggcggaggttatggtgagccaagatcatgacactgcgctccagcctgggtgacagagcaagactccatctcaaaaaaaaaaaaagaaagaaagaaaaacaatttattgattatttctaagaaccagctttgtgtttcattgattttctctactggctttctcttttcaattacattgatttctgtgattatttgctttcttttctgatttttctctcctttttctacattcttgaggtaagagtttcaattatcattttgagagttttcctcatttccaatgtatatgaattcagtgctataaatttccctttcccgactgttttagttgtgtcccacaaattttgatatttttattttcatttttcatgtatttttattttcattttcattcaggtaaatgtatttttattgcccttcagactccctctttgcctcataaattattttaaagtatgttgtttggattctaactgttcagaagtttttcttatatcttcctgttattgatttctaatttgatttcactttgaccagaaaacacagtctggtgccagccatggtgactcatgcatgtaatcccagcactttgggaggctgaggtgggaggatcacttgaggccaggagttagagaccagcatggtgaaaccccatctctactaaaagtacaagaattagccagacatggtggcacacacctgtaatcccagctactcaggaggctgagacatgagaatcacttgagcccgggaggtggaggttgcagtgagctgagatcatgcccctgcattccagcctgggtgacagagggagactctgtctcaaaaataaataaataaataaataaataaataaataaacaaacaaacaaacaaacacaatctgtacaatttcaattcttttgagtttgttgaggtttgctctgtggcccagaatatggtctaacttggtatctgttttatggatacttgaatgtgcattcttctgttgttgggtggagtgttatataaatattgattagatcctattgatgaatggtgttattgagttcttctatatcctggtactacaggcatggtgccaccacatctggataattttaaaattttttgtagacatgggacctcactatgttgcccaggctgatctcaaactcctgtgctgaagcaatcctcctgcctcagcctctcaaagtgctgtccttcttgatgttcaaagtttcattcttttaccattttatttatgtttaaataacttcatttcatcattattttaggttatgtctatgagtgacacattttcttagtttttctttatctgagaatatcttgatttctgggtggccagttttttttttttttctttcaggaaataaaaaatgttgtgctaattctttctgtcttcttctattgttttcagtgagaaatatgctgtcatgtaaattgctttttcccctataggtaaggtattgtttctctctcattccctttaagatttcttctttgtcttccgttttcagaaatttgactgtaatatgtcttggtatagttttatttgggtttattctgtgtggagtttgctaaggttcttgaatctgtaggtttatatcttttggtaagtttgagaggttttcagctgttatttctttgattactttttaacccctcagccccacttccgggcttctgttagatctgtatatacagtcctacaggcccctcaagttgtgttcattttttgttcagcttgtttttctctgttgttcagatttgatgatttctattgttccatttcccagtttattaattttttcctctgtactttccattctgctattaagcccatctgctgagtttttaatattggtaatccattctaaactttctattttgttctttttatcttctatttgtttgctaagactttctactttctattttattttttcaagtctgctcataattgctcactgaagcatttttatgatggctgcttgttaacatttgttggataattctaacactgctgtcctctttgcattggcatgcattgattggcatccatccattaattggcttctctgacatcactgtgggaggggacgggggcacggcactgccaccttactaccaggcaagggtagaagtccaggttccctgctcagcctttgttgacacccaaaagaggggctcctcattaccactggatgggggttgaagttctggctttccatttggcctctactgatacctccctagctgggggaggtagaagaccttaactactgttccccacatggtcttcatgacatcacagggtgatgagtatccttgttaccctgggtggtggtgaaagtcctgactctactgggtctcctgtcaccaccccagcaaggtggacgaggagcttctcattagtgcccagtgggagcagaagtccagacttcctaattggccttctctgacacatatattatggctagaagagtaagagttggtttatgtgcctaattacagcctgaggagggtggaaatctgaactccccactctttctttgctggcatgggcagacatttgaccacagtttattctggaatgtttggttgaagcagagaagttattgtctaaaaattttctgtcctctaggttccccttttcctattcttttggctagagagagcaggcttttgttgggacttttttttttttttttggtctgtgctcatttgcatttccaggttttcagcttcttcaactcaaactctgggacatatgatgcaaaacaaaaatctagggacctcaccacagtgtggctctttgggtcccaagaaccctggatggtttgccttccttttcctatcttctagagtctccttatgttggttttgtgtaatatccaaggttttgaattgtgcttagagggagaagtagggaaaaatatgtctattccatcttcccacaagcctgtcctatgaccttgaacagattgaacttgtgctccttgtagaaatctgcccatttggaataggtttgccgtcttcacccaataaatacctgatagcagtgaacgtgtggaaaagatacttagccaggtgctaggagacctggatcctttttcggggctttatggccctaaggaggttacaaacctcagggagcctccattttctttttttcatgtagcaggataatttactgagataatttatgatgttaattttccctgctctagcaattttcccctccctttaaaaagtagtcatgtctttttttcttttttaaaatgagttgtttttctcctaaagcctttagggagttgcaggacctgaggcagaagtttccaggcatgcagaagataatctctctaatcaaacttttgcttttgaaagcttaggctccacaaggtgactgccccaggccctcctggagaggaggaatgcagagctggggttctgggggagggaggcaggagggtcaggagaaatgtctcggagcctggaaaggggagctgtggagtctgcaggcaccaggagagctcagaggtctcagggaggcaagaggacttctgctcaggtgatcagggggctgagtccacagaacacttgaactgtggcctttggagccatggagagttgatctggacctgacctgggcttggcatggaggagctgcctctgagggaccaggcacagatcatctgactgatagaaatagcaaaatgtgggctgcctggtgcctggtgtgaaagtgtaaaacccatgagggtccagcgatggcacctgccctcctaccccacagggcgttctgaggcaaaatgcaatcatgcacattacaacattttctaaagcactcgaggttgtccaaacataactcatggtttttattaagcacctactccagctaggctccgtgctgggaatgatgttagagcaaagcaatattagtgagatgctggaatttatcatctctttggagagataatgcatatactgggtgaagaaaaagctaagggttagagggtcaatctagaaactacttgtaaggattttctcatagagtggctttgggcctctgacttttaacttccttgtcaaactgatgatcgtaatcaagacttcttagctgcaagtgactgaaatctaattcatactagttcaaggtcagaagggagagtagaggatcccgtaacaaagaataataatagtgagcaccagcatttataagatgcacactatgtgccggccatggctttcaaatgctgacacctctcatccttgaaacagtcttctgaggtgaacaggatggatcatcagcccgcttaatagctgaggtcacaggggcacagagaagaacgagtttgtttaaagagccgccatctggctctggggcccagcacttatcaaaagttaaaaatggttgcccagccacttgggaagggccaatgatggacaatgggtgtgaactcgggagggcaggatgtaggggctccagcgatgaaagggctgatgaaagggctttgtcacttccttcgtctccggctctacttccctgggggtgtttacttaattcctagccagacaaacactctccttacatcaatgccaaaagggaacagggaaagaaaccctctccctcttagggtccaggaagtccctgcgagaactctgatggccctgctgggttgtgtatcttttccagaacatcagtagtggccagagggatggaatgttctgggaggctccaggtgggggttgagttctatggttgaccacacggagtcaggggtgggaggttccttggaggaaacgtggggtacacagtggttccagttacttcctagcaggtatttgttatgggtgtgatgggaagcttttaattatttgtgggaaggaggcctccagtaattttccggtatctgtctctgagacttctgtcttaatcttcaactttgaaggtcatcttggggccagatgttatttactctttcttcatttgaagaaatggtttcctagatctttcccagccactcttgattccatgctaatggaagaaaacaaaaggaatttgtctgtaatacttaacttgtcttgtcttaacttaatctatgaaatatctacttgcagtttttcccctgaaaccatctctcatcatctgtcttgccaccatagcttccaggcatctgccgcccccctccctccaccctgcacctccctgcctccttgatttccctcatctcatggcccctcctttgcactgacctcccacaggctgtgtgtgcttggtgaagaaggggtcctctctatagctgggctggctcaccagaggaagcgaaggagcgtatctggatgctggagacagaataccattgaagtcaagagtgccagcaaaataggaaacaaacagtggagattaagcattctcatttctttcttcttttttttttttttttttgagaccaagtctccctctgttgcccaggctggagtgcagtggcgtgatctcagctcactgcaacctcctcctcccaggttcatgccattctcctgcctcagcctctggagtagctgggactacaggcatgtgctaccacatctagctaatttttgtatttttagtagagacagggtttcaccgcgttggccaggatggtctcaatctcttgacctcctgatccgcccgcctcgggctcccaaagtgctggcattacaggtgtgagccactgcacctggcctcagcattcccatttctttcaaatgaaccaacacacagagttgctatttggtgtatccaaccagccttatgctgctgccctccctgatgacatggtctctgtgtctgacccactttcccaggcttctgcttgaagggctaaggcatggttttcctctgctcctgttcttcttcctttctccactcacctttcccttcctccttccttcctctctctgtctctacctctcttctttccttccttactttctccctgctatgatccaaatgttggtatcctccccaaattcatatgttagaacctaatacccatagtgacagcattaagagatgcgatcctgggcctggcctggtggctcatgcctgtaatcccagcactttgggaggccgaggcaggtggatcacctgaggtcaggaattcaagaccagcctggccaacatggcgaaatcctgtctctactaaaaatacaaaaaaaaaaaaaattagctgggcacggtggcatgcgctggtaattccagctacctaggaggctgaggcaggagaatcgctggaatctggggggcagaggctgcagtgggccgagattgtgccactgcactccagcctgggtgacagagcaagactctgtcttaaaaacaaaaatcaaaaaacaaaacaaaacaaaacaataacaaaaaaagagatgcggtccttgggaagtgattaggccatgaggaatgggattgacgaacttattaaatggtttgaaacaggttgaaaggagcccctttcctttctaccacgggagggcacagaaggcacacctatgaggaacaggcctccagacactgcattttctggcgtcttgaatttggacttcccagcctctagaagtgtgaacaatacatttctgttgtttttaagttacgcagtctaaggtattttgttataggagtccaaatggactgagacagaaattggtaccaagaagcagagtgttgcagagacaaagacctgcagatgtggaagaggctctggaactggataatgggcagaggctggaagagtttagaggaacaggctcaaaaggcctggactgccaagagtggacataaagggtgatcctagtgagggctgagaagaagacacagagcctccgagattatgtaagtggctgtgatcagaatgctgatagaagtatggatggtaaaggccactctgttgaggtgtcagacagaaatgaggaacgtgttactggaaacgggaggaaaggccattcttgtgacagagggcagaggacttggctgaactgtttgtgtcctcatgttctgtgaaagtcagagtggcaagggatgaacttgaatatttggtggaagaaacactctaaaccatgtcttgaggacactgcttaccttctctccactgcttatggtaaaatgtgagaagggaagaaatcaattaaaaacagatttttttttttttttttttgagacggactcttgctgtgttgccagtggcacaatctcggctcactgcaagctccgcttcccgggttcacaccattctcctgcctcagcctcccgagtagctggggctacaggtgcccgctaccatgcccggctaattttttgtatttttagtagagatggggtttcaccatgttagccaggatggtctcgatctcctgacctcgtgatccgcccgccttggcctcccaaagtgctgggattacaggcatgagccaccgcacctggcctaaagacagaatttatagtcaaaaaggaggcagaacttgcagaatattctcagcctgaccatactgtaaagaataaaaaagcatgtttagaagatcaagggtgtagccaaactagcgtttcaggcagagattagcatggacaggcagaagccaggtgctgtgcatgaagacagtgacggcataaccctgaaggtgtttcagaggttattattgctgccctcccatcacaggcccagggtgccgaggtctgggggacagaactatgcccacagaggtgcctggagtgcctgcaggacctcggcacctgctgcagtgtgtctccctcagagggcacaatcaataaaccttgggcttctgtgcagggccatctccatgggtgtgtagagggtaggagctatggaggcatggctaactccatctggatttcagaggatgctttggagagccttggggtccaggcagagaactgccacaggggcagagccactgcagagagcccccaccaggacaatgcccagtggaggtgtgggggcagggccacctgaagacctcagactagcagagccactgacgtgcacctccagcctgagagagccacaggcaggagactccagcccatgagagctgcagtatgggctgtgcccagcaaacccatgtaggaggtgccacccagagccctgggggcctaagtccctccttagagtgttcagaaggtgggaccatggagtcaaagaagatataatgctttttgccctgttgggttttggacttacttgagacctgttatcgctttcttcttttctgtttttctctttttggatggaagtgtctgccctgtgcctgccccatccttgcattttggaagcacataacttgtgtgacttcacaagttcaccgctgaaggaatttgccccaagaggacatttaccttgagtcccactcacatctgatttaaattatgtgtagctgggactctgggctttagactttttatttggtgccgggaacaatttaagactttgggccctattgagatggaatgaacatatttggcatgtgagaagactgaattctggagggccaggggtggaatgctatggtctgaatgttggggttccccctaaatttatttgttgggacttaatgctcagtgtgattaatactctgatagtactaagaggtgtggcctctggaaggtgattagttcatgaagactttgcctcatgaatagggtggagctctcataagacaggttgaagggcccatctcttcctcttccatcatgtgaggacacagaggcgccatctatgaggaacaggccctcacctgacaccagagatgctggagtttgaccttggacttcccagcttccagtgctatgaacaatacctttctgtagtttacagatttcccagtctacgatatttgttacagcagccagaatagactaagacacacgtacactccctcccttggtcagagaagccaacagggccggggccaggctgaccagaagggagatctccaggcccagcccaaggcaagctcgccacagggatgcgtctcgagcatgagcacctgctgtgttgtcccggcctgggatgacgagggcacggtgttcatccctgtctctccctccctcacatcactcaccactgtcagacaggagagccacaagccctctttcctacttacacttggggcagcatcttctgttcttaactggctgggaacttttatcttcagagtcagagatctgggttgtgaaaagcaggcaagcagacaaacatctctctgcagccttctccccattctcctacccagtttccagaatttgggggaaaaaaatcccataagctgtcatacttcatattgccatcaggcagcagtgggaatggtgcagagaggagctgggcaaaggggcagagggacagctttctttgtttttttgttttcctccatgaaatggggaggtgtcaagtgagcgagatgtccccggccacacagtgaagcacaaggcagccgaagacacagcaggcaggtcaggtctgtgtgcacattggcaggctgcatgcagaccagcctcggcccaggtggagaagcagagggatctgcaggggaaccagggattcagagacctgttgttggggtcctgcagaagatggggcaattcaagtcaccaagccagtctcaccccaatggcctggctggttgcagaaactcaccagggacaaggggtcaccccaccacaggcccacctggacatgtgactcccctgcacccaccctcacaagcaccaagggcaggatcctcacgccagaggccaagtcctcagtgtgcccctttctccccttcatgttcagcctcagcagctggaagtccacagaaataaatcagacacttctaaaatgggacaccatagggaaggccagatggaataagagttctcttcccacagacctagacttccattgactccactcgaagtcaactgggtgatgctgttggctgcaagtcaaggccaacatgggctgtgctaatagatgcagaccctctagagggaaggagcacatcaccctggcctgttctgtcctgatcacactgaataggtgttctttggtggccctgaatttcatgagggacacgaggaactggcacccatcccgagaaggggaaagtgggacaaaagggcgtcttctaggaagccacactggagagactgggggcatctggtccagagaacaagggtctggaaagaatgttgttgccatcattggctggccagggcctactctggggagtgactccatgttgctatggtgtgcagagcagtcagggtgatagggagtccaattggacacaggttcagtttgctaatggtgacaacacttaataatggagtgggttgccagttgaggtagtgatatagtttggctgtgtccccacccaaatctcatcttgaattgtagctcccataattcccacatgttgtaggaaggacctggtcagagatcactgaatcataggggcaggtctttcccatgctattctcatgatagtgaataagtctcatgagatctgatggctttataaaggggagtttccctgcacaagctctctctcttgtctgccgccatgtgagacatgcctttcaccttccgccatgatcatgaggcttccccagccacatggaactgtgagtccgttaaatctctttcctttgtaaattgcccagtctcaggtatgtctttatcggcagcgtgaaaatggactaatacagacaggaagtggctccccactggaaattaccagctgtcagcaatgccttagcagaaatttctgttggggttgggactaagctggtcctgtcgagagctccccttgcctggttgatcctcagggttctacttagaatgcctcgaaaagtcttggctggacacccatgcccagtctttctgcagggtcccattggggttaaccttctcatttcatcccatgtgaaccaggccaggcccatcagggtttggcaaccccctgatgcagtggttgctgccaggtgacaggagcaagcctgcagctgctggggggccatgcagagacagcctgccagaggggagaccacctggggaggccagagccgtggagacagcaagagaccaggggctgaggacagagtagtacaggtctttggtcccagtagtcctgaaaccactgcactccgaacctttctgtacttagcttaagccagttggagtttctgtcctttacaaccaagagccttgataggaatggggtcctgtgctacgctactgttggcttctttcccgatcgggcgctggaggggaacacagcagtgactacagtgggatgcttactcggtgctgggcatgctagaaagtgcttgccatgccttatttcccacgtggtggggattttgaccccactgtacagacagataagtgaggaccctttcacttatcctgcaacagaaaatccagcagccaaagccaacaagggcccagcatagcatcttccctctctgacttcatcctcacgctccacacaccatccccctggccattcccagcagcccagtaagcactgcctcacacttccagttccggaccagccaggatggccaggctggatgggggccatccaccggctgaagccaattgcctattctcgagctgaaggtgaatcaatcccgcataaatcttcgggcagagaactgggtgggggtagaagagggggaatgtctagaaggaaattctgggcacattcctggaagtgaggaggatggatattggacagaaattatgtcattgcaggcaccctcacttgccctggccacatggacagttcctccccggctgtgttccgtgcctcctctcgtgctccagggcctgtctgttcctggagcgagatgggtcccagggctgggcaccagtccccatctccagccatcaggcactttcctctctgtgttttggcgtaaacactccctaggtttgtggatctgaatcctcttcccaacacactcaagctttgctggcctccctgcagtgtatgtttaaggcaccacacagcctccaaggcctggcacccgggcagtggcacctggtaaacacagcagtcagatttcctcatttcagccaagtgtaaaatcaaggtaatggatctactcttttttttttttttttttttttttttttttgagacggagtctcactctgtcaccccggctggagtgcagtggctcaatctcggctcactgcaagctccgcctcccaggttcatgccattctcctgcctcagcctacatagtagctgggactacaggtgcccgccaccacacctagctaattttttgtatttttagtagagacggggtttcatcatgttagccaggatggtctcgatctcctgacctcccaaagtggtgggattacaggtgtgagccactgcgcccggctggatgactcttgagacaacaccattcagacaaaggcaaggcctcccacttaaactcataaccgtgtctcctttctctccttcgatttgagcggctgaatttggttacagtcatctgacctgtgggtgtgaagtccacctgcctggcataaaaagctgtgcctcctttctaggtgaggagaaagagagagacctggctcatctgaggtgtggttgggaggggggacccaggtgtgctggaaatgaaaagaaatgcattcctgtttttcgtcccaacatgcaaacaactgaacaaaagcattagggcctgagactgggagtaaagaattccttgtcaccatggataccaggaaatggccccacttatatataataagggctttagagatgctggaccatctgatattccagcctggggccacatgggagtgtgccctggtgttattccttatacagttccatgaacatggctctggaaacacctctgtctgcagaaaatgaggcttttctttttttgttcgggggtgaacagagggcagaggcctgggcatcttcactcagcacccctttgtaacccagcacttagcaccatggctggcgcacagcaatgtcacatgtgtgagtgcacacgatgcctcactgccaggggtcaccccacaccggtgctgttgggggcgttggagtggttatctcttctttagtcctcaagctcctacctggcagagagctgcccaacaccgtcggggtggggtgggcgggaagggaagaagcagcagcaagaaagaagccccctggccctcactctccctccctggacgccccctcttcgaccccatcacacagccgcttgaggcttggaggcagtggatttccgagcctgggaaccccggcgtctgtccggtgtccccgcagcctcacccgtgctggcccagcccccgcgagttcgggacccggggtttccggggtggcagggggttcccatgccgcctgcgaggcctcggctcgggccgctcccggaacctgcacttcaggggtcctggtccgccgcccccagcaggagcaaaacaagagcacgcgcacctgccggcccgcccgcccccttggtgccggccaatcgcgcgctcggggcggggtcgggcgcgctggaaccagagccggagccggatcccagccggagcccaagcgcagcccgcaccccgcgcagcggctgagccgggagccagcgcagcctcggccccgcagctcaagcctcgtccccgccgccgccgccgccgccgccgccgccgcccccggggcatggcctgtctgatggccgctttctcggtcggcaccgccatggtgagtgagcgcatccttcgtccgccgggaacggttttattttcaaggagagcaggaaacacacaaagactcgcaagctcgacctgacacccctcccaggagcgcgtcctctgggcgctgacccagggcaccctagagtggcgcccggctccgatcgctgcccctgcccctccgccagggccacctggagcctcgggatgccccttgcaccggcagagagcacggactaggtggaggggccgggagtggggcgggggcagcgagttgccctacaagttggaccgatggccttgacctgatggcttctgggcggggggcgtggggagctggggacccggagcgcactggggactggggaggggccgcagcttgggccggagggaagaggggacttgaagaaggggagccccgcgcgcgcggctgtgggcttggggaccggggacttctcgcgccatccccaggaacgccaggcaaggtctgggggaacaaaagaggaagctgcccccagagagccggagcctgcgactgcactcccggggacaccctctcccggacccactcggggaggcggcggcgaaggcccggggagacccgcgaggggcaagcccggattcctgccggccgcctttctgcgcgcgccggagagagagacgcggtggggacagggatgcgcatttcacttccccgagctccggagagggatggcggggtgtcggcgagttcactgctggacacagttactgtaagtgctgtttccaggggtggtcaggaatctccctttctggttttctggcattaggaacaaacaacaaaccaatcatcaggcccccagccacccacctcaccttatcctagcgcccttcatgtctacgcccagcacaccaacatcgtagaggtagctaaagtacaaatggaaagtcttccgtattccacgccgtgtatctgtgtagttactaccctgatattacttccccgaggctgtaagcccacagtgcatggcacgctccggggctcaccccgcccctcccctgtatttcatttttagcatcctgtatttgaagtcagcagggctcagcaggatttgaccgacagttacctcttgccttgagctcaagagaaaaaaaaaaaatagccaggtttctgcgcatgctccgctgtgacaactgcatcctatgattccaaacaggttactgtagaacatacggagcctcgccagctcattatataatgattttgtgtaaacgatagaatggggccgcagacatggccaggcggtgggtggaggaggggagagcccgagcgggagacccgcaggctgactcgcctctctgggctgccctgccttccctgcgtggcttctacgtagaagaggcagtgaacaaaacggaaaagccgtttccctcccggtgacacttgcttttctctggttgaatctttgggcaacacttgggaattctgccttttgcacttgttcatctattaggatttctaaatgaggttgaccatggaaaattaaggaggttattgatgttagttgcaggtagagaaagttatagatcttgtattagatgctagttaactcttgaattccttctagagctgcaaaggtggcttggtgtgggttttcctataatggacatgtggaaaaataatgaatccgatgttttaaggtacagatttttaataccaagtttttaaaaaatgttatattatcatttgataatatgcccccggagctcaactgtcttgttatcacgtggagacagtaacggctgggctcattgttttggagaacattattttattttgaaaattattttcctctctgaaaactgggtactttaaaaaaagtttaaacatttctattcatgcacagctgtcccaccctgaaagcaataatctgatggtagaagctaagcagagttaggccccggctagtccttgaatgagagaccacctgggaattctgggggctgtagggttaaaagaaaaataaattaaaaataaaataaattctggccaagtcataaacaaagagcccttcagagataccaggatcttaagctttgcttttccttcacctccctgccctggggtccatcctggtgtggaccctctgagctgtgagtcaaaggaggtacttgggggtgagccaggcactcgggggaacatgctggagcccctgagttcggtgggcatacaaggggtggcaaatgcgtccagtgggagggtggtatttggaggtgttctgggattccaagtgacccctcaagtgcggtctggtctctggctcagttcagggtatgatgcctttggtattttcttctgggcagtcgccttgggggctcttggtcagtgcattttcctcttatgtgcttaggatgcttaggcaggtaccaaggctggcagcagtgaaccaaagagagaagacagacagctgcgtgctaactgtgctgctgactggctcctcctcctgtttcctgacttcctcctaatgctaggagaaaaagtttctgtctctgtgttcctggtggaaatggagtgaatgcggctcaccacggcctgtgggtggcttactgactgctacagaccctccccagctaaacaggcatctctatctgcccaggattcaaactgcaatcacaggccactctgctcagcgcccaggaaaatattcccatgaacagcagccaggaacaatccaaacagggtctctttggcattccacatctatgaatgaacttactatgacgtacaatgtattgtgcagcacaaatcgtatgtggcccggtgcgggggtgggggaaggtcaaagacaatgcttcagtaggatagggaaacagaagagtgaaaggaaaaaatgaagagagaagatgcatgtgttttaattttaatgagctcaggaggctaaggagaaactcgctgtaacctacattgccggcagctctcatcggaggatgtgtttccagagagctggtctatttcagactgacaggccactgcctcgcatcacgcagttttcacgatcctattaattgggtgaggctgttagacgctgtggaggaaaggtggtcaactgtatgcattgctttgctgttggcttatttggggatggggctgtatgatttccttggtgtggattttcctataatggacaagggctgaaagatgccgaaacacccacaactcacccgtggaaggctaagcaatagtcaagggccgttacagaggcttgtggtctcagacctggaagcctctcagagcagggccccagcctggccacgccctaatcatggggtcttaagcaattcagaccatgtctctgtgcttccgatacctcctccgaactggagatggtcatcccacctcccagcacccctgtccctgttagggttgtggaggtaataagaggcataaactatataggttagagtttaatagtcacatggtaattgctggatcaataaacactattgtttataatcacttacctagcatgcacaagccattattatttaatactttacattgcaagtacttgattctggcttctctctttcttactcccaaatcagtttagtcacccagttttatcctcctggcctgtcccctttccttcacccccactaccaacagcagatccaggccaccatcaccccacctggctcacagcaggagactcttctgcagttctggtcctgttattccctcggggctccccaaagatctctagataaaatgcaaaacccgtaaccaagttggcaagcccttccccatggggaccttgtttgcccctctagtctcatcttattctaaagccccctactctcctgccccgaccctaccagcccaaatccacgctccagcccctgcgtttcttacaggtctctgaacgcttcactgtctcatgctggtgggactttgtctatgctgttccctagcagaggccaccaggagccagcactcctccatgtcaccttgctaaactcaactaagattctatttctgcagaaagatttcgtcctgcgtctccccatctcagggtctgtgttgcgttagatatcccttctgagttacccatagtatgctttccgcctggctcttggcttgacctattgtaattagttggtcttcctcaaaatgaaagaagcagatcataggcacacatggggaaaaggcacccaccaagagtcctcaaggcgacggcccagaggaaaataaccaaagcatcaagaagcacagctgagcttctcaacaatctggaggcacttatgctttcctcctggctcttgccttaacctattgtaatgagttgcctgttttcttgcctggggccagatcttgaacttgagcttgccaggtcaggggccatgtctgcctggctaattgctgaccccagggctttatctggtgctcagtttgtccagtgaatgagtgagtgagacagtgagtgagtgagcagatagtgagtctagcagagaaagtcagggtctcatgataatgtagatgggtggtgtggtggccattcaccctgtattagtgtgggcttcagccacaagaaagaagcatctgtccctgggcttcagcaggggcctcacacctgcaatgggtgcctggggagagggtgcagatgttgcgtggcagctggcctcctggggtggaggtggagaggacccacaatgggagagaagttgctcgagcaccctaggacttaccctcaactgcacacacagccatcgggggtcacgtggcagagcccacatctgccagcaggattgggtagaacccagcgcgttctgtgtctttatttgtgtggcaaggtggggatggaaatggacacagggaaccagacctagagcgcattgtcttgtcccacagctttgttgacatcccccctccaaagcccagatttggtgtttttggggctcttttggaatcaaagtgagctctaaacacctggggcagcagcatgggatcccagagggcaggctgaggggcatggcgtagcagctcctccaagaggccctgccacaggggcattgggaccagctgggaggaggcttcggggtcgctcccttggagtctgcatcttatcatcacaccagacccctaaggaaggcggatcccttgtcagacacacatacaccctcccagctctgctcgggaatgcggggaacccacttacgctggcatccaagacaccccacatgcccgggaccagcagaccaagctcagctttgtcagagtttcacttggcacctttagttttagccacacaatattatagtgcaggagctaagttttgatttcatgaaggacttcagaggtagaagatgcctggaaggggtgtgtgtgtgcttttggcactgtgagatgttctctctcgatttggaagacagcaagaaaaagcacagcaatttgctcccccagggttcttctgtgttttgaaggtacctgaagcttattgatttgctcacggttgccaggccattgaaaaagggtatttctttctttgcataggtacttctgggttcttggcaatcagttacagttcgtttgactcccaatggaagctttaaaagccaatggtagctacaaaagattaggtattctcttgatgcagtgaaatgaacacctatcttttttttttttttatgactcaaattctgggataacttctgctactcacttgattgtgagacctggaacacggtccttaaattgtctatatctcagtttccttgtttgtctaacatattaaaaaatgttaaccattccaacttttcagcactattatgaagaggtagcaagagagtagaattgtaagtgatttggaaattttaaatgcaaaatacaaaggccaatccccacaaaactcagcagctcaggtgatgtcattgctcctgagacatttttatgagattacgcgagaaaggcacaaaacagctcagtgtaaatataagtttctcggttttttatttcttaggcacctggtgtgtctttattgaggtttttaaaatgaggggactgtaaatagatcgatgcctatggtggccagtgttttcttctttgaggcaagtgatgattcatggattatagttttatgattagattttatgattccaaagtaagacttgtagatcagtgtaacactttaccttaagcattttttaatagaagaaaatgtgacggagatgacaaattcctctaggtgggcacatttctcctggggccaaaggtgctcctgcagtggaagaagtgttgctattaataaccaatgaccctgagcctcatggtgaatctcttcatgttctttttcttgatgcagcttataacaggtcttgttgcttcctctggtttttctagaatgccagcagttactctgcagagatgacggagcccaagtcggtgtgtgtctcggtggatgaggtggtgtccagcaacatggaggccactgagacggacctgctgaatggacatctgaaaaaagtagataataacctcacggaagcccagcgcttctcctccttgcctcggagggcagctgtgaacattgaattcagggacctttcctattcggttcctgaaggaccctggtggaggaagaaaggtagggagggcggctgctttgtgtatcaagctgggaggagcctctgaaggaggcaacaggttgtttgggcaaaatcggggtctggaggttgagaggctgagcttctcttcccaacgccgtcactgctgtggtcaatttattctattgctttctgcctgaattttcctctcctataaaatgaacaggttggatttggtgatctcaaagttcatggttgctctgaaattctgcgatgtcattatggagaatttcacaaagattgacgggtgtcaaagtgtgcctgtttctggcatgtgctgagagagtcctcttttgtggatgctgttcatgtccatctttcaagatggaactgtttttcaaccgcccagagcaaaatgggggacaggtgcccccctcccaagcgtgaagtgttaaaaagtggccagtgacctagactgacctctccagagacccatcttgaaaggattcttttgtgggtggttgtggtaggctagaaagaaaactaaactgttgaaaagagctgatacataaaaatagaaaaaacagagaggatagagctcaggaggtgtctggaacgccacacagtgcaggagtttgccactagcttgttgcatgttacaggaaattgatgagtggtagtttgagttttctcagcaaccttccctagctctagagtttcacagtttgtggagttaatgccgccctgggttggtgtgtttttttcaagcctgatctgtttcttctgtggaatttatccttcatctccttatgctccaagcactcattgtctgctcctaagtggatcagacaggtgggttgggggagctgataggcagaggacgtgtcagacttcatcaagaaaccatggtccctagtttctactgaatcatggaaagcaatttgaaaatctgggaggactttggaacaatacaaatgactcaggtacccctggaatatgctaatattttaggactttgaacttaaaactggattcagcccttctttcattttgaagaagaccaatcaagactcacgttttaaattttcagttgtctttcttcttttccctattatcttctttttgtttttctaccctcttgaagctaagtctttgagacccttagcatgggcagtcccatcttcattgtaatcacaattttagagctttgaaagactggtccctgggatctgcaagcccagttggtggctgggtaactgtatgtctgtgtttgcacaagcagaaacagattcagtaccttctcaacagacaacagtatagcactgtgatgtgatacttgcattttcagagcataccagcctgttctgttaagaaagcagctctgtggcaggctcagatgtgggcccactcctttgatcatgttgaaatttcaacatagggttctagaattctccttctcaacttaaagaaatattttatagaaaaatgtatcaagaaaccaggacaccgcgtcatgttttggcgtcgtttgtctatatagacaaattatggcaaagcagtgagcaacatagagcgattcctgtccgtctgttatgtgtggccttggaaatgttgtcatgacagtagaaaatgctgggaaaggtgtcttgtaaaatgaagatgggttgtaatgcagaaatgaagacatctgaaacctggtggcatctgggtttgaaatgtcttggcataagcctggcacacaggtgtagccagtgtttgcaagcagtgagtatcgctcccctacccagtgtgtttgtccattttcacactgctataaagaactacctgagactgggtcatttttaaaggaaagaggtttaattggctcacagtttggcatggttggggagggctcaggaaacttacaatcatggcagaaggtgaaggggaagcaaggcatgtcttacatggtggcatggggtgaggggagagagagagagagagcataaaagaacccacacacatttagaacattagatctcatgagaactccctcactatcatgagaacagcatgagggaaccgcccccaggatccaatcacacctctcgcccagtccctcccttgacacgtggggattacaattcaagatgagatttgggtggggacacagagccaaaccacatcacccagtatgtgacttgtcacccctatattctctaagtgtttaaactgatcacatgaatcatcacagttagccagctggtaatggcttgtagtgagggaggagccccaactgtccattcttaggagcgcagcccgggcggggtggccaccagatagagacttgccctacagtaaccttgtgtgctcaggcaggggaagagcctgcaatgggccgccgagggacctgcccatgactcagaaatgggtggagccagaggggttgacagacaggatatgtctgctgtgttccagctgctggtttctgcaggggccaagggtagttttgctgtctggcttcctacccactgccctccccagccacagcagcacctgcgtctgtcttccctctccctgctcctcctcccctgcctgccccatcctttcctttgttcctggtgcctacaattcagagtctagatggtttatcactccagcacacagaatagaaaggaaactgagacaaaggtggttaagggacttgcccatgctcctgggcttgaaaggggcagggctgggatgaggacagcaatttctagctctgtgcactccgacacagtggccatgccttgtctagcacagggccttatggggtgccagggtccatgtagccagcagggaagcagagctcttcctggaggctctggtgcccacaggatttcctgctgttggtggttcagttgccactgctgaagagtttttcctgccaaagggtgctagctgcagaagccctctctgtgcccactgttgtcccaacaccagcctgttcttgggtgctgcgtccagttggctccaaacttgggtaccatatttccccaaccaaaagccaggacaatcaataacagtgcgcattaaatgcggatcttgtgttggggctgcaggaggagctgcatcccactggacctcacccacacgggtcgccaccctcctggtccgcctctgcgcctgctggtccaccaagtcggcctcttttgcccctcccatgcatgggttcctcctgctcctgcttttgtccctccaattgctggcggtggtctcagtccccagccatgattaggttaggctgagaagtcagagcccagcctcactctgcatttctctcttctcacagtggcggagtttgtatttggcatcatctctgtgcgactccaagtgtgacgttgggtcaggggctacttctctgactgctctcagtatattcattttgctgtctgtatcaagtccattgttttcaacttttaaaaattcagtttgatgcattgagctaattgtaatgatcacgcggaggctggatgtcctggcattgctggggaggtgtctccgaaggtaagaagtgaagcagttttgaaagtgcctggttctggccgggcacagtggctcacgcctgtaatcccagcactttgggaggctgaggcaggtggatcacgaggtcaggagttcgagaccagcctggccaacatagtgaaaccctgtctctagtagaaatacaaaaaaaatagccaagcgtggtggcgagtgcctgtaatcccagctactcgggaggctgaagcaggagaattgcttgaatccaggaggcagaggttgcagtgagtcgggatcgtaccattgtactccagcccaggtgacagtgtgagactctgtctcaaaaaaaaaacacaaaaacaaaagaaagaaagaaagaaagtgcctggtcccatggttcacagtagggcaaaggaaacaggagctcgggcgcagagctgattcactcaaaggcagagccagggctaggacccagctattctgactccaagttccttcccattacaaagacactggaccactccggttgtttccaggaaagactttttctcacatgatttcccccaaaacatggtgctgcgatacaaacgcaacatacaacgccctagcaaagctgagcattgtgaccagaataactttatgaagtcctacgtaattattttaaagaaggagaacttcacaatccttacaagaaaggcgatgcgggaaacagtagcggcatttttaagaagagatgccaggcactgattctgtaaaacttttgagcttgacagttactaagcgttgaatatggcattttaacaaaacatcttgtattttcaattgtagttacattttcaccatatgactaatgatgtctttggagggaaaactagatcatataatagattcctagcagaaaacataattgtgagaggaactattctcaggagagaggagtacaccccaaggataatttccccggcctcagatacagtaattactctccctcaaggaattcactcacgtagcttgtgttgatgggacaaatggctcggaacaatatcagctttggtgctgtcacacaaactgcgctggggacagatcagagtgatctggtttatttgttcctcctcacccttaggtgtgactcttttgaaagcagccttttcttcctacagagtagacactatgttgagaacatttaggaatgtggttaagagtaagttcacagaataaaattcttcttaggtaaagatgatggggatgagcagattttatcgtaagctgctttcagagcccattcacacaagggtctcattttattagggcgtgattggccacagtgaacaaatggaatgcttgggtactcgtacactgcccatcccccaggagatcccggcggttcccacgcgtagttgactgaatgatagccgttcttcaatccatttggctcatggggccgattcaggaaggatctgcacattcttcctgtggaaacctgtgacatgaggctcagagacgtgaccaaggtcataggagtggggaggaaggaactcagaaccaggtctgtgggatttcaggccaaaaaggagcgtagcaagtgcttagctctgacgtgggcacaggactggaccaccaaggcacagctgtgcctagccccgtgttatgaaatggtgtggggttgccttggctgtaaactgatgtattttccttttaattggcctgcttggatgtcagcggccattggccatttatagggatttcctgtccctctggagaggctccagcttccctcttctcaccaggaaggggaggctgatgtgcatggcgtgctttctctccaacaggtgaagcgattctcagaaatcaaatttacctcccaagattaccttgaggcgaagttcaggttgagaacaaatgtagtcatatctggggctttagagcgttttctttcctatctgcagtcaggccgtggcctccacatggtgacgctctgatggaatggaatgtcgcctccttctttgaaacccaaccctccaggctcatccttgccaaaaaccaggaaggggttaaatattccgggcagcgccaagtcagattatctgtattggtttgcttctacgctataaaaatgcatttggacacctttctcaaattcggggttgctttctcttaatttctatagccatttcacaaggcctgtaatgacaggccagctaaagtgcatggaaggcatcatgaataaatcctttcaggaattccattaagggaagactggattccaaccaagtgctagtgacttgatccaacctgctagaacagggaggggaggcagcccggttaaaggcagagtgtggagatcctgtggctaggggttttgagaggggcagatgctcaggctgaagggggatggatagttccctagcataagtgagttacttttgtgcttctttgaggctgttgtgctaaagtgggctttcttgtgggcccacaggacatttcttttagtcctttgcctttaatggaggtgacagctgacccctggtgcagtgtcgtggccccaggccacttgcagggatggcttgcttgaggctggggcattgacaaagagtctgccttggagaattcagaggactggagaacccttctcttccccgctggggccagttcctaggttctcagtggcccccaggtgggtgggctaccactcaggccctgaggggtagcactcctttggtgatgaggtcttctggaacagttctgacccctctgccttacagggccccaaagaggctttgaaaaaattttgagaatggaccaactctcacagcagattcatgagagttgaatgtttagccgccatgtgcaagaccaaaggggtttgctactttcttggacaggcttcatatccaaggggtctagatgctcccctccagccagcacattttctccctgtgagcacgttgcaagggaaaccaaaccctcaccagcttgggcctgggatctgggtgtgtgactccttagtgtggcgttgttagcggtggcagcctccctggacaaggctcagatggctctgccaacattggccttggggtctgcttttctctttgccaccctcagattggcaggttctttatttggacatgttaatactttgtcattttcccagagagtgctcctgttcttgaaccatctggccccttcagtgcaactctgtaggactgtgctctgctccgtgggggttggtgtcactgtttaactgctggaggatgttcttaccacaatcgttttcacctgcatggtgggtgcccccctgccttcctctactgccttgaataggcttgtatcttgaaaagttcacgttctcaaatggaggccctccctataaaccagaacctaatccaccagtccaagaaatcaccaaaggtgacattttgctgaacatgacaccgtttcttttgtttataaattggcaggaagaaaaatgtttagtaaccatacacctgctctttctgagttcagttctagaatcaacagattagctatgaacaaagaaaaccatgtgggtcagattaaatatatcctgaaggactaaaccgtaaaactagggatttgtcatggaggtgcattcatcaaactcagttgatgaagttccaacacctgcataggaaacttactctcaaatacaatgtacccagtgccgactgtttttgctcacattgtgaaaaaacgcaaaaagatgggttttcagtcatgagtggtggcgggtgggcctgcagggatccagtctgacctgcagccaagagtttcacttcccactttgtcagctgtgtgctgtttgtcacctccgtgctctgtggggtaaatggcatttggtgtcaaaagtaagacacaccagggtgacttcagggctgtgattacatccagctgagacctatatttagagtccaaatcttggagccaaaaggagtcgtgctgccgtagcccgccctcctgccccgtggagggagccttcttgcaccatttctgacaagggacagccagcttctgtctgagcacttccagcaaccaggaactgacacctcccaggcagccgggctatgtttgcacaaccctcattcttagaaaatgcttctgtctgttgagctgcaatctgtatttgagcaatgttcatttgtggatccaggttctgttttttgaaactccgtagaccaagttaatcttggtcttgaaataagctcacaaatcaaggggaaaagcccagccaagtacagaacaataaccaaatacattacaatccagagctaccttgagaggaggaaataagaagcacatggcccttgcaggaaatgaggtcagagtcctgctttgggaggtgggcatcactgcggcatccgcagggtgcaggtcagtgggcaggcgcccctgctggaaggttcttgctgtctgtaaactgataagggtggaacccgctggaagggcagaacctgagtcacgttctttctgtttcttttactgttataaggcaacttggtgccttccaaccaaaaaagtccccctctctgatatctcaactgcctgtcttgaaagtgaaccttttggcaggagtttttatgggatttctcagttgttatttctctcctcccactgttttgggagaagtgtttttttttgttgttgttgttttaattaaaaataactggtgtttactgagcaaatcgtgtttgctttatttggcgctttgcctcattaagcctttggggagcagcatgggacacacatcagtatgggcatcttctccagaagggaaggagggtggagggggaacgagggcctgcccaggaccgctggcaggtagggggcaggtccaggactggacttaacacctggagtcccaactccctgcctctataagcgccactgagaactcatctctttgcaatcgctcagacccagataataaaataagctgggttgagttttccttacccaagacataaaccccaaaccctgctgacaatgaggagctacaaaaggcctctcctcctcctggggcacgtgttccgggaattctttcatggatgcaggtatgggggcatctttggcctctgtcctttgtctggagctccccgcacctggctgggggctgcactggacacctctgcccaccctggccctggggttatcaggccacctggcctccacccagacgttccctcccagggcgggattcatcctggcccgtggtgatgtgcaggctcccggaaggccgggctctgcccactaagtgtcagctctaacgcaggctctccatactgagtaaaaaagcccgtcctttctctggctggtgcaggtgctgactctgcaggcctgtggacgcagggtgacgttcgcgctcttgcccgagctcaacgcccgggagaaaacagcgctgccggagcccctcgcgcgcgcaggtgcgggcggggcgggtgcgcgctgccgcgcgtgtgcagcgcccgcccatccgccgccaccgcccgcgccggggttactaccggtcaacgctcgctagtaacctccgcggcggagcggcggcgcggggagcggcgcgattggctgcgggcgccccgcgctgttgccaagcgcgaggaggcagctgcagccccgagcggggtcgcagcctccctgggacaggggcggccctatgcataggggatcacccgggccatgcaaatcccggcgccccgcgcgtgctggtgttctcctccccaggtccaggaacaccggtccaggaagcctgagagcgctggcagtaggaagggtcgccagtgtggacctgagggtggaggtgttgccacccggggcggcctgcgctccattcaggcttgagcggtgactgggagaccccgggaatggaaatggcgctcaaatgctggtgtggtgtccgcaggggaacggcccgcgggtgtgtggagtctgcgcccctgtggcttcagctgcgtcgggggactgcgggaatcttccagactccagtttaaatcagagaggtgtgtccacgaaaagagtcaaactaaaacatttaaagagatttatcctgagtgaccatggcccgtgacacagcctcaggagaccaggagaacacgtgcccaaaggggtcgggaacagcttggtttcatacttttagggagacgtaagacagtgatcaatatttaagatgtacattggttccgtctagaaaggtgggacagcccaaagggggacttccaggttataggtaaatttaaatttttttctaattggttaagttattatcgatagaaagggatgtctgggttacgatacggggctgtggggacctaggttgtatcatgcggatgaggcctccaggcagcaggcttgagagagaacagactgtaaatgcttcgtatcagacttaaggtctgtgttgatgttaatgttacaggctacgataaggcatgtcagacggaccgccacttcccgtcatggcctgaaccagtctttcaggggaaattttagagtgccctggccaaggagggagtccatccccatggttcagggggcctttgaattttatttttgatttacaggtctttacttcaggtggcacaattttcctaggagacagttgatttttgattccttataaaacgtgctggttttgtttttagctgacagtgtggggtgaagctgtaagggagccagggcctcctggggttgatccaagcatgtctgagccttctctggggtcagcactgaaaagtggccagggtggggtttggaaccttggaattgcccttgggaatctgcagcgttggctccgctaagccggctggaatccggagatcatgcggcaaggtcacgcttcccggctgcctgccgagtcacttctaccctaggcaggttagaggcaaggacagatgacagctgaactttacggagtgttttccagggcatctattacagttttgtgtgtgtgaacccaaaagtgtgataacaaacatcatttccatcagctgtactgtgtttgagtatccgcaaggcctggggccacctcagtggagtcggaggtgccacgctttgctgtctctggagaccagggccttctctagacacccggcgggactagttcctttgggcataatttaggtgttttgtgaaatgttaaacattgtctttcagacgctttgctcaaccttttgggctcctgaccaaatgcaaagagacccaagggcttgcttttccttgcactcttgggttttcattgcctgcttgcttatttgattttgtgactgtggagctggcatttctgtaagcccatatagaaattacagtttccaagcctaaacccactaagccaacaggggcacacaggaaaccagagatggtggtggatgaaaacctttgcaacaagaaggaagggtacatctatgataactatggtgttacattactaaaaacagtaaggatgagtgtcactaacatgagaatgtactctacacaaaagtctggtgaaaaagggaggagccctttcactaagtttcatatttatcagcactcacgttaagaattacagcagaagctgcaggtttcctgtttctgaagacctgcgaatgagtttgtccagaaaatggccgtgtcctgaatggtgtgagcaggaggccatccagccttgtgcctctaggcctcctccccttcagttgtcataaatgtgccatgtgcccctgcccaaacccagcagcctttctctgaatttcatctggtttagagaggaaaatgggcagcatcattttgtcaccttctctcttcccaggggcgttctgtgcttcttgagaactatacctcaatatctgagttggctaagtctctagaatatgaatttcaaagagcttagcctggccagcagggctctcttggagccctttttctctcccagccctgcgtctccgcagccactccccatgggctagccaggctgaactgccagtcattctagcatttgtgctttctttgggccactctctctaccaagaacccacctcatctccccaggctaggggaagccttccttcattcacccttaaccctgtggccaggagagtctttcttggttactcttcgtactcctctgcccctacgatcatgggattatggcactcagcatgggattttgtgcttctcttctgagcttccaaaattacccctgcgtctcagctgcccagccagtgcctggctcagagctggcatgcaaatgaatgaatggaatcacaaaaagctaaatcacagtagaagagcctatacttttaccctcaaagacagcttggtagagaggagaagtagagaggaaaaccaagagccttgagatgctgggctgttttgatcttcccttgctgtgtcaaacccatgagccacctctgactaagcttcacgcaggtggtttctgagggctgtttctttggccgcacagcaccgtggatggacagaggggtggctggggaatggtaagagcctggattctgggtcaagcagcctactcttgaatgccagctccacctcttcttaaccatgtgaccctgggcctcagtttttgcatctgcagaacagggctgatccaagtgccaaactcaggattggagtgaggaatagcagaggtcatcactacagccagggctggcacacaatagtgctcaaggtattttaatgttacaggtcaaattttgctaaaaattgattttcgtgttcctggtttcatgaaggcaaatactcctctttctaataataatagtattagcttggtatttattagtctgtgagcagtaacttactctgtcttcacagcaaccctgcggtcaggttttctacccattctttttgagggaggaagatgctgtggccggaagcagtgagggcctttgcttgggcatcacagagagtgccatctcttacacaaaatggggatttcgaatctcaacactctgagctctgtgctttcccccaagacaggctacatgctccctggagttgtcctccaagagaatctttgtatggttccttttctgagacttctggtttcttcctcatggctcatattatgactaatttcagacgcgttaaatccctctatcttgagacttgtgtacttgcgtgtacaagacaggtaacagtcttattatttctgagagatctctcaagtactttcagatcgctggatgacaagctttgcatctttgaactatttatatttcagtatctacatttgtgagttactggatggaaatttccaccattcaaacaaagcttggcaagcaacattacacttcagaatttggctcacgggcgaggttgatgcaggttatcttaggaggatgtgagatgttatcagctcctgcgtgttttagtcttgtggctagatggtcatgactgaaaattgaggatgttgtgcccactgctctggttggcagctcgtggcagggagaggtggcagcagctctggggttggtgggagccacagtctcacacctattggcaggtcgtgaacattgttcttggatttgcaaatatttaatgtaaatccattaatgttgtagctttatagaaaatgcacttactctcctttgtggtaattctaaattaatatgtaacaaggaggttaagatgaattgaactatatgtggagcttagttaaaattttctttctcccgctatttctttcaaaaaaatgattccaggtgtagtacttgttagcaaaatgccctcagtaaaggaggaggcagtataggatagagctcaggaatgtgggctccacagtaagagagtctgggttcagaattggctccaccgcctactagcagggcaactgggtgacttacccctcctgtgaaaaggaaatattaataataaaaatatccatcttattagatcaaatagcttgatacctgtgaagcactgtgaccagcttgtggcacttaataaaccatggctacccttcttatatgtgatgtaataaaatcataatagcttagaatcactaagatggatcaaagccttttagttctcattctaaatgtgaagtgtggcttgataccttaggctttagaaatgaaagggaaagagcaagggtatagttggtggccactgttgatttagtgtttcctaggcgccgggcagtgtgctcagagcctcacacctatgtgctcccatgagcctcattgctgccctttgagagtggaggggcaaggggaggtgtaggggcctggtccggggtcacagggctgtaagtagcagagccaagaggtgacccaggtagctgcttccagagccccacactggtcccctggctgggctacatcttacctttgtgtgtctttggtgacccatgctcctagagccagcttccggttggggcagaagaccgtccggggcctggcccctggctaatacgatggctactgctcatctgctctgtgtcgtagatgctcacatcacttgggtgatgagcctttgtcacgtggcctctgcagaatcagctagctgggcaaggggcctaagctccggaaggttcccctttggtcatttttgggtgtctggtgattgccaggcttccagtatctcaccactcaaattagagccccagaaagggagcatggtgtcatttcatcccctgggccgtggttgtgggagcccatggtgccttctgcagggcactggagaacgctgtgtgtgctcatcttgggacaggcaggagaggagggcaggtggcaggatgagggcggctgtagcctgcaggtcacacagtgttatgccagaccacggtgcctgccacgctgggtctccaacggccacacgaggcactgcttccatgttatcagtgaggaaactgtggcctggagacaggtgggcgatgagttcaagttcctgctgccaacaggtggaccccaggaccaagcctagcccagttgacccctggctcctcctgtttgctctttgagatcatatgaaacagccagtgactgcctagggccatggcccttttcagtgaacttgaaacattaaaatgtttactgccttcacacttatggcttaaaaagttgtttggtttgtgttttctttgagatggagtctcgctttgtcacccagtctggagtgcagtagcgcaatctcagctcactgcaacctccgcctcacagattcaagtgattcttctgcctcagcctcccacgtagctgggattacaggcgcccatcacacccggctaatttttgtgtttttagtagagatggggtttcgccatgttggccaggccggtctcgaactgctgacctcaggtgatccacccgccttggcctcccaaaatgctgggattacaggcgtgagccaccgcacccagccagaaagttaattttaatgagaatgaagccgcatcattgaaaagtctgatgagcttgggagttgtctaatggtggaggctgccagccaggtctcatgacctggaccagattaagccctactgtccatcttcagggagagtaaacagcgtgaccagcacgggccacgcttgctcacacccaccagatgtgcgttcccgcaccacccaggggaccgagggcacaggtggggagttaggagggaattcagggcatgggcagaccctctgaaggaatccaggaggcttgggatctggaatggacactctgggctgacagtcaacagtcctggtgaatagcatgttggtctctgggactcttatccttctgactttcacagacacgtagtgagagcactggccacgttcagacgtgactgcctgtcaggattctgacggaggtgaccctggctgggccaccagctttcagcatccatttatcgtaaaagccaagtgcacagtggagatgcttttctccccacaacatccgtgagctcatcataaacagaaacggggaaattcatcagagtgtgtttctgtgaggagttaaaaaatccacagggcagtaatcccagcactttgggaggctgaggcgggtgaattacttgaggtcaggagtttgagactagcctggccaacatggtgaaaccccatctctactaaaaatacaaaaattagctgggcatgatggtacacgcctgtagtcccagctactcaggaggccgaggcacaagaatcacttgaacccgagaggcagaggttgcagtgagctgagatcgcaccactgcactccagcctgagtgacagagtgagaccctgtctcaaaaaaaaaaaataacaaaaaaaaaacaaaacccaaaatccctaaggtgtttataattttatactgtttcctaagggattctcttgcattaaaaatgccctgctgggtgcagtagctcacacctgtaattccagcaccttgtggggctgaggtgggaggattgcttgagagcaggaggtcgagaccagcctgggcatcagagaccctatctctattaaaaaaaaaaaaaagccaggcatggggcatgcctgtggccccagttacttgggaggctgaggtgggaggatcacttgaggccaggaggttgaggctgcagtgagtcattatcacaccactgcactccagcctggacaacagagcaagaccctgtctcaaaaaaaaaaaaaaaaaaagaactccccatggtgtttttggttacttgttttacaaatatgcctgccattgaaagcacaaaacagtgaaatccctttctaaagtatatggggccagccacaaagtagactccagtacattttattttaagcaaagttacaaagcacatgcagttcttactactgtattttgattttctgagtttcctttaggaaatattggctttttaaaaagactatacaatgggcctggcacagtggctcaggcctataaccccagtgctttgggaggccaaggcaggaggactgcttgtgcccaggagtccaaggccagcctcagcaacatagcgagacgctgtctctacagaaaataagatgagcagagcatagtagtgtgcacctgtagtcccagctactgaggaggctgagcggggagggttgcttgaggctaggagttcaaggctgcagtaagctatgatagcactgctgcatactccagcctgggtgacagcagagaccctgtccctaaaaacaaaacaacacaaaaactcaaactgcacaatgagagaggaggagggagctgtattatagatgtgtggtacctggaaccaagtggtgacgctgaggagggcggaaggagcatgatgagaggtggctgggtgacttggctgctggagaacgctggccattagggcacattcattctgttccggctcttgtgttatttcacactttccacatcccagtcctttagagccgaccatgaaccggggcagtgaaccatatcgttgtttgttgtgttttttggtttttgtgacttcagaggctgaagtgcaatgaggcaatcaagcgagctccaccatggccctgagggcttgtgaaaatgcaggtggctgggctgcacccccgggggtctgagtgagcaggtttggggcaggcagggttccgtgtctgataagtatggggcgatgctgctgttgctggtccagggatcccactttgagaactgctgaattagagtaaagaggagttgatggccatgtgggagccaccctgagccctgggaaaactggagcaggaggtggcatcacccacacttgcaccacaggcaggagtgagggccctgctctcccatggtcaggcagcctcagcatctcaccactccctggccttcaaagtcagctttccttgtgaacctgggtggtcagagatgcagacagcagggccaggtggtgtctcacgagtcgcactatgaatgtggggagcccgtcggcccctccctctgcagggaggagagttaaagctcatgtcctccagggtaccttcctcgggggtggtggactgctgcacgccagggaacagggcagaagtgcctggattcagcaatttatattattatttaagagagagcagattttatttttatcttaatctgtttcacagaaccatattttaataccgtgtgtgtgcgcgtgtgtgtgtgtgtgtgtgtgtgtgtgtgtgtgtgtgtgtgtgcgctggtttataatatcacctgggcgggataaagaagattaggttcctttctgcttatttgtaaaacctgttcaagctgcagtaagattgtcatgatctccatcatcatctgatttatcccccagccagttcctctgtaaaatctggaaagacagtagttgctgaggggctgcaacagaggattggcgtgagagtggagaggtttttgcaggattcccggcgccctgtccagacagcggtggtggagagaagcaaagagaagtgcagtttctatctaaactagtaattttctttcctcttctgtaagccctctttatctttggcttttttttttttttttttttttgagacggagtctcactctgtcgcccaggctggagtgcagtggtgcgatctcggctcactgcaagctccgcctcccgggttcacgccattctcctgcctcagcctcccgaatagctgggactacaggcgcccgccaccacgcccggctaattttttgtattttttagtaaagacggggtttcaccatgttaaccaggatggtctcaatctcctgacctcgtgatccgcccatctcggcctcccaaagtgctgggattacaggcgtgagcccccacgcccggcctatctttggctttaaaaaaatgttttaaattgctcttttcttgctaaaacatcactgtaagtgataaaattatttgcagaggctggaacatgaggttagctgggggtggagagggcatcctaggagtggacatgggagctcacagggattcaggagggcatccagaccctgaacttccttcgtcccctcccagtgcaaggttctgacaagagcctgcctgagcccttctctcagtatttagtaacactcgatcctaacagaagaaggtcggccatttccaccgtcctctgtgccagctctcaggaccagattagaaacacagttaacacagccattgccttgccaataaattgataaagctaaaagacttcaaaagcttctcttctgcactgcatttcctaaagtctaatttacagtcttgtcttactttgcaattcccactcttttttttggtgaagaaattgagcttttcctcatctaaaatcacggcagattttgagttgcaaggatcacaattagtgaattttaaaaattatacctggaacaggcacatggcagtggtcgtctgagaatgagctgggaggtgtgaaaccttcttgccactgacactcaaggacagggctgtttacatgacatccatttccaagccacagaaagcttgggaacacccacttagagctgagagtgaccttccctatgggagaggcacacttacaaagggaacgaccgtaggcaggtgaaatccccaccttgctgttggaacccgagcttcagagagggctgttgacttggctggagccatccgtggaaggggtgcattgaaaccacaggtgagaactccatgtgggaatccaccaccctctgagaacgaccctcaggaagaggacctccttccccagtcatgtcccagctctgcccccacgcgctccacgagctcaggcctgcagtgggagctgagcgtctggagtgaggagtggtgtttgccagaccttgtgttccctgggctgcctggaggggctcctccagtgaatctagacaccccacactttgtaccagggagtggaaagggtgatatgaacttctgcatccgaggacttctgaaaagccacagatggaagaaccaaagaaaacaggatttacttagaaggttgagcctctccactggctcgcatataggtctaacttacaaggaacctgttgggttgtggtttttgtagttataaaaattattaaggaaccagaaaattgcattcttctccaattggttttaggcattcagtccagatacaaggattatgaaacttaaaaagcagcatcttaagcccggcttaaccccaaacaacatcttaaccccagtgaagtgttcttgaagggtgggtgcggccacacatcctgcaatccagtgcagaccagatggcctccctggccaaccacggggacaggaagaagaaggacagaggacacaggagagacaggactgagctgggttcccatgtggtgtgagggaggcagggaatggcccagaaggctggatctgcaaacaggagtcgcatcagagacagagaagagagcacagctcaaggctgagataagaccaggagaactggggctgtatttccttatctattcctgagatccatgctttctgaaaatcatctgcacatctaagcatcttggcacaactccgatgaggaggggatggggcaccaggcagcagactctgatgaggaggggagggggcaccaggcagcagactctgatgaggaggagacagggcaccaggcagcagaaagtgctgactcagcagcacaagaccacatggccggcttcccttcttcctcggaatggcctggaattcgatcaagaacagcagccccaggagcatcctagagaggtgggggcaggcgggggacatggtgagggagggagtggcaactctgggcaggtggcaagagccagctgatgagtacagggagggagttcccttctccacccatccacactgacatctggggaactcatttaagctacagatgccagcttttggatttgcagaacggtgcagtgactgaattcgccatccaaacacttagaagaataaatgcaccagtttctacagaggctgtagatataaagccatttctcaagaggaatgatagttgtcactggatataggatagctttgaaaaggaaagattatggagatatttgtcacctctttaagatactggcaaaacaataaagctgttctaataatttacctgttaataaatattttcataaaataatctcagtccatgtgcaaaaataataaacaatgctgctttgctctgatggctaaaagaaagagattctcagttccagcttttcctcactgacgtaaagggatgggatatcatttcatgagcttttaagtttcttcatcatttttcctttcagaaagtaacaaatgtaatttcaagatacaatggcgtatgtgtatatatatgaatatgtatgtattgatgcttctatacataaagacacatgtatgattatattttaatgagagcactttttttaagtcaggaaaagaccttaaagattcatatagtccacgctccacatttcatagattagaaacccaaggcgcaggctgagatttttagtttaaaataaaccagtttttgagatgaaattctggtactgccacatctaaatttgaatcttatatgcctgtatttatttgttctgagcaagaaggtttgattccatcattaattaaaaagtctcaggcaaccagactgggataagtttttaaaagaaaaaaaaatcctacaattaaaatgaagccacaagacttagaatttgaccgtgattttaaaactattctaaagaaactttgttttacttcaagttagacgtgactgtctaaggtaaggtatatgaactattataaacttcccagaaacaatttctagctggtcctctttctgtttcttggtgagtttgtgtctttctctgagtaattttcaggataaaaatatttgaaattcttttttctattttcattatggggaaaaagcatcttgtcttcattcaacaaacttttattatctgttataagcaaagtatttttgctcagtcttggggaggaaaaagtaaagatagcatgtccctcaatgagtttataattgatagggacacaaggagctctcactatcaggcaggggttatctaagacagtgaataatgcccagagaagggttataggaattggaggaggatgagaatctctggagaaatcacagcctttggaaaaggccacaaagaggggcagaacccgggggcacccggtggagaactgagcaggtgtggtgtttagaatttaggtaacgggagagtatggtgatgggcagtcttggaaatggactttctgggaagcatttgggtggagatcttggactagactggtgactatggtgtagtgggttgatggtgaccctccaaaatggtacatacatgtcccaactctcagaacctgtaaatgtgaccttattcagaaaaaggtcaatttgcagacagatgtgattaagttaaggatgtccagatggggccaccccggattaggatggattcaaaatccaaggacatgatcttacaagagaagaagagaagaaaaagtcacagagatgcaggggagaagagacagagacatgtggaggagacagccccatgaagatggaggcagccgttggagtaacacagccacagcccacagacgcctggggccagcaagagcctggagacgcaaggaaggaccctcccctggagcctccggagggagtgtggcatcgcggacatctcgattttgaacttctgccctcagaacggtgagacggcacattttgtggcattttcttggggcagcctgaggtcactaatattatacaaaagaaaaggaagcaaagatggtcatgagagagcaacgttttgaaaaagaaaagtggtaggaagcatagagaggaggataaagaagattaggtttctttctgcttatttgttaaacctgttcaagctgcagtaagattgtcatgatctccgtcgtcatctgatttatcccccagccagtttctctgtaaaatctggaaagatagtagttgctgaggggcctcattagaggattggtgtgagagtggagatgtgtctgttgcaggactcctgggacctgtccagacagcagtggtggagggaagcgaagtgaagtgcagttctgtctaaactagagaaccctggagcaaggaagactgtgaggcaccacccgtggggggtgcagggcagctgccacagacgttgtttggcttcatgaagctgagttgaagatacgcaccctctgtggcccagcattttcacttcgacctgaatacagcgctctcagcagcactgttcataacaacaacaagactggatatgacccaaatgctcattgaaagaagagtgaataaaccaggcaggtgcggtggctcacgcctgtaatctcagaactttaggaggccgaggcgggtgaattgtttgagcccaggagttcgagagcagcctgggcaacatggcgaaaccctgcctctgcaaaataaaaaaatttaaaaaattaaaaaaaaaaacacctgggcatggtggtgcacacctgtagtcccagttacttggggggctgagggaggactttttgagccagggagattgaggttgcggtgagccatgattgtgccactgcactctggcctgagtgacagagcaagacctctctcaaaaaaaaaaaaaaaaaagagcgaataaacaaactgtgatgggtccacagtggaatattatacagcccagaaaagaaatgaagcacagttacaggcatcaacaagaacagatctcatggacaagataatggagagggagaaaaagcaattcctggaacacatgcaatgtgatgccttttctaaaaacttcaaaacattcaaaagtcaccaaaattgttaaaggataaatacgaacgtggtgcaagatagagaaaaacaaggatgtaataccattcaagagagtggggacatctggtgaaggcaggggactgggatgagggaggggcgccgggcctggggtgtgttgctgagattaccgcctggctggctcgtgggcacatttatttttcattgatttattcatttatttttcttcctcacatctcacaagcaagtgatctgcacagaaagtaagtgtcatattgtgtgtggactccggagccagaccactcagtttaagttctgtttctggtcggtttcacttctgcttactagctatggttcttggggaaggttattttaggtctctggtgcctcagttttctcatctgggtgtattgaaatatggaccttgcagggttctggtgagaattaaatgagttctgtgttgagaattaagtgagttaatgtatgcgaaagcttagaatcgtgccctgcggcatagtagatctatataagcatcagctattgccatcatcagcatcatcattttgtaaatgtaaggcagtttgaaatcaaaaaagtaaaaagacggtatggagctgtaaagaagtgagagggagggccaggcgcagtggctcacacctgtaatcccggcactttgggaggctgaggcaggcagatcaccagggtcaggagtttgagaccagcctggccagcatgatgaaatcccatctctactaaaaatacaaaaattagccaggcatggtggtgcacgcctgtagtcccagctacttgggaggctgaggcaggagaatcacttgaacctgggaggcggaggttgcagtcagccgagatggcgccactgcactccagcctgggtgacagagtgagattccatctcaaaaaaaaaaaaaaagtgagagggggatgaagagtcctcactgggtgaggaaggtgcccgtgtgttgtgtgtcttgggtcacgtgtgaacacatatgggggtgcagggggagggggcgtttaaaggattctaagtctaaaccactgaggactcttggggacaggaggagagatgaagactggaggaggaactgagggtttctagctgcgcgtgttgaccttctcctggggtggcacatcccattgaagccatgttcccaggggacaagcagagtggacccagctctttggggactttggtgcttccagtcttattttgaaggcattatagagggggtggaagccagatccaaacccagttcacttcccattccctgccccatgcctcagtggtctttggtttcccgtgggtgctctgggcatcctgcatggagggggactccaggctcccagagataggcagccgcatgcagtggtgcccaaacgtggaggagcacagtccagctagcctgttggaagagagccctgaaaacagggctgggacctcccagggaatgagtcaggggccacccatgagcctccctgcaggcctcctctggtggccgctcatggtcattgagattttagttctttgggtcacacacacagtgagcgccagtggacagaacttgcctgtgtgaggtcagggtctctcccgcggtaccctccatgtgggccattcctgagtctcattttcactgatgggaacataacacaaacgtgctttgtctctcttgcacttacccctttcctccctggcatgctgtgctgctggcatggaggcagggtcaggagcccaacaaggggtgtgtgcggggtataggaaggtggcccccagaccccgcagggatcggcttgggagagacccaccagacacatgaagggaagcaacagcagcactaagtggtattgctggcaggaacggcagggatcacaacacaaaggcaacaacagaaacgaacacagggacagctcagcgcccagcagacatgaacttgcctgaccataccctgtgaggagctagggctgtcactatctcctctggaatacagaggcccacggtcggtcggtgacctacccaggagggaagtgggattcagacctgactagtttgcctccaggccctactgttttgactctcctgatggtaaaatgatgagtctgcaaattgaacaagtgcttggaggaaggaggtttgctttaggtttgggcaggaaagggaggacctgtattcatggaggcccaaccgggtggcaaatgcttcacagtcctgatctcattttgtctccccagcagcaccaggtggaaggaggtacgtgttgttacctcagtttacaaatgagataacagaggctcagcgagatacactaagttgtcttaagtctgaagatgaataaggactcgatgtaggattagagctgtggccagccaccgtgtgaagtttacttgcttcttggggccacaaaactggctcgatgagcgggcaggacaaggttgggatgatagggtggtccttttcaatgggatgaatggcagcggccaacgcatgtttgggagaccctgaccagaccagcctggtgtgggggaagtggaggcgaggcggggggaatgggaaacgtgtctggaagggcccaattgtggaaagaaggccttgaaccccaggcctaggcacagtcggtcctagagggagacagtgggggcccacccagagagagctgggagactcagaatcccactggagcccctactcttcccaggcaggccacgccagcactggccttgggcatgggagggcctcccaagtcatgtgcaggcccaaagtccttgctttactttacaagacaagcacagagccgaggcccaaggcttgcatgtggcatcatctccgtgtccgtcgaatctgaaaggaccagggaagctcaggaagctgagttcagaggcatccctctgcttggcagccaccctgaccatgccattgggttgctggaaaccccagctgtggaaacggaaccgctgattctgaagctctccccgcaatgcttcttggatgtggccatgcacgggggcaagggtttgatgagagcatctgtgccattgcccggacaagaaggagctgttggctgtcattctttccagaaatctcagcaatgtaaatgttcagggagagcaataagacctcgtggttgccagccaactcctgcttctggaagctttccaaatctccctgtgcctaccattgtgcctgtgctggatttctgcttgtttttcctttttctttcagagtttgaatttgggtttgggaggatagtaatttgatatattagagcagcgataatcgctgtcattaagcagaacccagctccttaatgtctgtgtgtggacgggccaagtgcgagccagtgtgtggggctgggatgcctgagagcacagagaaacacaaagccagggccgccgggcagctggggcaggttagggacacttctttcgttgtcctgtttgagactcagccatggctgctttggatggtctctggttggtgttggactatgatttttctttagcgggggtgactctgatgtcattcagcttggagatgtgtcccaaataaacctttaatcacagaaaaggtgcttggaaggacaaggggcaccttcctggcccggtgactgcagcttggggatcaccctcccattgcctggctttccctcctactttccgagcaaccacctcttgggtttggcgttttaaggtttccccacttggattttaacccccattggcagcaggtttaggaaagccatcagagggaagccctcctccctgacatcatccccgcccaggtggtgttggggcgagtgaggttctggtgctggggaagctgctgcttgaggatagcagtgggaagaagtttcatggcagcagctgccacctatgtgttctgcagagcacctggcaggagagactcgccttcccagtctcggcacgcctggatgccgcattagcacacagggagggtcatggtcagagcttcaggatgcagtgggcgaggtgtctaagatccagatgctagccttggaggagctggtgggacaaaggctgttcccagggattgcacctgcctggccctgcatccagggaggatcctttcagctggagatgccggaagttggcagagctggggtaaagggcagaaacataaagaccaggtcagcagcagctccaactaaggcagatgcccagagcagatcagagaagcagaccagagatgagccggcaccgctgtgggggaaggatcatcccagccatcatgtggtttgggggaaagctgggaccccacttggtacaatttaggaaggtacagaagaatgtgcattccatcatgtgggttctgcttctcccctgaagcctctgtcaagagctgctttgggtcttggtatggagaaatgccttcatttggccagacccatctggcagaggcagtcacgatgccattggacccccaggcaagcagcccctcctagagagcgagggtcttggaaggcctggtatgacccccatgccactctgtttcctagggaaccctaaagggaaaccgcacgtgagggactccactgagataaccctgacgtcaccgtgccactgtgccccttgtctgcagggtaacttggctttgaaggagcatcaggggaccctctgtaggactgggggtgagatcgatggacctgccagctgttattgttgggattatagggaagtgaggaggtcgtgtgtgcctccttggggtctgagtgcctccttggggtgcctaagggagactgaacatcattttggtgatatttattgatgtaactactccctttgcacgatatttattgatgtgactattccccatcacttgtgggatgctgagctgtgcatagcacagttcaaaatatctgatctaagcaggcaggaaggagacagctgctggtgctgcttagagttaggcgcagggatgaaacccatgagatgaggaggctggtggaggaaagggactgggggcagtggagggatggagaaatggacagaagtatggatggggaatgctgaatgtgagggagaccccagaaccggatgacacaagaaaacaatccttggctgtggccgggtgaccatgttaaggccattaaagtcatgcttggagaaaccacatagatgcttgcagctttgcctgtcatccagtggacttcagagcacagcatccgttcgaaatccagcggcagattttcatagtctgacaaattaaatcagctgttctcctggcgccagagtgggcttcctgccccacactcactgaggggtggtagggaggggtggcctgtcctttgcacactagtgggcaaatgatactgtcttcattttatgagcagttcttgccccctgtgacttagaatccctcacgtgtgttttgagatccattttgatgttattaagcccaacttcccagaccttcttcctgttcttcttgttggcacaaaagcccccttcctgtttcagaaggtgcaaaaagcaagaggattgatcagcgcgtggctttgccacatgatcacgaaaatggaggcggtcgatgagaaggcccttaggcattagggggaagaaacaagtagagtaaaaaggaaatgtcactggatgtcatagaatatggatttctgtcctttctgccttgagctttctcttggggagggaggaagaggggtctgggagaacaagacagcccgttctgagcagaagcccctttcagctctgggctgagatgaatggggagcgagggggaggggagggagtgtagcgcagctgggctcatcccatcaatgttggcatccaaagaaaaatcacggctttgggtggggaaactgggtcctgctgtgtagttttcagattgaagttgatgtgagacttggagatcatttggcaaccttattggtgctattggcataatttaaataatgggaaggattttattcttaattgttccagccaggtttagaagcctggaaaaagaccagttctgcttttagaagtataaaaataccgcagggatggaaaatgcttcatgcctgacaggcagatgtaaatgatttccagttatatttcagtacctgcgcaggggcagggccccgttgctagtgatctgatgaactagtcagccagtggggcgcggtgtgcagggggcgtgtgtgtgcacacaggatgtatgtacatggtgtgtctgtgcctacatatgatagtgtgtacatggtgtgtctgtgcacgcatgattgtgtgtacatggtgtgtgtgcacatgatgcacatgtgtgtatatgggtagacgtgtatgtgatgtgtgtctgagtgcatggtgtgagtgcacacatgtccatgtgtgggtgtgtgtgcatgcgcgtgtgcctgtgtgcacatggtgtgtgcatggcatgggtgtgtatcatggcctgtgtgtgcacactgtgtgtacagggcagacgcactcactgagggccccttcagttgtaataggcagaaggagcgcacgaggaggctgaaacgccagttagaatttcagctgtgagctcttctcttccccacttagggctgggatgttttcacagaaatcacagagcagctctcagagcccaaactcattgtttctcctggttttgtttgtgttgactttccctttaatccatgctcaagcccctcacctgtttagaggggatgtggcccgactttcaatgaaaatctctccagttctcctgccgtggcctctcgggctcctggggaacagcaccctgagccttctccttcttaactggtgagttctgcagagaatggggctatggttgatagtgtagtctttgggaacttttgttattggacaaatgtccactttgttttctaggacatctctttgtgtcccccagagtgaaccagctggagccagggagcccctagagcagtagcagccattagggggagccactgggagtcaggtgccttgacttggatccaggtgtgcaccctttctttccaagggtctctgggtgaggcccgtgaccttcccaagcctctccctgtcttgtgaaacctgggcgtgatatacctcccttttagggctgctgcgatcatttaggcagattaaacctcataagtggtttcccatacaagaaagatgctagcagtgcaacagacagaacacttacctgcctgccctcccgccaggaggtggtcttccaacttttgcccggagtctacagagggtgggccctctctgctggggctccgggacatggtcaggagaggttggtctgtctgtaccgccattctcttggccagactgtggtgtctggtccctactcacaccttcctgtcagagtatccagaggccgcagagtatccacaccctggctgggtgtactggctacagatggctgtggctccaggtcacctgcgtgcctgggtgatgagaaataatgtcacaacaaatatcccatctgcattctctgggacactgacccatgaagagaaagcagttctcacagtttttacaggcacaggtcagctctcagagtgctggggacagggttcccaccaggcagccctttctgctcctcccagagactgatggcttctctgcattcagagggatctgggagcattgcaggaataggctctggctcttcagaaatgatcacgagcttaaggaactgggtctgcaatgtgaagccttaggtccactctccttggtgggagctcatgccctccccaggctccaggacccagtcaggattcttaattcacgtggctatgtcagcgcagctgtcactcccggaaatgaagagagacccctcttgccgtccttctcacattgcttgcactttccagcatgcattttgttgtgatgttttgtctgtaattgcaactccagcagcagccagtgtttattaaccattttctatatgccgggctcaatgtgaggcatttcgaacacattctcttgtttggtcttcacagacacccttaaggttaagtactcatttcatgcccattaccagatgaagaaaacaaattttaaaaactcaaggaacttgcccaaggtcacacggctaattagaggccgaatctagagccgatttggaaatttcagggcccactggaatctcctgggtcatgccccaggccaattccttcagaagcgtttctcaaactccccaggagattccagtcaatcaatttgcaggcagctttttgggaacccagctgggctggagtctatgtagaatatccatggcacccgcagcctctgcagcatctggcctgagttattcttccattgcccggtgctatcatacagatacaggactggtgactacaaacagtgttagcaggacgtacttggagctcatttggcagtgggagtggacgtgctgggggccatcccccttccacctgaagcgttcttgtcctaaagcatgttgctgagacagctgtgtagggcgtggcggtgaccctggggaaggaccgtactgagagctccagactccagccagcctcctcactttggccacattccaacaatgcttactgccttccacagtggatgaaatattccagaaatcagaatgtgttgaaatgtgtggcaaagaagaatgtcatacttgcatatgtgcttacactggccactgaactgcatacacagtcccaagaggtctccctgcaccgcgaggcccatgctagaaaaggcgttcttcaggaacagactgaggcttcatgaagatccttccctccatccatcactccattaatcctcccctccattcatccctccactcatcccttcatttactccatccatccttcctcccattttcccatccactccatcagcctctccatccatccctccactcatcccttcatttactccatccatccttcctcccatttccccatccactccatcagcctctccatccatccctccactcatccctcaactcacctcttcatccactccatccatccttccacacttttccccatccactccatcagcctctccatccatccctccattaatcctcccctccactcatccctccactcatcccttcatttactccatccatccttcctcccatttccccacccactccataagcctctccaaccatccctccatctgttcctccattaattcttccctccacccatccctccctttatctctccatctatttctctctccatccctcccttcatgtcttcctctatccctcctccatccctccctctattcctccctccatccctctttccatctctccctccatccttccctccatcccaccttccatatcccccccatccctccctccatatcttcctccatcccttcctccatccctcaatgcatccctctctccatccagagttcaccacaccctgagtccccagtgctgcactcctgaaactcactctgggatttgcaactgggggttgccttgaacatgttccctgtgtatccggttgaattttggaaacacccatatctccatccactctatcagcctctccatccatccctccatccatccctccattaatcctcctctagagcattctactagagaacagccgaggtcagccttcctctgcctctcaggggagtagggcgcctgctggcagctgctgtaagactcgggatgagggctgccccctgcaggtggctctgaaagctgcagctctgagtggtgcccccagcagcagctttgttccctaattaggagggcacagtggctgtctagaagcacccaggagggagctgctccagaactttctttatcagctgacaaatcaaccttctcatgtgaggggagtttgagtcgttcactccagaattctggagaaccgtaggattcggagctccttgagggcatagccagtgctttcccttgttcctggtggtgatccaagcttgcctttctctcagacctgcctcagttgtcctgttctcataccctgttttcccccaagaacacagggtgcatccccagccttagctggattttcttccaccttgcaaaggcccctgcctgggagacatgtcttggtgtgagagagacgacattgcgttcccagatgtcgctggtgctgggctcagctccaaagttctggagcagagtcagcaaagcacagcctggagaccagatctgtgctctgcctgagtttgtaagtgaagttttgttgcagtagccacagccgtgcatgtacaggtggcagctttagcttctgctaaactggagagctcagtgtttgtgacagactgcgtgtcctgcaaaatcgaaaatgtctgtgattcagctcttcagggaaaaagggtgccgatgtctggcctacagggctcaagcattgtcatcatgcccccatccaaccgtccactcaaggtgcattgactgaggctggctggctggagtcatcatgtgggccctcaggctatggaggcaaatcgagtggcattgcctctgcggagctggccattaccttgtttcctaactgtcactcatttgataaaaactgacaaggttgctagagccacgtgtttgcaaaccagtgggcattcgcacgtgcatgtaatccacacagttactcggtgatgggagtatacttgagggaaagcagctcacagatttgccacttgccacaggtcatggtttaggaagaggcagaggtggggtgttttctcattagcccattccctcctccctttggatggaagaaaggaaaagagcaggggagagagaggccaatggcaaaggagcacagcgggagaaagaaggcccccaggcttgagcggccctgaagctcagcagctgtgggttggacggtggtgttggcttgctcttccccttccctcctggtttcttcaggccagtgcggcatcctgcacgtggtcagtccaagtccagggagggccccatcacctgggggtggtcgctatcagtggcaaagtcttgtcagcagctcatggggcaggaagggcctatggttgggggtttcctggcgatcccatggaggaaggtgaggatgagttgtgttgcttctcgggtgaagctggtcacgtggccctaaaggcattcagagtagatgctcacttcaaccctgcaggtggcattgggcggcaagcatttctaggacccagcttccaccacggagccgaatggtggcccggctggggccagggctcctctcgagggggcctgagatgctgagacccatgacgctgctgctcctgccaggggctcatcacctgtgaaacacaagccggggagcctgagtgtggcagagtctccctccccagggttccctctgcaggattttgtttgggttcttttgaagttgaaaagattttcaaaagagctcaccagaatatctaaaaccatgttatttagggaggagaggagccgcatggaagggccccaactccccagtgaccccctccaccaaacgcacaccaactggtggcattagaggtgacagtgcagcaggatggacttcttacttcccctctcagtctttgcactcagccccaagcagctcctgccaaggagccaaggagaggaaaatatcccttagcaggaaggaaggaaaatagaggcatcccagaaactgaacaaggacccagaaagcaaaccccacctctgttcccccatgagctacccacttttccccacagccccacagctgtgtgcctccctctctcccattttctttttttttttgagacggagtctcgctctgccaggctggagtgcagtggcaccatctcagctcactgcaacctcctccgcctccctcgttcaagcgattctcctgcctcagcctcctgagtagctgggactacaggcgccagccaccacacccggctaattttttgtatttttagtagagacagggtttcaccatgttagccaggatggtctcgatctcctgaccttgtgatccacccgcctcggcctcccaaagtgctgggattacaggcatgagtcaccgtacccggcccctctctcccgttttctaccctctttcttcttctagtacggtgaggtgggggcgggtgctcttgtcctccttccccctctccaccaccccccctctcccgccccacccaggcagctctggagtcctgctggctgcaagtttactaaacggaggcatttgtgaggggatttcagataccctgctgtgctcaggccagggtgacagtgttttgatgtttgcggttggaaagctgacctcctggatgtggggtgacgggagcggccggtgggaacagtactgtctgcatggcatcttctcccatgagaaaggatgactcctgagaaaacagacaagcaggatagcaaactccatcgcagactccctggcctggtcgaaggggcacagaatccacaggggcctgggggaagcttgggcagctccccaccccctctctccactgaaaccccgagcgagagtccctctgtgtatcggggactgcccgcttgtgaggagacgcattgcctcgctctggcttggaagaggaatgtcctgcctggcccggccccctcgggaagctggcgggtgagtgaacaagacaaggatggtgaaacacgctgcaacctcggccgcggagctccataaacacaggatggcctcttgtccctgctgtttatccacatttatgtttatggcgtacttaactcacggagaggtcagaacgctgagctatcagagtaacatttgacatttggacaaccacaaaacaaggccctgattctctgcgggtgcccacttcacctggtcccagcccagcccagtgcaggtggacaacacgcctttgttggtgctgctgggaaacaaaacccaatgaccgatcttccccagggtctctcgagaagcagccggcccctttccaaactgcaactcgttcaatgaaacctgagtgagctagtcacttgcttattatgttctgcaggtaaccaggactggggggttaatggttcccaaggggctcagatcccttggttgctgggcaggtagtaggagaggtttttctcacacgaagccttagggagcatgcatttggcttggggaagcatacttcctagcagaggctgcaaggagtccttcatgtaaacagggcttgagtcctccgtaagggacaggagaccttcccacatcctggcaagaattcttcttttttctgaggatgttttgtggaatgaaaaataaattgaaaggtaaaggtcagttgcacaagtgaagatctctttgaatgggcataggaattcttacggccgtagatttcagagcatctcactgcatcagcgctgccagctaccctgcccacacctgggtggtattcttagccttaggtgacccacggggtttcttctttatgaggggaaaggcttgaaattccttctgatcctctgttcaatatttcatgcgatatcagactaaatgcacaattctggattgagctgactgtattgattcaatgggaatatgcccactcggaggaggagggagggaggaggggaacggctgggaaccgctctgcggggcctggcaaaggcactcttggccccgggtgcaagagccgcctccgggtttggcagaaggggttggaatcttggatcctctgctgacctaccgtgtgaccttgagcaggtcattaaccctctccaagctcttgtatgtcacctgtaaaagatggagaagaacacagtagtcgcttgctgtgaggcctaagcggagtgacaggagcaaggctggcgcggtgcccaccccagtgagctctggcctggtgaggcccgttctgtgactcatggcctctgccaggggactgggctggccctgcctgtgcctccttcaagggcacatttctacagagtgaggaaaactctcctagccccgagcgatgctgccgtgtcccccgactcttcctaggtgttgacagttgacaggtctcggttctctttgcaaagcactgttagctaatgtaggaaatgtaaacattcagtgccttcctgaaattccttctagaccggaaccaccttgttccaggggctgtctggcaagtggtatagcccagccacagcagctaacagggctcatgggattactggggggtaatctccatctcagaaaggtgccttgacttttccatgggcaaaggaatgttgccttcatttccaagggaggaaaccgtcttttttattgtttgttttggaaaagttgtatttctttgtttaaaaatcaacacctttgggggtttactttagatttaaaagtagttagccctgaagcgacaggaaggggacgtgagggagctcctaggagtgggccatgtcccagttctgatctgggggctgggaccctggtgtgttcgatctggaaaagcatgtgaagctgtgtatttatggtctgcgcacttctctgtgttttctacacctcagcgacatttacagcaaaatgtaattactcagaagtgaacacaacaggcacatttccatggccattgtctacgggtttcctgatgacttctgtctcgcccacttggggaggggtttgtgcttatgtaacacaagacagacggagccagcaaccccgtaaaaatgcctgaagtaggttgatcctgccgttagactgtggggaggggccaggcggctgggcctgcagtggcctctgggcattgcctgatggctctggtcccaaaggggtctgtcctgtcagaagggaggtgtgggaagagacgacaaggccacggcgttgcctgagacgggatgttgctcaaggttcatttgtgccaagagcccttcctgtcttgtgagtgccacgaacatttccttccagtaaccattgtgcaggctccattccaggttcgcggggcatgataatcaagaagctggtcttgctcacgtcctcatggagctgacattctcagggcctccagggcagtgacagagctggaagcagaagaagacgtgcgtcacatggcggctgtcggatgccctgctcatctggggtgcctggtttggggttggccagctggcctttaggaggagcagcttcattccagcgttatctccttatactcatgatcaccggaattcgggatgtctgcacaggctgtctctgaatctctaatgttctaaaagtggctcattctgaaggaggggataactcaggaaactctttagtattcacttaattttaaacattactaaatgcttcatctgcgtggtttttaaacatctgttcatccatccatctgtctgtccctctgtccatccatccatccatccttccatccatctgtccatccatccatccgtcaatctatccatccattcattcatctattcatccatctgtccatccatccatccattcatccattcatccattcatccatctgttcatccattcatccattcatccatccattcagcgacacttgagtatctacactgggccagggccgaatgtttagagatggaaaggtgaggttcctacttctcagaggatgctggcaaaggaaaggtgaagggcaagagagagaaggtggagagaaagagagagaggaggagagacagagaggagagagagggagacagaggagagagggaaggaggtgggggagagatggccacatggggaaagggggaggaccaggagagaagagatagaggagcgctgtttggggtgctggttggtgtgctctggggagctctccagggtcttgactgggggcacgtgcatggggagggttgggtcttgggaagccttgacaacaccaggactccatctctggccttgaggccactagctctcatggtttctgcccgtggtggcagacagtgagtgggagggtgccacctcttgggccctttggctgagctcctcgagatcagagccagcttgttggtgctcgcttgtgctggccccccatccccatgcaggacagcttcacaccatctttccgagtgcacacaggggttcataggagctgcagctgtgctcgggcagggctgcaccccgataacagagtccagagtgctcaggccctcacgtccctcattcctgcacccacaggtcagtttcctcctggaggctgcatccagtgcagcagccccgggtgacgctttctccctagcattgtgctctgctgtgggttgagttgcatcccccaaatagatatgttgaagttctaacccctgctccctaagaatgtggccttacttgaaacagagtcactgcagatggcattagttaagatgaggtcatgctgaagtagggtgggcccctgatctcatatgacagctgtctggataagaagatgggaatttggacacagagtcacagatacacaggggagaggcccatgcgcagacagaggagagatcaaagggaggcagccacgagtcaaggaacacctggagcaccagcggctggcagagacaggggaggtcctcccctagcacgttcagggggagcacggccctgagggcacttccagtgaggacttccagcctccggggctgtgagaggatgagccctggaaaggggtcagctctaacacaccacagggcggcctgaccactgttgacttctcaggctttccagatgtgcacctctggtccactacaccggactgcgagctggctcaggaccgcaggctgggatggcctggagacatttttctccacctctacagtcagtggtgtcctgccggccctggcctcccccttagtgaggcagccccctcgcgcactgccatagcttgcccctcgtggcttgagggattaatctataggcctccccttcctggacagggttcttctctcttaagcctggataagtgggcttgctcttggttttgctttgacagtggacttgtgaattgcaatatgaagctgggtgtggtggctcacatctgtaatcccagcactttgggaggcccacgtgggcggatcacgaggtcaggagattgagaccatcctggctaacacagtgaaaccacatctctactaaaaatacaaaaaattagcctggcatggtggtgcgcacctgtaatcccagctactcaggaggctgaggcaggagaatcgcttgaacccaagaggcagagtttgcagtgagccgagattgcgccactgcactccagcctgggtgacagagcgagactctgtctcaaaataaataaataaaataaaataaaataaaataaaagaattgcaatatgaaattcagccaaggtgagtctgattaggagggtttgggatcaaggtgcttccactgctccttttatagtgagtagctctgaaggaccagcatgctctgttcctgtctctcccaagtatgcatcatcttagggaacaaaccataaaaggggcagagatagactctgtgggttgtctttggaatatcccaagggatttgctcctctctgatcatgtaggtctgcggctccaagggcagtccgtcaccaccctatctggagcactcttctatcctcctcccatctctgtcctctggcgatgaccacagccccgggcactgctagttgtgccccttgctaagctcccatattttgtgttaaggagcaaggattttcacaggctcatagagcatttgcttcctttctagggtaattaagactacactagaaaccatcttgtccggttctcttttacagatgttgacattagggccccaagaagatacgtagcctgctggtgtcacttagggaattaattcctgagcaggtgtctggtgcctggggccctgctcagaccccattctctcctctggttctcgatggccctcacctcccatttctttccatttcccagaggagtctggttgaacttatggctttttttgccttgattaattgactatgaatttatgtcccctaaaaaaggattaagttgcatcatttcttcttagcatgcagtgctcagagacaacccagcaattgataaagactttagggttggtgcagggaaagggggaaacagacactgattaaagataaatggggagtggagccttcctcccacccaggctcacagaggccggccctgcccgcctagcgctctcgcgggttctggtctgcagtttttatctgagttccgtttagtgtctggtctgaggctctggtctggtttgggttctgtctgggttctgtctaggtctaatctgggttctctctagacctggtctgggtgtggtctgggttctgtctgggtctggtttgggttctgtctgggtctgatctgggtctggtctaggttctttctgggtctgatctgggttctgtctgggtgtggtccgagttctgtctgggtctggtctgggttctgtctgggtctgatctgggttctgtctgggtgtggtctgagttctgtctgggtctggtctgggttctgtctgggtctgctctgggttctgtctgggtgtggtctgggttctttctgggtctgatctgggttctgtctgggtgtggtctgggttctgtctgggtgtggtctgggttctgtctgggtctggtctgagttctgtctgggtctggtctgggttctgtctgggtctggtctgagttctatctgggtctggtctgggttctgtctcggtgtggtctgggttctgcctgggtgtggtctgggttctgtctgggtctggtctgggttctgtctgggtgtggtctgggttctgtctgggtctggtctgggttctgtctgggtctgatctgggtctggtctgggttctgtctgggtgtggtctgggttctgtctgggtgtggtctgggttctgtctgggtgtggtctgggttctgtctaagttctggtctggctgttctagtctgcggctctggtctggcctgggttgtgtctaagctctggtctgggctaccatctggctgtttcaaatactgaacctgggcatcctgcacggggctgatgggccttcactgggcctggctctggcagtctctgcacttgttatcctgggcactcactatcccagccagaaaaacagtggaagacagtgtgccctgtgaacgagagcccacaaggacagggaggcaggtgcatgtccattatgccaagaagtgggctgagcagagctcaggggtgggaaagtagggcaggcggggtgggatggtcgcatcttcgctttatatttctgtaatgggaaccaagtggaggactctgcggggagggtgatttccttacataaatagaggtaggggtgtgtgtgtgtgtgtgtgtgtgtgtgcgcgcgcgcgctggatactcaggaaacccgactaccacaggaagcctctggctggtgtttcctgggcccctcagcccaggactcacttttagatgtgcacaaggtcactgttgtacccgggctgtcccacagcagggcagactaatgtttactggactttgtttccagagccacttttaagattcttcaattccaaatgcatgtctttttttaaaaaaaagaaagaaagaaaaataagtttctaatattagagaagtacagccctgaattgggttttgtgtccactgctggaccccatgagggccaggtggagtggacctctgcagccccagttgtgtgcactctctgtttggtgcaaattccagtttgctggttctcaatagcaagaccagcctgagaccacctgtcctgctcttcccatgagagggccgaatgctcccagcctccatgccatgtcctgttcctggggtcctgggggtcattgcagcctgtatgtgcttcctccagccagggtgatcatcgggtgccccagtgagccccagcactgagggtcagccccaggcactgtcaaaggtgagagctcagaggctgtgcccagaaagagaggtgggccctgcctgccctggacggagggagagaggcttctcagagcccgaggcatgaaccctcaggtgggtcgtggccatagtcagatgatggctgctggtgagctcagtgaccaggcgtcttcaggcagctcataagtttgagaggacacagcctaagggaggtttgctggggagtagccccacttccaccctgaatagacaagagatggtaaagcaggtacccagcacttagtgctttcttggggatatcgcgtgggtccccgggggcctgggtgcccgaagtgccgcagtactccatggtgcagagagcttgctcctgtggaggaagtgtctatgtggtccccagctcctctgtctgcctgtccactgaggggcacccatggctcagcagaagggctattcttggggttcccggtcctcctccagccccgctaatctgtgtaggcctcaagtgctgtgtgtttgtaagcattgtcatccacagtcctattgtacgagctggttcacccgcagctctgagctgctctccagccccagccctttcttcctgtgcccctacccccgctgggatgactctcctcaccctccctggggcgacaaccgccctgtctgtaatgagtggcagtcccaagcttcctgactggcttccgcagctctctgactcccctaaacaaggcctcagggactccacatccaaattaaggcggcacctggtggcaggttggcattttccggtgtcctatctatgaaagacaggaagacagctgggagcaaactcccctgggccagactcttggaaacataaaggcttgggtgcccagctggggaccgggagaaagtctaaaacacgggactgggccaaggaccccacaggtccctgtctcattaggtcccctgaaacgtgtggaagctaaaatggcattcacgtgattcttgatcatttaacagtggattctgatctgatactacactgagaagtgcccctgggccgggcgcggtggctcacgcctgtaatcccagcactttgggaggccgaggcgggcggatcacaaggagattgagaccatcctggctaacacggtgaaaccctgtctctactaaaaatacaaaaaattagccaggcatggtggcaggcgcctctagtactagctactcgggaggctgaggcaggagaatggtgtgaacccgggaggcggaacttgcagtgagccaagattgtgccactgcactctagcatgggcgacagagcaagactcagtctcaaaaaaaaaaaaaaaaaaaaaagtgcccctggattgggagacattatctatgcatccagttgcttctgttttattatttacagcacttttaaacagtctatttgaaaaaaaattaatgtggctttgcttgggatgtgcagcttttccccttttataaagctctcagatggagacttggcagaaattccaaagcagtttggtgtggctccaaaatgacaaactttcttaattattaattaagggattaataatatattgattatttaatcatatgttgattatttataaataaatcatatatacataatttatacttatgtaaatatataaagcataaataaataatttgtagatgcagtaagtgaattattaattaaaacagacacatgcatggcatctcggggcaggagcaagctggtagtgctgcagctcagagctgggttctgcccatactggccgagggcttgggcaggtcacctgggcccaccggacatcgcttcctcactctgagacgggaatggtggattccccatagactagacaatgagtgggaaagtgctttgtgagctctaaagcattacacacgtgctggtaattattatcattattataacctgtgaaatgcaattgaagacgtagaccagggaattcgaaagacatgaagttcatgttcttccctggaatgcagccttttctatgatgcatgtcaaaggttgcctttggccttggtcatgtgtacttgaacatttgcatatttactgcattagagataaaatgaaatgaatatgaatatgatctgcttttttgcaggatacaagaccctcctgaaaggaatttccgggaagttcaatagtggtgagttggtggccattatgggtccttccggggccgggaagtccacgctgatgaacatcctggctggatacaggtgagcagccctgcccagggcgcaaagttctctcccgggtgtcaggccagcagtgggaacagtggagctccttccatcagccccatcacctggagcaggctgtggtctacagcagtagtccaggggagagagtgacattgagaggctgcacttgccaagggccatatgatgggtggagagccacactcagagaggggtccctggagacagtggccacagcagcaccctggatgagctcagcctggctaaagggacaggaggaagtaggaaggtcaagttcagggagaggggtggccagagaacttggagagaacaggagtgaatgcaagttgaagagagacaaggcattttcagaagagaatgagaactgtttggctggggcttgtgatggtcttagttgtttagaagtttgagccgggtgtggtggctcgcacctgcaatcgcagcactttgggaggccgaggtgggcggattacctgaggtcaggagttctagaccagcctggccaacatgatgaaaccccatctctactgaagatacagaaaaaattagctgggcgtggtggcaggtgctataatcccagctacttaggaggctgaggcaggagaatcatttgaacccaggaggcagaggttgcagtgagctgagatcacaccactgcactccagcctgggtgacaagagcgagactccatctcaaaaacacacaaacaacaacaacaacaaagaaaaacaacaaagaagtttggcgaccattgtgtccaatgtcatccatttgggaatgattagaaaacttagaatctttagaagtgtttagaaaatgctctgttaaagtcagttattttcatgtctgattggttttatttactaactttggcaaatagtaataatagtaataatttcatttactgaaaaaatggcaaatatcacccttttccttagagcttctgaattacaccttaatgccagaaattggggtttgaaaaaacctcacttatggcaaattcctgcctgtgacagtcacatctaaaggttgaagttgaatcctcagagtgaggcagggccagagaggagtggagtattcttgcaggggtggctgtttctcagatcatcaatacacccacagctcctggcagcctgtgtgggtgcttggcatctcggagctgcagaggccactcaggatggggccttcagacctggggatccaggggaagccagttgaccccagcctgtgcctggaggagagaagagacccggccgcaggcccacagtcatagtaacaagctgagtaaagttggaagctagacatgctttcattagtctccgtagattcgcctctgttttattccccataacgtctaggaggtagggctagagagactggatccttagaagcacagtgtgtagactgcctgtggcatgcaccagctcccgggctgcactgatgctcccagaacggcaggcagcagaggcgcacagtaggtctgcagtgagccgatgaaccagccagtgaatgagtgtgcctggtgaggccgtgcctgccttgcatgagcacctgggaggctctcagcctgctcagcagagagaattctccctggtggagaagggccatccactcggctgagctggtccgggccccaggcccctctctgctccttcccaggcctgaagtctgcagaggtccggcctttgggcagttgggtgtagcctgagctacacacagaattgttcagaagccaacgttacaaacccccacaaatccaggggctgtacatcctgacctcgcggctgcttataggaccatccctgccaatctttgtttggcaggtcaagaaagtgctgccgttacccttagtataaacacaccatcccacggaggcctgtgtgcagcttcctcttcccagcaggagctttctctgtggaatgtcttcctcccgatcgctgcagtgctagcgaggtccggtccctttctgcccctcggggtccccgtggccagtggttcagctgggaagatgctgggaggcaagcccccgtctctggctcccctctcctgccccgggaggtggaggaggagcaggagcccggctgacggcttctcctgtccttggttctgcagggagacgggcatgaagggggccgtcctcatcaacggcctgccccgggacctgcgctgcttccggaaggtgtcctgctacatcatgcaggatgacatgctgctgccgcatctcactgtgcaggaggccatgatggtgagctccgccctgccccgccccactccgcccctgccgcctgtccccagcgcccacattagacacagcactggccgagtgcccagctgcgagggacccaagggctctgccacgcggcctgcacagggccagcaacctccctctagcggagttctaacaccagactcgctgttgggacaggcagcatcatcccaaaaccccccaagactgtgagtttaatggaccttgtttggcagggttggggtcaagtttctgagaaggttattaacccggctggcttgggtgatcctctccagggcagccaccatactatttctcctgcaggccagtgcttgggattctccttcctgtcagctatccttgagtctttccgtgtctttggcccaagcacccactcgcctggtgccttggtcaggataccaagggtctattcctctgactcacctgcctcccaggtgggaaaatgaaaccagcagtggccgagcatctcctgggtcccaggccctgagcacatagctctacacacaccagatatgtcatcccaaaaaagtgggtgggaaatggagcttcccccagtgaagccaggagcccagggtcacacggctgctgatggccacacgtggccagggctgtctgtctccaaaggcgcacctttaactgccagctcagcttccctgccgtgcacctgctttatcctcacagcctcagtgtcctcatctgcaagaccgtatggggttggtgtaaatattgaaagggaaaatacagggaaggtggggtagaattctgacatgcagttggtgcctaatcaattcaacttggtcactgtttcttttcactcctagtaagcctccccacagtatcttcacttatgtcctctgtggataaatccagtatttggggaagtttaaaaatatcttcccctcttggggccacagaagggtccaggggatatcctctgcctgggtttctggaatagctggttgtgctccttggacagaccgcgacccagccaagtgccatgcatctgggtttccagggccttttttttttttttttggggacagagtctcgctctgtcaccgaggctggaatgcagtggcacgatctcagctcactgcaacctccgcctcccaggttcaagcgattcttctgcctcagcctcccaagtagctgggactacaggcgcccaccaccatgcccggctgatttgtgtatttttggtagagatggggtttcactatgttggccaggctggtcttgaactcctgacctcgtgatctgcccacctcagcctcccaaagtgctaggattacaggtgtgagccaccgtgcccggcaggggccatttttttttttaaaggcccaactcatggcgactgaaaccacacagacctaactgtgagcagaggcaaccaccagaatcctcccattaagaggagattgaaaatcagtgtgcagctccagttgccagtcatggctggctttatgtgggggactgtttatatttctgcttcctccttgttcgctgcaaaagaagagtccccaggcttcatgtctctcctggcaccctagggggcatcctcagcttgatctgctctgtgctttggtcagtagatgggggttcgccttggttttccacctggagagaccctgacttgggttgggcaaagcttcttccccatggtgtctgagagtggcacgtgaagggcagtgccaaggggttcttagctcagcaaagagaagcaggttacgtttgcagacacatgatctgctccctaaacttctttgtggggaaacagaagcaggaacctgtggggctgttcccattcgtgttccctggtcctgcgtgttctgtgggtaagcagacgccattcccctgggcccagcatccctgggcggtgtgtgccccatggagccctgactgctgatctggcctccaaatggatgttcagatggggcgcagaggacctctgaggagttggcgaacagatgctgcaaagcagtcgtgaagtttttcttgaccctaatgttcactgttccatgtatgccctaagtgcaaactccatgcacaccctcttgattcctgaacagctcctgcgtcttgggtagcccgagtttgacttctcagtaagttcttgagtgaaccccatggccacatgctcgagacccttcactgggaccgcagctcaatggctgcattctccacagatgcgactagggactcctgctgtcctctcccaacctcgccaccgaacctgctgtgaaatgatctattttcacaatcaaattcagttcgattttgattctgagaatttcatgaggccctggagaaatactctgaggctatggtacatgttaccactcaaggtcctgtctcacacggaggagatattggccgcccgttgcggagtccggatcccacatcagacacagttgtgcatgtttatgcttttcatccttgcagccaggcagactgagaaatggcaggcagtgtcacatggcaggagcgtgggcctgaccctgtccagctctggggcctgagacctctttgccccacaccccgcccccctccccgccaccgccctgcatctcaccctctcctctgatcctcacagcaacttctctagctaatgaggtggacagagcttaacctcaccattgtgccagtgaggaaatggaggttgcacgtttgcccaaggccacgggaggcaggagggtggaagcaaggcccgtcctgtgcatggtgatctactctgggttttcccaagcagggccaggagcccagtgctgtgttagcaaacgggatctcaaaaaacacaacaacaacaaaacgcggcatcctgacgtgtcgccctcgtaaattcctgtgctgtaaagactctcctgtggataagttcaagcctcagcagtttaacaggcggtttgtggaattcctaactcgcaccactggttccgcccaggctggtcgccaagcccctgatgcctggggctttcttacctctaaatggcccacatctgacttctctcctgggtacagcagagaattcaactgagatagcaggaagcatcgcacatggactgctctcctgccatcctaccattgttaaagcaggggcatcggaagccaagaactccttgggttttccatgatgatcagctagctgcacggtggctagtggcaccgtggctagctgcatggtggctagttgcaccgtggctagtggccttatgcctagctgcactgtggatagctgcaccgtgactagtggcaccgtggctagctgcaccgtggctagcggcattgtggctagctgcactgtgggtagctgcaccgtggctagtggcactgtggctagctgcatcttggctagctgcaccgtggcctgcagtgcgggcatgaggctcacactgccagtggccgtctgttctgcttccacactgttgtccttgtcccctgcaggtgtcggcacatctgaagcttcaggagaaggatgaaggcagaagggaaatggtaagtgggttgtttggtgcccacaagtggtccagaaagtgcatgacgtgcatgtggaaggtgtgcctgccggggcattttggcattggcttttgtttgttgatttgtttttgccttgccttccgtgtgtgggacaggcaacatttcagggagtgctgtggcctgcagcagccagaggccaagaaaggcagatctggtgcacacgctcatggctttgattctcagattcaggagtcggaatgtaatgtgagggacaacagacttggcactcatggggccagaagatgccagcttcagggttagaccaagagtgctgcccttttagtgtttaatatgatcgatattaaattttttataagacaataacaatgaagatggttagtcattcgtttaaaaataaccaccctccatccacctacacttgcaagaagaaatttagttcttacatgttattaaccggcctcttaaaaaagaaaataaatacgtttccaggatgatgaagactttctaatccctttagccattttttttttggcttcctaaacccagggagcagggacagatgcaggtgggcagagccagggggagcagcagaaagccacacagaggaaggaggccaccagcctggactcacacaccctccacgggaaacccactgtcctcctctccactgcagctagtgctggtgggattttcagtgtgagatggaatttggggaaaccccccttctataagattatctttctctcctaacacccttaaaggctcacagtctggcagcagctgagagtggggtttgccgggttagtgccaatggctcgacatggccctttgtgttctggtataaaatgaagtgattgatgggacagagtcaaacatactgaggaacagtcatagcaattctatttccggcatttccccctctccggtcatctgtaatagctaatattaagtaaatgtaaaccactttggtatggaaaaaaagagttggacaaccttaatgctcctcctcccccatcaactgtgcccttcaaaactcaggattcagcccgtgtcaccggggctggggggtgaaatgcccggtgcaggtggaaagagcctaatgtctgagagaaggaaaatgactctttgttgctacagaaaatgttctgtgtggaattcttttattctgagattgaaaagaaaatggatgagtggaaaccaaaagagagaaaatgtggaaatcacatgtgttcctggcccttcatgggggcagaagacccagccttgtgagtttattgtctaggctgaaaggcgagagccccctctggatagtgttttctaaacaatgtaacgtagacacccccccacaacacacacaccacctcccaagcccgagaatgttacttataccaagttatggaagatgagtgttatggcctgaattccccccaaaagatgatatgttaaagcctacaccccagaaacccagaaatggctgtatttgaagatcgggtctttacagaagtaatgaagttaaaatggggtcatatgggtgggcctcagtccagtctaactgtgtccctgtaagaagaggagaggaggacccagacacaccaagggatggccccgtgaggacacagggaggaggcggcatctgccagcccaggagaggggcctcaggaaccaaccctgctgccctcgatctcagactttggcctccagaattgaggcgggagtttctgttgtggaaaccagccagtgtgggggacttcgttacagcagtgaacgtaacaaacgagagccttagttccaggcacacagaagaacatggagaaaagcaggtgtcagagctgagtctcggcgaagtctcccatgggagatgaacccaaatcaacagaacggggccctgggattgagccagggcgaccttcactctccctgtctgaggtcagttttgccaccccccagtcctgggccctccttgccatcagctacaggacaagaggagaggccggcaagagtgtgcagggcccccatgaagcagaggcttttccacccggagactcaagaagctgctcctcccgaagcctggatgcagtgcccctggatccgcctttcagggccctccttcccatcccccggcctccctgctttcatggggtgtcggaagcacaatccaatctctttgtctcggatagccctccatcgaggtcccaaagacccctccagatgctggcctgcaagctgaggggcggctgtgggggctccaaggagagacggtggaagtggtcactgatgctcggcgtggaggaggagccaagagctctggagagggaggcgctggagagagggaattctgtctctctgacccaaaataaggcccaaggacagagcaaacggtggagagggtctcggggatcaccggaggccgggggagcagacgcaggaggcggagggcggagagacttgctaacacggagaggccctgtggtgaagtagagctgagcacacgggggagccctccatcctggcctcctggaacccaccggatggccttgggccactgcctgctgtgccccgagccgagcttcacctgtaacgtggggacaggaagccaggccccacctgccttttggggcagtgcaacctgaactggatggtttctttaaggtctctgagctcgatggagcccatgtgatccatatgggaggggctgtgggattgcttccctgcagcataaggcgacagccaccagccttttccggggtagctggtgaaagtcgctctccccatgggctgggcgcacagtgagtgctgctcagcaggctccgtgctgaagtcacagcaagccaggcccttggcctgccggagctggaagacccagaacaagctggcatcttggtggagaatggaggcgcctcccaggagtagctacacgggacccgaaggcagatggcacccataggtgtgtgtcctcgtggtgcctgggccctgcctaagacacggcccggatgagagcctccagctattttcaactgggtttacaagggcaaaaatatcagctcatgtggctgaatcatccctgaggggtgagcccctggcgccgtcctcagattcctcttcggctggattgaacaatgcagagagccctccccacaggacctggaggccacgctgcgtcctgcacatgctcctcaccagcagacccagctgttcctcagccatggcacaggtgcatgcctcgccatcgggcccaccatcaggattgcttcaggagaacagggcagcaactttgtgccttcactcacttccctccaacccccgatgtgcacctaggtcaaagttctctctctgtctcatggaaacacaatgggatggaatgttctagaagatcatggaatttttgctgtgttgttcacggccttccttaattcccagcaaagcagcctcagccctccagagccctccagcaaggccacttcctcaggagtgaggtctccaggggcagcctgggctgccgagatcctccctggagcgcccgccgggaagccccaggggggctggagctacaagtggccttgcaggttttttgtttgtttgtttagggaaaatgtataaataactgagatcattgtttgttctttctgactagtctttaaaacagaacccttctgggtggcatcactcctgagcggacactggagaaagtggggtgggcccagctcatgggcaggggtgcggagggaaaggcacccacagcggcctccgcttccagcatcccctccgtgagggtggagggagagaagaagatgtgccgcatgtgtggggcccccacagtgagcctggaagcaccagagccactcagtcggccaagagcgtcgcccagtggttccagaagatctggaggcctcgtcctgggaagaccagcagtcgatgccagctgggaagagggctctgcccaccttgcacgccccccacccaccagccttttccagacagccttccagaagctgtttctgggttggcggccctcagagccaggcatccagcagaggcaccagggctggggtgagggcatcagcaaggaggttcaggacagggctggagcccaggtcggctgaccctgtactgccacctgccctggcctgtccagcagccgtgccccggttctttctgtcaccaaagctgcactttgtaccgactgtgcataaataattcagaagctcagagtggaaattttcttcctcgtgagttcttcctcccttcagatgacttcatctccctagaggagccgctggagtagggtccgcttgctatggctcccaggggccggccaccacagggctgccctggcagggtggggacaatagctgggtgaatgctggagggagctccaggtgggctgtccccagggtagggaggcagggatggcagtggctgacccagggcctgcttctgagatgatgctggggctgaaagcagcaccaagccagcacagaaatctgctgaccttcgtgttccctgagtcgatacaggatcaataatccggagcagacagggagggctccgtgcgcagtgccctgcttgttcctggcgtgcagcctgcttcccagagcctgtgccgtggtgtggctaccgtgggtcatgactgctttgaggggtactgcagatctgtttcgttgccttcctggcacctcagagaccttgctttcaagtcaaacctatttacaagaacaaaagtgactctgtccccctccccgagagccctggtgtgtgtgaccgtgttcctgcccttaatgcctacctcagcgatgacaagagtgctgggaacagcccccacggactccatgctgctctgtgcactctgcatccactctttcaagtaaccatcacagcgaccctccccttcgttctgggcagaaaccaccagaaattgtgcatcctctcatgtgtccattcatcaagtattgactggacaccttctccgtatggggcactgggctaggcttagcagtgaggaacgtgccctgggcacctgccagaggccatatgactgatgaggatgcaggcccttgtatctgaccccagcactgttgcacagcctctgggcagtgcagagcctctgggcagtctctgtccctcatcaggacggctgatgtggaaatggcacctgccccacttggcactgggcagcctggagtgggttcgacttgcgtggcctccacgtgggccaggcacggtgtgtccagcaggctgagggcggctggcaggtcttcctgcatgggccatgggaggtggtgagctttggcgggcagctcccaatgtctctcgttctgttgcccccaggtcaaggagatactgacagcgctgggcttgctgtcttgcgccaacacgcggaccgggagcctgtcaggtggtcagcgcaagcgcctggccatcgcgctggagctggtgaacaaccctccagtcatgttcttcgatgagcccaccaggtaagtcaggagcatctgagctggtgtccaggggcaggaagaaccccctgtattcagcggttcttccaggtgaccctgacatcctgatgtagcctcagagggggtgagttgagctcacccggcggttcctccttccatctgggaccactgggcagaagagctgacttatgccccctctctcactcactctgtgctcaggcctgcaaggcttgtgttgaccctgggggtatggctttgggggaaacgtcctttcacgatgcatatctcttccatgacaccaagttccccgtggctcagccactctgagggccaaggtcatgggacgacctgggaaacggtgtgtcttcaggtgtgttctggaaacgccctgcagtttagcacagcagaggctcagagatgcctgcaggacaggatcctgcctcggttgctcaccagctctctatacccacgggcgctctgaccccgcctgcaggacaggatcctgcctcagttgctcaccagctctctatacccacgggcgctctgacccctttcctgggtgatgccctttatgtttggggctccctgcggaatcactaccctggagtcctggatctggtgcccccagccgcaggttgagctcgcctgactcctgcatgtgtcctgtccagttgtcccaggcaggatgggtggccaggaaccaggcttctcctgaaatgacttcagccagactttacgttgtctcatttctgccactcactcacctctccaaagtccagcgagatttgacagtagtgtgacagcagccttctgagggggggatggcggggctcacttgtttccttctcttgggcctgcacagtaacagcccacagtgtctataagatacttcaggaaaagagaccacaatgaacccttgaatagcatcttgcaggctgaatgccctgagatgggtgggctccgggggactgcccaacacacactgtcccccgggcctgtcacttcagagttgaggggatgagagcaggagtagatctgaggggctaggaaaggagaagagaggtccccccaggaccctgctggacagtgaaacacctgctggagtaaagcccacctgggctgcagcaaggccaccttctatggggtgatgcccccatcgccagccccatagatgggaggtggggagtgggggtggtgactgcggggcactagaccacctgaggcacagctgcctgcctggacagttgtgaagtccccccccacccaaatgagtggggaacccccacctctttcccacctggacagttgtgaagtaccacccaccacccagatgagtggggaccccccacctctgtcctgcctggacagttgtgaagtaccccccaacccagatgagtggggacccccccacctctgtcccgcctggacagttgcaaagtccccccgcccagatgagtggggacccccccacctctgtcccgcctggacagttgcaaagtccccccgcccagatgagtggggacccccccacctctgtcccgcctggacagttgcgaagtcccccccgcccagatgagtggggacccccccacctctgtcccgcctggacagttgcgaagtcccccccgcccagatgagtggggacccccccacctctgtcccgcctggacagttgcaaagtccccccgcccagatgagtggggacccccccacctctgtcccgcctggacagttgcgaagtcccccccgcccagatgagtggggacccccccacctctgtcccgcctggacagttgcaaagtccccccgcccagatgagtggggacccccccacctctgtcccgcctggatagttgtgaagtccctccctgcccagatgagtggggacccccccccagtcctggactctggcagcaaggctcgctggggtccctccgttcttaccaggaataaaatgcaacatgcaaagccctgctgtgtgccctgccactgagcagcaaaacaaacagcaagagcagagcccggcctgggacggggcagctgcagctgcagcccctgatgccaagccctctgggacaggaactccctggacccccggaacctggggcagtggctagttcctgccgcccgcaggcgtctcacggtgcctcttgacttgcagcggcctggacagcgcctcctgcttccaggtggtctcgctgatgaaagggctcgctcaagggggtcgctccatcatttgcaccatccaccagcccagcgccaaactcttcgagctgttcgaccaggtacgcgggccccgggccctccccgccagattaccactgcactcaggtcagcctgaatgacaccaaaccctgggtacccactgccttctgttagctcgtggggcgtcttcatgacaccaaaccctgggtacccacagccttctgttagctcatggggcatcttcatgacaccaaaccctgggtacccacagccttctgttacctcgtgggatgtcttcatgacatcaaaccctgggtacccatggccttctgttagctcgtggggtgtcttcatttttgagagcgtttaagtgccaggttttgtgagacttgtggaaccacaggcagcgaagggggctggggagtggaagctggtgagcagagtcctctctctgtcctggtggtcggtcatgggatcctgggtgtcaccagcattgtagaacttcatcacctcccctgttaaaatggggggaggggggacacttgttttccagaattaataacaggttacagcatttgcacagtatcatttggtttataaatcttaggttttggccaggcacagtggctgtcccctgtaatcccagcactttgggaggctgaggtgggcagatcacttaagctcaggagttgaagaacaacctgagcaacatggtaaaaccctgtctctacaaaagaaaaaaaaatacaaaaattatcccggtgtggtggcacactcctatagtcccagctactggggaggctgatgtgggaggatcacctgagcccaggaggtggaggctgcactgagccaagatcgtgccactgcactccagcctgggcaacagagcaagaccctgtatcaaaaaaaaaaaaagatgaacaaacaaaaaaacttaggttttgatattagtctaagcaaaaatagtcacaaagggataaaatgtgtatagctccaaaattttttctgagcagggggttagcatgaaaaataaacagcaagcaatatagtcaaatcatcctggccgtgcgatattcttccctggcttatcgtggctttcccttcagatgttaatagggcccttgggggtgatgtaaagctctcaggagaggaagtggctgatcgctgggctgactgattgatcggttgattgattggttgattgattgattgagggctccggttgccttccgaggaaggcagggcttgatccctttttctccttccttttttccagctttacgtcctgagtcaaggacaatgtgtgtaccggggaaaagtctgcaatcttgtgccatatttgagggatttgggtctgaactgcccaacctaccacaacccagcagattttggtaagcggagtcctgagcagctcgggggacagaaaggggattttcctcctctgtgggtctcacttttagctgacgcccccaactcagaaaccacttgactaccacaaatagctcaagtgtcatccagttataaaacgtttaaagaacaaaaaaattaggtttcatttcctctagactctaggtaaaatcatctggccagcctgtctctgcctctctcctgtctccatgtcctaatcacctcctctcctgaggacagcagtcattggattcagggcccaccctaagtccaggatgattcatctcaagatcctaattacctctgcaaagatgctttttcaaataagggtgcatagtgacagtccaggtggacttccctcctccttcgccttccagccatcagtcttaatctgtcgtttttctttaaaatatttgattcatgcaattcccaggactccgtattttctaccacactatttcccaaattgtgttccatgagacattgttcacggacgtgcctctcactcacaaggagtaggctgtgatggagaggagacagggcgagggttgcagggagtgtggtttaaggtgggacgggagccccaggagggttgtggttctggtttcgtgctcgctcacaaggaagagtaacagatcagtaacgggtcactaacggatgctgctgagtggggcaggggaggtgaggtctgaagcctgcatggaggtgagaacctggagggaagggcgggcaggaaggagaggaaacacggtgcgtggggatgcagagaggtcctggagagatgagggcattcccttctggggatttcatttcctcaatgtcgtctgaccagagagcgggaggtgaggggagtgtggcccactgttgagggtgtgggtgaccagaggggcctggaaacattgcctggcagtgctgtaggctcgtttggagcccttgaggatgactttccggtggggccaatgtgtcctggtttgtggcttcatctaggaggtgtggtggcctccgtaccagctgggaggaagcgggtagctggctctgccagagggaagtgcggaaaaggtaagggtgttggggagctttgggccttagcaagaacgttactggagtgggaggcaaggcatcgcacagggaggacacagaggcaggagagggcagaggggttgggagaaagcagatgtaggcagagggaaggaggccagtcaccacgggagtgtggaaggagttgcaggctgcagaggaagtccaggtggagggagaccttaggggagcgagtctgcaggtggagtggggaggtgacgattgggatgcgagaggcaggagcagcgggcagggccggtgcaggagacgctcactgggatctgagaggtgcaggttgagggtcccaggacctccaagtccccagggtgccagccactcatgtggcgatgggcacgtccttctctgccatcttgtagaactgccgtggctctcgtcacaccctgccaaaccacaagctcctcaaggaggagtccctcagggaggagtccttcgttctgctcccttcccagctccaccttggaggctggcccagagcaggcattcagtaagtaccggctggatgagcagtcggtagatgcaggagctcattacttctcagaccactgacagcacagtgtgtgtttgcgtttcccgtctcctgacatgataaagggccttgctggggggtttgagagccgcacgctggttgataaatgattttgacgtcatgccattagcaccgccacgcagcatctatgtaatcgctttaaaacattcccacttgaataacgactttcgcatttgggtggttggggtgtccttcctggagcccgggctgacccccgtctgtgtctcctgcagtcatggaggttgcatccggcgagtacggtgatcagaacagtcggctggtgagagcggttcgggagggcatgtgtgactcagaccacaagagagacctcgggggtgatgccgaggtgaacccttttctttggcaccggccctctgaagaggtaaagcagacaaaacgattaaaggggttgagaaaggtaatgcaaatcccgaagccccctgggggaggctgcacgtggcaccgtgcactgctgcatgagagctctttccgagcaagaaggagccgtggctccggactggctttcacccgctcccctcttgcgtgtgtcctcaggactcctcgtccatggaaggctgccacagcttctctgccagctgcctcacgcagttctgcatcctcttcaagaggaccttcctcagcatcatgagggactcggtaaggctgcccgcatcttctcctgtagctggggaacccgtgggtcattttctcagactcgtcctgacggaatgtgttcgttcattctcacattgctataaagaaattcatgaggccaggcatggtgactcatgtctgtaaccccagcactttgggaggccaaggcaggcagatcatttgaggccaggagttcagaccagcctggccaacgtggggaaaccccatctctgctaaaaatacaaaaattagccaggcctggtagtgcatgcctgtaatcccagctactcaggaggctggggcaggagaactgcttgaacccaggggggcggagattgcagtgagccgagattgcaccactgcactccagcctgggtgacagagagagactcccatctgaaaaagaaagaaaggaaagaaaggaagggaaagggaaagggagaaaggaagggaagggaaggaaaggaaaggaaaaaagaaagaaagaaagaaatgcctgagcctggggaatttataaagaaaagaggtttaattggctcattgttctgcaggctgtgtaagaagcatggccggggagccctcaggaaactttcaatcatggtggaaggcaaagtgggatggagcgctacacacttttaaacattcagatctcacaataactcacccattgtcatgagcacagacccaaaggagaagtccacccccatgatccaatcaggccccatctccaacattggggattacaatttgacatgagatttgggcggggacacagacccaaaccatatcactaaactttcaaattacttttcttctatttgcaatagtcagcgttcactgtaatgctgcagtaacaaacactcccataatgtacgtgtctccctccatcaatatttgtgtcctgcttgtgttaggggtggcaacggtgggttgtatcatggctctgtcccataagtcttctcatcccgggacagctcctatctggacatgcctttcttcaccatgtcaaaggaaaagtgcaagagagaaaccaaatgacagcccttaaaacttccagttggaagtggcaaatcatcacttgcactcacatgccattggcctaaacaagtcacatggccgagcctgaaaccagggctgtaggcgagtccatttctccttcaggaaagcactgtgaatcatgaggattgggacggggggttggacaattccttatagggaaggaggtggtgaatacgcgggaaccataattctaccagagaagttgacaatctggccacctacttaggagcggctgaatgcctggcatggcttctgggacctaatttgaaagacagaggggctcaccgccgtccacagcagagttcttagagcctctgatatagccacttttccctcaccattgtttttacctttcctctcttctgagggtagacttcctttgttctccatttttaaatcttttacaaaggatagtaattatgttggttttaacacaacaaaagcctgacatgtgtgcatatatgtgtgtgagcaggcgtgtatgtgtgtgtgtgagtgtgtgtgtgtatgtgagtcgctttagggtttggcttgtttctctggaggagaagacaggataaagtctaagacgtgctgtcacagagttcagggtcccatgcttccaaaggccgcatccgggttgttctctgagccgaggacggctttgcgaacgcactgggtaagatgcgggtctgtccccaggtcctgacacacctgcgcatcacctcgcacattgggatcggcctcctcattggcctgctgtacttggggatcgggaacgaagccaagaaggtcttgagcaactccggcttcctcttcttctccatgctgttcctcatgttcgcggccctcatgcctactgttctgacatgtgagtgacagaccgctgaccccttcttccttattttcaattcctacccaagcatgggggcctgaagtcacgccttgaccaacagatgagttttctaaacacaatgtttttgtttttttaaaatatcatcttctttgttgacagatgcaagttgtattgtatttgctgttagataagaaaatacaatacttaagccaaaggaatgaatcccaaatggaagacttttaagcatgatggaaggctgatgggagggagatttctcaaagattcactaattaggagccccccaactctactacttaagcattacctagttcaattgttaagatagctctgcacagcccacttcgggagcagataagctctcttagatggatatccacacaattccagtttgttcacaaggagactgcccttggtcactttggctgacagtgaacacagcggctgcttctccagaactttagcataaatagctcctccctaggtacctcctccccaagcttcccctgatttccaagagcagcttgcagccttgctcacaggaaggcaccacgttgatgcagagtttcagaagaggcagactcaggaagagtaaggccaggcatgaatccttgccttcatcactaagatgatgctttgtattcacagacatgctccccatcctgattctccactcaatgactcttcaggttatgcaaacgggtggcgtttttcaggctagcaaaacacatcctctgtttgttcaatctctcagtgccctaggccagagctgggttaccagccgctcagctcaagatcgcctgttgggatgttaaacgggctcgctgcacatggtcactgacccttcttttttgcttttctatctcctagttcccctggagatgggagtctttcttcgggaacacctgaactactggtacagcctgaaggcctactacctggccaagaccatggcagacgtgccctttcaggtgtgttagccaggggctggaatttgaaacgggggcaagagttctcctgtacaccctttatatcgagtaagaggacctgccagggatgcagggtgacatggcccgacttcgggagctctggtgggagctgcggggaagggcctgacttcgggagctgtggcgggagctgtggggagtggggaaggacccgactttgggagctctggcgggagctgcggggaagggctggctgcccaggagctttgctgttggcctgctgtggtgggaagcggctgagcccgcggctgacgggtccttgtttccagatcatgttcccagtggcctactgcagcatcgtgtactggatgacgtcgcagccgtccgacgccgtgcgctttgtgctgtttgccgcgctgggcaccatgacctccctggtggcacagtccctgggcctgctgatcggagccgcctccacgtccctgcaggtgccagcccaggaggcgctaagtgagggcatgacggctgggcttccctgagctaccttggcctgagctagggggctctgccaccccttcccctacttctgccctgaccctcctagatggggtcgttcccacgggaagggcccgcattgtcgagggtcaggatcagctggcttccacagtgcgcacagcgggcagcctcacgtgtgctgactgcgtgctgggcgctcttcccagcgcttcccagatctgagctcctgtagccccaagcacagccacgcttaggtgctgtgctggccccattttacataggggagcactgaggcccagagaggcaaagtgatttgtcagggggtcacacagctgattcgggagccaagctcccaacacctatgcatcactgcctctgtggggttccctcggcctctccatgggccccttcctcctcccatcgcccaccctgccccccgacctgccgcccacatgcacctgcaggttctctacctctgtggctttaggacgctcggcctcagcctgtccttctggacaaaagcagtgttcctgggtggattgggaacacccgagggccccagggtcccatgctgggtgcagtgtattcctgagtcacctccagtccaccataagcaagctccctggcctccagggcccaggtgccctcaccttagatgaggactgccatggagcccatctcacaaggctgccatgggaccaaagatgacactgcaggaaggtgccaggcccatgccaggtgctgcaacccgtgtgccccaaggccagccccagtgcacctgctcagccacccccaggacccctgcctagggcactcaggctccgcaggggtcactaatcagaccagggctgggatgcccctgtctgcacggttgcacacggcacacatgcacacacacactacacacagaccacactacacactacacaccacacactacacacataccacactacacacacaccacactacacaccacacacactacacaccacacacggtgcacaccacacactacacaccacactacacactacacaccacacactgcatacacaccacactacacactacacaccacacacacaccacactacacaccatacactatacacataccacactacacagtacacaccacacacactacacaccacacagtacacactgcacaccacactacacactacccaccacacactacacacacaccacactacacactacacaccacacatactacacaccacacactaaacacatacgacactacacactacacaccacacactacacacacaccacactacacagtacacaccacacactacacacacaccacactacacactacacaccacacacactacacacataccacactacacacacaccacacacactacacaccacacacggtacacaccacacactacacacaccacacactacacactacacaccacacacggtacacaccacacactacacacacaccacactacacactacacaccacacactgcatacacacactacacactacacaccacacacacaccacactacacaccatacactacacacataccacactacacagtacacaccacacacactacacaccacacagtacacactacacaccacactacacactacccaccacacactacacacacaccacactacacactacacaccacacatactacacaccacgcactacacacataccacactacacactacacaccacacactacacacacaccacactacacagtacacaccacaccacacactacacacacatcacactacacactacccaccacacatactacacaccacgcactacacacataccacactacacactacacaccacacactacacacataccacactacacagtacacaccacactacacactacacaccacacacacaccacacacactacacaccacacactacacacgcaccacactacacactacacaccacacactacacatacaccacactacacactacacacaaatactacatacacacaccacacagtacataccacataccacaccctacacacaaacacacactacacactacatgctatgcacacacaccactcactgcgcacacagactacacactagaaacatcacacactacacaccacaccacacaccacacactccacaccacacaccacacaccgcagacaccacacacaccacacagcagacaccgcccacaccacacacacactccacacacacactccacacacacactccacacaccctcctacccccgacacactcacagtgcccctgttggacctgtgctcactgtgaaccctgagtcgcggcggttgcttcggtctctgggctgccctcccggaggtgctgacaggcaggcgtccatcccgcctgtgaaggctgcagtccttccactgtgccccgaccgaaggggtgcccgccacacacctgccacaggccaggcacttagcccccccggggacagctgtggaggagcagacggcagtctgttgaggagggtgtgtccccacctctctggcctggggacatccactgggtcccagctcatcctgggctgcaggaggctctggggctgccacgtcacagcagggcagccggggggtcctcagagatggtgaccccacacctcgggaacgctgcaccttctgccacattaagcatcatcattaccctgcccagaaggtgccctggccctgcccgggggaagctggcgtgggcgagcctcctctgcaggaggccaggctgcaggttctgctacatctgtcctgtgtgcccccaactccaggtggccactttcgtgggcccagtgacagccatcccggtgctcctgttctcggggttcttcgtcagcttcgacaccatccccacgtacctacagtggatgtcctacatctcctatgtcaggtagcgggcgtggggcacgcatggcgtggggaccgagggtgacgggggaagaaccgtctccaacagcgtgaggggctcacaaaagccactctgggctgctggccaagagcagattacacatctgaggatccaggccttccatcttcctgctagttccacctcctcctaccctcaccaacacacacacactaaacaaggaggccacacaaaccagcgcttcacacccggagagccatggcaggaccaagtgttctggacgttgccgagagctgccttcggtggaagcgcttccatcttttaggaacgttcttcctccccgaagtgccgagtgctcctaacaagtgctgattgtaaaacctttataagaaatctggtgggagtcaggcgtggtggctcatgtctgtaatcccagcactttgggaggctgaggcaggcagatcacttgaggtcaggagtttgagaccagcctggccaacatggcgaaaccccgtctccactaaaaacacaaaacaattaggtgggcttggtggcgcgcgactgtaattctagctactccggaggctgaggcgggagggcgggaagatcccttgaacctgggaggcagaggttgcagtgagctgagatcgcgccactgcactccagcctaggtgacagagtgagactccgtctcaataaaaaaaaaaaaaaaaaaaaaaaaaaaaaaaaaaaaaaaaaaaaggaaagaaatctggtgggaaacaagtcatttttaaacatctttttaaacatcctaatatcttggaacaagaatgcccagtgcctcaggtccttagctacaacgtttcgtgccctctgtggagtgcggtgttggcacgctggccccaccaggggcagcgcccatcttccgagctgcagaagttccatgtgacactaagatccaaagttgggaacaagctcttcttctctagaatgtcagttcagacttaggtatattgttcaagaaaacaaagcacttgtacagagtttcgacaatctgcgtgtgctccaacactatgaaatcagaaaccgacgtctttcttctcaaaatgagtgcttttgttctgacagggcaggactggagcagagggagagagggggcaggaatgtttcatataaatgctctcaagtccttgcaagttggctggcccacgattccctccaaccgttagaaagcatgtaacctcggaagtgaacacaagacttctcagtgcatttcaccagtgaatatgtaccgctcattcaacttgtttttttgctgggggccctggaggaaacaaaattggaagaaaaacatagtggagctgttgcacgtgtttgtcttaagaaggtggtgggcggtgaggaagtattctggggaaggcggccctttgggaagggaggatagccaagctgggaatcgcagggagggtgaacgacattgaccttcagccaacggcgtggctggctgggagaacgtcctccctcatgcctggcctttcctcctaggtatgggttcgaaggggtcatcctctccatctatggcttagaccgggaagatctgcactgtgacatcgacgagacgtgccacttccagaagtcggaggccatcctgcgggagctggacgtggaaaatgccaagctgtacctggacttcatcgtactcgggattttcttcatctccctccgcctcattgcctattttgtcctcaggtacaaaatccgggcagagaggtaaaacacctgaatgccaggaaacaggaagattagacactgtggccgagggcacgtctagaatcgaggaggcaagcctgtgcccgaccgacgacacagagactcttctgatccaacccctagaaccgcgttgggtttgtgggtgtctcgtgctcagccactctgcccagctgggttggatcttctctccattcccctttctagctttaactaggaagatgtaggcagattggtggtttttttttttttaacatacagaattttaaataccacaactggggcagaatttaaagctgcaacacagctggtgatgagaggcttcctcagtccagtcgctccttagcaccaggcaccgtgggtcctggatggggaactgcaagcagcctctcagctgatggctgcacagtcagatgtctggtggcagagagtccgagcatggagcgattccattttatgactgttgtttttcacattttcatctttctaaggtgtgtctcttttccaatgagaagtcatttttgcaagccaaaagtcgatcaatcgcattcattttaagaaattatacctttttagtacttgctgaagaatgattcagggtaaatcacatactttgtttagagaggcgaggggtttaaccgagtcacccagctggtctcatacatagacagcacttgtgaaggattgaatgcaggttccaggtggagggaagacgtggacaccatctccactgagccatgcagacatttttaaaagctatacaaaaaattgtgagaagacattggccaactctttcaaagtctttctttttccacgtgcttcttattttaagcgaaatatattgtttgtttcttcctaactttctgactacctttaattttgcctaggttgatttaaacaaacaaacaaacagcttccctttcctcctgtatcacctcagctgcctccactgaacctggaagaatggggcttagggaaattcaggcacgacctttgagggttggctcagcaggagtggccagcagtgaaagatgggctaactgtgcaagaggggaggaggccaacgagatggcatcagaatccaagggcttaggacgaagtcagtagacttcagcatgtggaggcatttgaaacttgatcaaacaacgcacttcgagtggtgggagatttcatctctgggttttgcgacctcacagctgcatcaccgcctcagtgttaggcctgtgtaaactttgcacgttggaaaccgcttctttcctatgactgaatcacataagtcaaatcccgctagggcagaaacaggtgcctatctggaggtcaagtggtctttgaattcacaacaaggctgcctgtgagtttgtcagctctcagaagcagtttgactacatgcagagaaggtgattctggccaaagaagtccacctttaggaaaatgccattgtttactccctctagaatatcattctcctagaatcagggcttccgatggaaaggctgtgtttttgcgggaaaatcagtgaacctttctaagctacatttttcctcatctgtaaatagttacagtacatcatgcccaaggccatgccagctcaaaggtggtgggattccttggcgatgtccctgaagctcttatttcccacttcgaaagaacgaaaagggtctgaattttatttacacatggatttagtttgctaattcttagagattccttttttactgctagatcttttttagtaaacacaattgagatagatattaaagtgtaattttaagtgtgcttgttctatacaaatatggcattgccttccagattaagtttttaaccagagtcaaacttagcctttataaaaagtcctcatttaatttcaaaatagatcttcttgtaagacattgcacatagggaagacctacctaggaatagcctggtgaaatgcagaattggaaaaaggcaaaagtccttgctcatgactcagaactacatcgagtgaggtcagtgttgaaaacgcccattccctccaggtgagccttccccattgtggattagtgttgtggcttcatggccctaataggggtgtgtctgccaggaactgcactgcatggggcccacagccctgcctcagaagcagctttggtctcgtttgctgagaccgcttgctgtgcctcatcaatttcaggaggaaacagtgagatgcctctagattttaaatctggtttcggagagcacctaagccctctgatggaatgactctcgtaggaacttgatgggggtaattctaagggggaagagcttgggaaccatgagggctgttaggctgcaagaagggaatggatatgtgagaccatgtgggtttattttttgaagggtgaactggagtaggtgaggattctgcagttgacgccccaggatggctttgctcagccctcccccgtagactggaggaaagcctaccgccaagggaggagaggatgcatctgtcctaggtgcagccggcctccctcttccaggttcagcaagggtccctggctgggcattttcctcgtaacctttggcagcattggctcaaatgccattgtttagattcccagatatttccccactgctttttgtgttaaggtagtttggtaaaatgccttattccaatggcctaagataatatcaagcaactcactggtttacttttctaaccagctgtggttaagacacacacggcaatgtgctatctttcacatgttggacgttaaacccagaccaactccccaaatctaatttgtttcagtaatttctgaatgcattgaccaagatattcctttcatctctggttgagtttcttccattagaaggaaggattaaaccttggataaaagatttgcagatgccccagtggttagtagaggtgaaaatggaggtttcagggaaactgctggggccttttgcctttgtcctcatccaaagcattttgtgcctctctttcttctcctctggctgaatatccactggagattgaattctccgaaactccctgtgtgggtgaagtgggaagctgtgcccaggaaggggagtaactgtgcaaagttttatgcagtcagtgccagaattggattacatcacctgggggaggcgccttcaggaccaggaaatggtacatggagctttgaggtgaaaactcatcttagaaacccacaaaaagtcattcccccagcctgacatcagggacagaccacacccatggggcagaaaccgggcttggttgttgcagtgggaagagaaggcacgactctggtgcaccgagcacctttcctcgtggctgtttccaggcactgggctggatgtcctcagaaccccctgtcccctgcccactcctcaaacccttactgacccacccctctcgcctggtgctgtcccaggccctgggggtgagggggaggggactccaacgtgggcttgccctccagtgtggtgggagggaaccgcgtggccacttggcttagccgtgctcatggtgcagacgtggaacgcggaggcagggagaggctccgtgacgtccccagggccccagaacgaggaaggagcggagttgggattccagcccagttggacgctgaagtccctgttttgtttactgcctcctgttcatggcgtatgaatgtatctgagatgctttgtaaggcataaagtgcaatactagcttagtggctgttcgttcagtgattccttctgttaccaaacaggtggctgagatgagagggcaacccaagcctaacgcccttcagtggccttgcatcagagtactcgtgacaggtacctctccgtggagaggggctgtcctctgcccttgcctgctcctcctattgcaacagtcctgtggactagctcaggctctacaggggctggtgtgtgtgtgtgcgtgtatggtgtatatgtgtctacctacacacaagcacatgtgcacacatgcacacacatgcatgcaagcacacgcacacacacacatgcacacacactcacatggacacacacatacacacacatacacacacatacatgcacacacatgcacatggacacacatacatgcacacacatacatgcaggtgtgcagacttggctccaggcgtgtgtttgatagtattattctatgatatttccctcatctccatagaataccagcttctgaatcctcaatcagcctttactgcaagaagaaaagaaaaacctctctcattccaggtctgtggtgcagatgggaagagtatagtcaaaacccattaaggccttagtcaaatgccagccgaattagaacgcaatgaacgttagacaaaacaacccaactggccaggcgggggaggcgcagagcgtataaatataaagttagatacttataaagaataaagactctaataaaatattttatataaaactttttacctgtgttcagcgtcagatgcttcaagtgattggctttgcattctcctaagtcgatggattcttaggctgtgtctagaatgcgtttgttgtccctctgggaagagcactgatttgtcgctcatgttctggtccaagacgtggctgtagatgagccctttctcgatgatgttcatgtattatgttgaattgtcttaaagttttgtgttttctgttctcccagaatcctcacccatgtcctcctgcctcgtgatgttggccatgacctcgaaatgtgcctggaggaggctcgaggcagggctagcaggagggcactgggccacaccttccctttggtcctctccacccttgcaggggctccctcaaccggggctctggggcggtagctctggcagggcgacgtcgcttcttccttactctgctttgctggaaacccatctcccaggctgagctctgtagaggcagctgctagtggggaaggcagcccctctagaggttttggtcccaaagttgaggtgagcagggcctagcagttgctcagtgttatgtgctgcattagcccatggttccccgagctccggccaggcagtgaccctcagagtgaagactttccgggacaccagtggcttagaactgggctttcaaatccagcttccctcccacctctgggacacagagcagagagccgggctgggtgaggtcacagaatcggcccgcagtggcccctgcactcctcctatggcgggcaggcacaatcgaaggctgccccaggcgtgcacacaagctcgcgatgcacagttttcttcccccctcggtaaccccagcctttctggacggcccggccgccctgggtcccagtaatgttaaagtcacggtcctttccaagccactgtacttgggctgtcccgtcagggaggttcctccaagataattgccccctgcaaagacaggggcttctgatgtccacttgtggggctgacctttttggggaacctccctgggaccagaagcagggaagaaataagagaccctgcacccccatggcacagtctaattttcacttacaagctcaattcaggctgtccttaaaatccacgtgtcctgggcaggaaggaaatgtggggacaggcacacacgcacatccttctgctatgctgacctaaagttcctaatagctatcctacatcctgcccgtttcttttttccatatttgaggaaacagaagggtttagccttagcctagtttttttatgttatctctgaacaggccaacctggaatcacccctcacacagacacgtgtggcctgccccagtgtgcctgaggcccacccaggaaccctgctttgcctggggtttatgtgaatgacacacatgtgagcagaggctggggttaggaccctgaggcttccctgttctcagaaatactctcctggcatcaaaaggagaaaacggtccatgccactggctaccacattccagcctggcaagggtttactgtttatagaggcaccgtttgggggcttttccatgtagaatggccgttgtaaagctgaagagaaaggaacagaagcacaaaagcaccttgattcttcgcaaacacaggcaggggctgccggctggacgagggcgctgcattttgagggcgtgctggacccgctggcagagcccgccctgagggttttctctgcagctgtgggctaagcttgcccaagcccctccccttttccagaaagccacccccatggccacttgcctttcaggtccaggttgaggacacagccacgggcatatatgtatttgtttcactggggttcatggttctggggacagtcttctagcccccgagatcttgggaaaggcatgagctcaagccacataaccaaaaagtagcaaaactcaaaattattactttactttcagctgttttctctcaatagcgcgccaccatcgtctgtgtgtctgcactgaacaaacatacgagagaatctggctgatcactttgagtgcctttggcctaaactttgcacatgactttaaacgtggccctgatactgcacacagtaagaaatgttttttattttatggtccctgaggttacgagatcagatctctggaaatgtgtaagccacctgctgtcacctctgacccatgtggtccattaccatgagggccggtgagtggggcagagatgctgaggcctggctggtgagcccccgagcagtgaggcaggaccctccctggtgacctgtgtgggggccagtcctctagtcccccagacaaatctccctttaaggaggcttctgaagctctgagtgccggcgctcagaattaatttgactcttcactgctcaccgcacctgcctatgagcctctagaaaacagcttgcccaatgagagtgctgcagctgaggcagcagcagacatgtccgtttctggggaagttactcaaacaatcgtgcctcttagggggccctaatgtgccccttctggcaggttgaaatgcatctggccttgaaggggaaggttaggaaattatgaagtacgtgggtttagggttgacaaccccatatccgtggactcctggagatccctgaacgccgtctaatctgaatggtaccacaatttggtttgtctgaaaatatagtagtaaccacggcagtgatttcatttttacacgtttgcatttttacatgtctgtcattatgcatcttggggtctcttttccatgacctaccagcttcccaagcttaataatcagtatctcactattatgtcattggccaactgaaaacagtagcaaaacatcctatcatccaaattgctaataaaatagaacaccacacccacacgctggcttcccatttttatagtcttatcctcccacctggagggtgtgaatggggatcagtttttcaatagaacatgtatgtttggtaagttaatatgtgtagctgacccctttgcctttgtttttatatatttatgtttttctattgtagacatattgatgcaatacctgttcatagttgaatctgttacaaattgttaccttttatttgatgaagaactatttaaagattttccttttttatttcttctaaagcaaaagtcaatgcaagtaactctaatcagcgtgcaaaggcgtgcatatatatctgctatgtaattatataatgtttttataatgctgtgtggataacttttcactgatttagttacttgactgtaggaaacactgttgctttgcacgctgtgagaggtttgcactgttacagatgaaggcaacatatttacatatgtacatgtatatacatatatatatattcaaaaataacatcggctctttggggtgtctgtttccttggttgtctcacgccactggaacattgaacccagacagaccctaggatgtgaggttcctgactgcaccttacggaccacagagccacgtgtctatttctgtagacctatctccttagatttgtacatgcattttttgcggacttgaactttgttttctgaaattagatgccatttatgatgatgtgatgtcaatcaaataaagcatcattattttcagatttctgcttctctttccttttgctttcaacagccccagctctcagacctgctgggggagtcgcgtctggtagagcatctcgtattttctccctacctgcccttgctctcaatggagcacttctctcttcagtgtcaggatggattccagtgaggaagacaaataagagtgatggtaaggaagcctgtagctccagactccatggagcaccatgtggtggcacagtaccctacctttccatgcgcaatctcatcaaaccgtcgtcatcagagctggagagccgcaactggccccatttttcaggttaaaaacaccgaggctcagggatattacacaacttgccaaagccacagagctggtcggtggtgcacgcagaagtgagaccctggccatccaggcagggctcctggccactccatggctctcccttcctccgggagaggcatttaggatttgagaccacacaggaggagaatccacgttgtgcaggaagtggtgtggcaggtctgaccctcatgaccagtggaaacttctcctcccagacacttggctgaggggtgagatgatgtgccaacatctccagggatcggcctggaggtccttgtgctgtcaagaccccttgtgagtcagcactggggcctgggtccagatgtcatctgggatcatcacctgggacatggccctactgggccctacttgtaggcgaggaggaaggtgtgcatgtgtgggtaggaacgagacagtgcaaaaagccgctgcctggtgacctggcatgcagactcggccctcccacttgcacggtgatccactgaagacaacagctgcctctgtactcacgctcccccacactcccctccttcctgccctggtttctccatccctagatgccatcccatgccccaaaccatccgccaagcacaataacctcgcccccacccaccccatgaggtcactcgagttgacaaccagataacagtttttgttttgttttgttttgttttgttttgtttgtttttgagacggggtctcgctctgttgcccaggctggagtgcaatgacgttatctcggctcaccacaacctccgcctcccgggttcaagagattcttctgcctcagctgcctgagtagctgggactacaggcgcgtgccaccattctcagctaacttttgtatttttagtagagacagggtttcattatattggccaggctggtctcgaactcctgacctcttgatccgcccacctcagcctctcaaagtgcagggattacaggcgtgagccaccgcgcccaatagcaatttgatgacccatcccctccactgctgggaaaaggctgggcaccgcccacactccatgcagctctctttccctggctcggaatcgctgcaggcgccacagaccagacgcgcactgttccccactcctgcttatcggccgcgcggcatccccttgtcgcagcactccagcatccatgcagccgcgcggcaccccgtcttcggagcactccagaatccatgcagagcgcagcaccccacatccagagcgctccagaatccatgaagcacgcggcaccccctcgtcagagtgctccagaatccatgaagtgcgcagcaccccttaatcggagcgctctagaacccgtgcagcgagcagcaccccacacccggagcgctccagaatccatgaagccagcagcaccccacacccggagtgctccagaatccacgcagcacgtggcatctcctcgtcatagcgttctagaatccatgcagcgagcagtaccccacaccgggagcgctccagaatccacgcagcgtctggcacatctttatcagagcgctccagagtccatgcagccacagtcctccaacggaccctgagattgtttctgcaaaaggccatgccttcataaatctgaaaatttggaaaacatccttctacttatatccttacaacccaccattcaagctgtagaagcctttctggaaccccaagcagaaggatatccaaaatgtaaaaacggtggggcctgcaatcccacggagcaccccccactctcacggtgcccaggtcgtcccactcagcacggacattctgcctccagccctggggcctccaggttatacccaaaagaggtgactcttggggacgtaaggtgcgtggggtgccatgaaccctcccaaggctgcagcctcttgggcaaggagtccacagtgctgttgccagccaaattggctgcacccctgcacgagggggctgatcttccccacaccaccactgtggctggcatcgcagtaggtaccacttgttaacaacctcgttctacagagagatggtgaagccagacgcaggtaaacctgtggcagggcactcttcctgaagaaccaacagatcccctcaggcccgccccgctgttttatttcccttctctgccctttccccggtgcaagcagctgttggtctgtgcttcctgctgctctgctctgcagatactaacgaagccacaaccagggggccgggtggtcacagcagggaccacagctgggcaacctataatctctgtgacgctgggagctctgggacctcatttttcctaatgtccccatctgtaaatagccaggttgccatgttgagagcaggtgtcagagggaaatgggatctcgccacactgcaggactgagacaattcctctggttggtgagggctgggcctaggatgggaggctcagagcagtgaatgaatggatgtggtgttggatgcttcctccaggaggcctgcccgcctgcccctgtggaggacagaggccagggagacaggtcagtgggatgggggagcagagggagtcggttgcaccccacaaaacccaagagggaaaggctgcagtgttcaggccaacagggacaaagacagctgcacagcgagaagcagcaaatgattcctgtgcctgagtgtggtcttggaatggcagagagaacccttgagcctgggagccacctggaagggaacaaggccgtctggcagccacctggcaggacccatggcattgaagatcagatgtgccagccacaccttggtgctcggtatgcccttggaaataaactctcagttctcagggcaaaaaggctttgtctaaatgggcaaatcaacagaggtatcagcacatgtacagatgtgtgcttaatgaagatattattcccatgccatagaattcacttttttaaagtgttcgtctcagggggttttagtattgttttagtaaagtgtacgatttggtggtttttagtatctaatattgcacagaattgtgcagccagtatcatatgccactccagaacatttccatcaccccaaaaggaaaccccttccccatgaacagccactccccatccctccccctacccagcaaccactgaaacactgtctgtctctgtgggtttccctattctgcacatttcatataaatggaatcacacaacacatggctttttgtgatcggcttctttcacttagcataaaacacacttcagttttgaaaacaaaataaaacctaaggaagaaagggagcatgaactctaaatgcagtagaaaactatggccgaccaaggggatgcggctctgacctcacaggggaatgagctttctcagcctgcaccttgcttctgcagctgtcggcaaccctctgatacagccattataattgtcccattttgctgataggaactttgaagccccagggctctctaactctttccaatacatgacagtgcctctcgagcccccaagaaggaggactgaggggagaatttccagcctccacagctgtgtcacagcccagggccctgcagggcctcagagcaaaaacctagtgagcagggaggcttcttggccactggagatgcacctaccactcagctgtccctcagagacgacctgctgcagggacccaggtcaccgacagccccgcatccagcatgacatccacgccaggcccacttccctgaggctgctcccaaccagggcattcccaccagacacagggtccctcgaggggcactctgctttggggactccccatcagcctgcgggaggctcttcctccccagtccttcccccactcatttcggaggcaagaactccccagtacgtctgctacttatggaagcccacatgggtgtctcagcttgaagccaaaattctcgccattggaaattatgaatccttggaatacagtgatgaatacaagtgaatatccaatgtattatggaacaatgtagagctttctagcagactccagaggaactgtggaaaatgagaagtgccacagccgcacccttcaccaccaactcaagaggagggggaaggcatgggcatggcacggaaaaccatcatggggtgtaacggctgcagcgtggggagaagcctagcgtttctctcccctttccaacagcagcacacgccagcagcgagggagcccagccatgttctggcttcttctggcaatcaaagtgttcattctggaaggctctggaaacacggaccatttccaagttagtgatgaaggtatttgacataaaaatggttcctgggtcctatgggtcacaattcattatttgaattcgccgtgagccgctgatggatgtcggtttcagatgtgcccagaccaggaggtgggaaggcccagcaggtggcgttgaggccacctgggctctggacagctgttgtcaactgatgcccagtgctggaaattaaatatgcacgaggccttatgaaaatataagaaataaaaggagagtaatgttcagtacattcctattcagtgcaccatgctccccatgtccacaccagaggacgggatgaaggagtccggggcttgaatccccctggatgggccacccgaggaacacaggcagccctggcactgacatgcttgaaatgaacgactcagctaacgctgcaaaccaaacaaatgcagtgtcttcttgatttacatgacataccctcctggagaattcaggtatgttcaagccatttgaaacaacaaacaacaaccaaaacaactgtgttaaaatgtaacacagaagtagtctctgggtttcgatcgccgtgaataggtttgcagccaccatgtgtgtccaacaggacgccaggacgtctatcgggtggaggcagtggtctgttcaggacacctggggacaccacagggtcctgccatgtctggcctgtgtccactcaatgccccctttcatacgattcataaacgtgcccacagattcccgaacatccccgtggcagcagcctccactgggaaccctcggcttagatcatgtgtcctgggtcccagatcctcctcaccaacaggaagcccagggtcattctggggctgcgtatcttaatttgtatctagaaggggcagggcacagctgtgattggtggcgagccgcagtgactccagcagtcagtagagggcgctgttcggtcgctttgtggtttggaccaggtttccgttctgccgtcgggctggggggtgggtgggctgcttttgggtcctgctcccccattggtgtctgtgatctcttatgagaatgtcacagcccccaggtgggtgctgtcaggggcgttgcgctctttctcatagcataaaccctacccggggttctgagagccccccgaccatgcctggggctcgcgaggaaggcagggagcttccaaggtccccatagcaaccgaagtcgaagcgagggagaggcagagacggtcggaggcaggacacgggagacagagaaagacgggggtccagtccagctcattccaggaccccagccctcctcagcccctttcctttcctcactggggtctgccctgcacagctggattatggggagtctctgtcctgccggttgttgccagcagatctctccatctgatgctatttcatttgatggaagcaacctcgatccagcccacacgggcagcaggagtcaatggtgaagcttctagaatgtgcacgaagcattgtcctgtctgaggaaggcacaggctcaggctggagacagggagcagctctgtggtgggtgaaggaggagtcccacctggctcaagttctgggggagccctccctctcagggcacagtgggaagtctgggccggggggaccacagtgcaggaggtgtctgcagtgactgcagaaggcaatgccaggaacggcggggtggggcaagtcaagaaattctttggaaatgtaggtgggcggtgcccatgaatgaggcaaggaggcagcagagccctgtcccggggtacagggcaccaggtggggtaggaggaaaacggagctggtcatccagctggtggcagggtggcctgaggctgaggccagggcctggggccaacctttccatccctccagccctcaaaggctgggcatggtctgtgagggagagggatgcagagccccgcctcggaggatgtcccggccagagcagctctcagtagcagagctccagagcagggaggccacacttggcgtgtgctctgaggcccgggatagccctggaagtttccctcccagggctggcagctgatgcttcggggcattggatgggacacccagggcttgagatttagagaccaggacatcctgacagtgtcccctctcagtaggggcttttggacaagctacttcaagaaagtctctttccatatctgtaagacaagggcaatactacctcccttctagggatgttatgagctctagggaccaggccccgagtgcaagctcaaaaacaaaagctgctattttaaaggagcagttgtctcttttcaaaagggaacagatagctcagagcaagaaccccaccgctgtgaccgcactgcagtggaattgtggatccggccctaagagagccccggcagtgggagcagcacaggaggcccaggcaggcagcgctcacaggaggcccaagcaggcagcgctcacaggaggcccaggcaggcagcgctcacaggaggcccagccaggcagcgctcactggccttcgtacatctaaaaccgtcttggtgggagcggagagctgccgtgtcccaagacagtgcgatggggagagaaccacactcaggtccagaagtggataaggcttcatgaggacgtgagatggaatccccactgccaccagctcattcatttcctatagctgcatccatttttttaaaaaaagagaaaagaaggccacccaatgtgtcacagatgtttaaacttaattagcaaacaaatacaaaaaagtgcctgtttgttcataatgtttactgtacaaagaaacaaaacccaggaatagtacaagtattgaacagtagcgagagtggttgtgaaataaaggaccactttggaagacagttttattggcttgctgtcttcaccaagaaagacttgtgatttttgaaaacttctacctgaaatgtattttttctgctttcccgaggaagcggcacttacagtgttcctaggctttcctgtgacgtgggtgccagtctggattcaaaatatccttgcatgcactgcagctccttagggagtcttttcctgcccttgaggcctgggcagactctcccctgacaccctcccgccctctcccacgacgcagcagaaataaagcacaacctcagaaagtctcaggcacgaagaactgtcctcgggtggagcatgggacctttattcgttaagacatcaggctccagatatgaactttcagcagaagcgcttgccgggagcaaagggacagaaaagctgagatgaacagtgcctggcagcaatcacagccgggcaagggtgctccgagcctcgcatcccccggccgggggcagctggaggtgcctcagaaggtgcattctgcaaacagagcaaaggcttgtgtgagcagtctctctccacccacgctgcccagcttcccaaggtcagggcaggctccaaggccagcacctagtgctgcctcctccccagagtcaccggggagtgttgagtccccaccacatgggggaatagccaagattcccacctcgggttgctaagcaagatagtgggacccagggatcaggcagataacaagcgagatgggccttggcagggccatggctggcactcagaggagagtgtagttccagtggagctgaaggaacaggaccggcagtggacagtagccagacccctctctctcctggccttctctggacccccacccccacccctaccctggacttgctggggagggtgaagggaggccctgggcaggggcccatcattgatcagggagccggggccagcaggactcagcctcccgcatttcaccctaggacaaagggcaagagaggcccctctggatgctggttccaggaaggtacctcacgcaggtgcggccttcgtgggggctgagctggcacttggacatggcagatggcttatagccaatcgccccacccacgatgtggggcagctaagcctggtggagccagggtggcaaacccgtgtgcagggccatctgttacccgcacagcacgcaggctctccgcccctggggagggaacccccagggtggttgccctgcacctgccctccaccacggcagagagagggagaggagatgacccttgtggggggcagagtgggggaggtggggtgtggcaccgaggcctgacgtctagggctgggaccgcctgccgtctgtgtaggggatgccacaaatgacaagactctggggggccgatttgcaaaaacagcccaaaagtcggcccggctttccacacctatgcgtttccacttctctcaagaatagttactaaatcagttccctctatgcgatgccatcattttgaacacctttttgaaacaattgcttttatgttttacataaaggggacagaagaggacagcccctggccatggctgccctaagtgtgaagcctctgctctgaggccttggaacaggtgtgtgtgtgtggcttcctggggtccttgtgcctccatctccagcccagaaaggacagggaggccctgagaccccctgccttatggggctgggcccagaccacgatgccactggggccttacctgcttcctgcaggggcttgaaacaccaaggcactccagggatcctggagtcaaagcagcagccccggttgttgcactccttgggggtgacatgggggtagccgcagtccaccctgtccttggctggcacggcacactggtttgcagctgtcccagacaaagccctgtcagctgccagagcccttgctgggctgcggtgagtgtgtttgcttcactttgcaagtttgcatcctcccgctccgccccaccccgccgagttcaaccactgctgaaaccctcgcccttaggaagatgcactttccctgtgaatatttaaagagaggcagtctgttaaatgctcagctcggggactctggccatttgcctaagtgtctttctccttggcacgctcttatcaccttctcgggaagtcacatacggacctgggtaccttccagctggcaggaacccctggggaatctggggtcccttgaacccagaaacaaagttacccttcattgtttgaccaacaaaaccttgcccctttgttttaaatgaaaaccgtgacaggagaggcacacgccatagagatcattgcaacgcatgctgcctgcttttcacttttttctgcatctccccttcctgaattgttgagcatgtcccaccctcccgggacatccttcagtccccaatattttcatgtttcaggcaagcctctatgtctgtatgtgcagcagaagttcactgcgtttcattaacgaactgagtatttccttaggaaaatggcaatcacgtgcagtgtcttacattcccttctcttgctcccagtccgtaattgcttatcctcctggcatccaaacttcgctcacactggaatcagctgcagagctttaaaaatgactgacgttggctgggcatggtggcttacacctgtaattccagcactttgggaggccaaggcaggaggatcacttgaggccaggagtttgagaccagcttggccaacatagcgaaactccatctctactaaaaatccaaaaaattagctgggcatggtggtgcatgcctgtaatcccagctacttgaagccgaggcacaagaattgcttgaacccaggaggcggaggttgcagtgagctgagattgtgccactgcactccagcagtgagtgacaaagcaaggctatctcaaaacaaaacagctgaggcctggatcttgcctggagatgccctgatgtaactggtgtgccccaagcattaggatttttaaagctctccaggtgattctaatgggctgcaagttcgggaaccactgcctttgaccctgctcagaagacacccagataaaagccatgccctcattccttcaaacttgggttaatggagcagccacaccccatggcagggttgctatgcaatggctaaatgaaccttgtgcctgccggtattgacagtgttctgaagtcagggtttttctcctgcatctttcctttttctttgtaaatgtggaacaatgcataaagacctatattgtaatttagaaatctccagcaaagatggctatggggtcataggggatgggctcaggctcaaaccctgatttcaacacagactgggcagggctgccttggataagttgttaactttctctgagcctcggtttccttgtctgtgaaatggggacaataaagacccacttcaaagggctagcgcaggaaaaagtgtatatgtgacaggtggccattattaaatgaatgcagaatccccccttatcctggatcccttcccttcacgcccaccctgccaccggggcagtcagggcagtactcacacaggcccacgtactcctcagcagagctggaggacagcaaggccaggaccagccccagcatgcagagcgctctggcagccatgaccaccgtgggctccgggacgcagctcaggactcgcttcatggtccaggaggcctcatttatgcaccgttgtttgcacagctgctctggattgtttgcttggggaaggctctccctcctggctgtggctgctcctgttctctcctgcatgcctttgtcaagctcccagacagtttttctctcccaaaggggagaggtcagttcagcccccactgttttggcagcaagcggtaagggcggattccagttctggttccgggtcctctactggggagcggatgtgtgtcaattgccctcctagcctggcctggtgtagtgtgcaggagccatgtggggtggcaggaccagggtgtggtgtccgttccatctcagcctcccagccagaagccctcagaacacccctggtcccatgacaagagagccccaggctgcttcatcccagatcggcctcggagacaggcagctctgagtgagtcaggaccctgcggctctctcacaactcctgaaacacagagattccttgtctttcctttttgctttctcccctaaaaattagtaactacattttaataagtggatgaaatgaattgattgaaaatatgttagtaaaaacatggtacacataattgatttttaaaatcaaataatacaaaagagcctttcctatccagaggcatctattgatctattgtgaacacttttttaggtatcctttcagaatttttctctctggatctaagcacgtttttttggtttgtttttgtttgtttgtttgttttgttttttttttgttttttttttgttttttttttttggagacagggtcttgctctgttacccaggctggagtgcagtggcacaatctcaactcactgagacccccgccctcgcggggctcaagtgatcctcccacctcagcctcctaagtagctgggccacaggcatgtgtccagctaatattttgtatttttttagagaccaggtgtcgccatgttggccaggctggtctcagactcctggactcaagtgatctgccttccttggcctcccaaagtgtcaggattacaggcatgagccactgcactcggccacatttttaacacaaacaggaactgactctccacctttgcccagcgtgctcttttaaaaactaaagactacatctcaggaattgttttataacaacatatcagatgagacagcgatgattctatccattttccagaggaagaaactaagactcaacatttccggtgcctatcagaggttactccagtgtccctggtatagctggtatttaacccactcccaggaccctaagcctccgccctcggcatccgcagcatcccccaaccccccaacctcctgcagtggactggctggtagtgggcaagagactaatctcattccaggaaaacgggcccctagattttgtgttctccgtgtttcttttccagggaggcattttgatgacccccactggcccttccaggagcctctgtctgaagggtggacttggtttatcaccccgagaaatgggagcgcctggctgcttggatttagcctgcagctggggtccccggtggtgtgtgcagggcggccttgagcctccaagggtgcatccacaaactgcccttccccgagtgacccatgggagctcgatggcgtacgtgctgagcaccaggatgtgtcctgccctgtgactcccaggccccgcccttgcgctcagcacgccctttgtggatggatttgagggcccctggcctctgatgtgccactcccgctgaggccagcgaaggaggaagaaggaaagagcgttgcctgccttgttttcggggcactcactttttctgggagacagcggacccaggttcatcaatggacagcaggattttcatgttattaaaaaggtcattgtaggggaaatccctgggggatctggtgagatctccctgggggatctggtgagatctccctgccttcccactgctcctagtacccagaggccaggccaggtcgtggtgcagggctgagttccaggagggtgcaaacaccccaggaacagactgctgcccctccggccctcatgacctgctggggaaggacccccgcaaggagcttctgcaggtgctgtggtctccacctgctgcactcaaaattgcctggagtggggagaatatcaatgcctgggccccgccctgacaggtggttctgtcgcctgtgattcttctctgcggccagcaccgagaaccctgctggggtttgcttccgtttaactagtgaatgttgactgagctcctactgcctacacccagggtttagggctggggaaggaataacaaaggtgacacattcttgtccttgaagagtccccccgcaaagggagacgggatcatgtcagagttaagatggtgaagccaagactaggttctgtgctgcctgaccttgggcaagtcacgtcccatctgtacctcagtttccctacatgtcacagggtgctcaccccacaggacagcatgaagtggtgctgcacagcccagccaggtgcctgggacacacactgaccacctgccgggtgtgctggatcaaccatgatggcagaggagaggattcctggtcccggctctggtaggagcaaaggctgtggcaagggggccagagctgggtcctgtcaggtggagacgcacaggcttctcagagaagggggatttgggctgcacctctggagaggtcaatggggaggcccgtgtgtgtcccctctctctgttctaggagccccctccccaggagccctgggctctgtacaggaacagaggatggcatgggagagcccaacctgccttccagagcctgcattcccacagccttccccagccaccctattcccctgggggagttccagttccagagaaaaagcagagctgttgtcagagctgtaggccgtgcggtagtgggcatcgggcccaacccagacaggtggctcccctgggcaacccaagacctgggggtgagcaggactggctctaaaggagcctctccctttcctccttgggagccgcatcccgcatccctgcagcagcctcgtcagctgtgtgcggtgtggcggtgtgggccgtcccaggagccctgcaaatccctcccaccctgggccttgtgcaggggctcctggatggatccaagaagaagacagtctgctcccccatgccggggctgcaacctttcacctcccggatgcgtggtcattgtcacgtgcatataacaagcacaagctgagcatgggtcccaggtcaggcactcggcctgcagatgtgggagccccagaacatcaggcagagcccgtgccctcagagctcacaggctggtgaggaggaacaagccttcaagcatgaattgtggtgcagtatgattagagctggcagagtggggtgaaatctgactaggtcttgagggatgagtacaagttcaccagatgggaggggtgaaggtcagaggggcacatttcattttattttatcttatcttattttattttatgttatgttaagttattttattttattttattttattttgagacagggtttctctcccatcacccaggctggagtacagtggttcaacctcagctcactacagcctacacctcccaggcttaaacgatcctcctccctcagcctcccgagtagctgggattacaggtgcatgccaccacacttggctaatttttgtatttttagtagagacagggtttcaccatgttggccaagctggtctcgaactcctgacttcaggcaacccatctctcttggcctcccaaagtgctaggattacaggtgcacgccaccatgcccggctaatttttgtatttttagtagagctgaggtttcaccatgttggccaggctggtctcaaactcctaacctcaagtgatttgcctgcctcagcctcccaaagtgcagaggggcaggtaaggccataacactgcctactttgcactaactcactgccccacagaaaactcagagttgatgtggcacatgcaggttatagggtctgcatcaccgctcagttttctggtattgtcactcgattactcaagcagcagacagtccgagggaggaaggaagtaggaagttgtgctaatcagcacccgtgggtggcccagggccgcacacctcccaggagcaccctgctgcccagctgtctctcggtctgcagctgccatgggtgccgcccctcactctgcacagaacttcctcctgcctccctgagagaggctcgaagacccttcctgagtcatcacgacctgaatgtaggtgctttggggaggcaaacgcagtgacccattcaaggatgcttctgtcttgacacatagtccactgaggacaaatgggggtggggaccaggagcagagcaaatgccaccaccacgtgtaaaacaggaaggtcagaacgcagagcagcccagtgggctcggaagggggcatgggctccagggttcccttgtgcagctcaaggagcacttggtgctgtttcagccactcgtcttgagaagcagccacagagccctctaaacccagagcgtctgtgggtttgggaccgttgcatcagccccacgtgcaagggacaggaaaggttcccagaaaggcatggactgacggccagaaataatgcagctgaccgcggtggacaggagcacctcacccgcagccccacctgctgggcccagatgggcccttccccagcagccagacctgctctaccaggaagcagagcctgagaggagggtgcaaggccctcacccaggcaccggaggcaccgtgtcacctcaccttccgtgtgatgcactccagtctgcagtcctgcactgagccagtcctgggccgacagctgggagcccctcttgtaccagacctgggctgatggcatgcagttctcagagacagtccctgaatgcattggtgcaggcagccaagttcaacagccccagacagcacaggggaccccatggggagccaggtcctcccaccaccagactgggaagccgcagccactctcggccttcggacttggctcatacctgtgagtcaagcctttatcaccaagtgattcccaagtacattgagttgaagggtgtcctccccaaaattcacgtccctcctgaaacctcggaatgtaaccttatttggaaataaagtttttgcggttgtaattaaactaagataaggtctagatcaagcttgttcaatgtgaggtctgtctgccacatgcaacccaggatggctttgaagacggccctacacaaatccgtaaactttcttaaaatgttatgagattttttttgtgatttttttttttggctcatcaactatctttagtgttagtgtatttcacgtgtggcccaagacaattcttcttcttctggtgtgacccagggaagccagaagactggacaccctcggtctagatggatccgctcgccatctggcctggtctagatggagtagggtgggccctaaatccaatatgactagtgtcattataagaagagaagaaacactgagacacacacaggggtgcagatgtgagcacagacggggcagggaggccacatggcgatggcaactggggcagagaccgagtgatatgcctgcaagccaaggaggccggggacttcagcacccccaggagccggaagaggcaggcaggacacttccctggagccctcagagagaggaggccctgtgacaccttgaccttggacttctgacctccagagctgagagagaataaacaagaataaacatctgttgtttaaaccacccagcttgcggtgctggttatgatggcccaggaccctcacacacaaggggcgcctggcagcagggtcttttcagcctgtgctttctggtgtgagggaagagggaagggaaggacacattgaacgatcccagtggcttgtctcatggtgacctctcccttcctgccctggcctggctccctggggccctggatgagctcttcccgggtgctcagtgccccctagccaggaccacgggtccactcggccgcctggatgcctttgaccccacacatcgccaggcctcggcctttgtccttcccggcacccatccgattgctggtctccatgagtccctggctatcatcaatccccagacatgtatttgatcccttcccaaactcccctgtcaccagaattatccccagtggactctttcattcccatttccttgtctcaggggaggctaagacaacactggctggtgagggctccgggactctcgcgttctggtggggcttgggctgggctctgcccgatggagggcagggcacgcggcagctcatgcccagggcacagcgggacagagaggcagccctgtgagaggctgtcaaagccaggacacttttcagacaggtgagtggaggtgctgtgaataatgatgccaggacaagagttgtggccagggagtgtgcctggcaaactgggaccaggaccccctgccaagaggacattccacaagccccccactgggctgcagtcatttccagagacttgaacactgtggaactaggacagagggaggaacaggcaccccccccaactttggaaatggagacacagtcaggtgatcccaacacacgtgtggcatagcatcatgccctgacatatgtggtcgtgcacagatggggaaggtacatggatacatgtgtgtgcatctggccctgcaatgggtcggggagctaaggagccacacagcactcacggggccaaccacagcactaggtgtctttgtctttgtctcccattctgtggggattggttccttctcttttggaaagaaaagtcagttaatcctatggtttctaaagtcacaaaacatagttgccatttaggcatagttgccatttaggagttgacatgtccagtcccatatgacaatcaaaattctgaacttgacttaaaattagatgttttcatttgatgccataaaggaattagtggacatttttagcatggggtggatctttgagtgtgtagctctacgtatatgacacacatatggatgtaaacgtttacatgtatcagtatctcttcaaggtatagactgaaatattatgtataatctgtggaattgtcttcaaaataattcaggaaggataattagaggtagtaagtatagataaaacaagattggccataagttgatacttgctgaaactcattgatgggggttcatcatactattatctctactttaatatatgtttgcaatttgccataattaataaattgaaccctctccctctcctggcctgctgctccaggggtaggaacagttgttggggcaagggcagggtagaggggagtaaggggaactgggaatggggaacggaagctcttcctatactggactgatgtttcccaggttggctccacattctctgggcccatcaggtgcttgaaacaaacgccttatctcatgtgctgcttccggggggtcttcaggggttcctcatctgcagatccttggacactggggatgcactttccactagctcatcaatttctcctcccatccccgggaacatggtgttgtctttggtttctctgagatgatgtctgctcccacctcaagtgtctctcttgtacaaagtctaggatgacggacacagttctcttgagctccatggcttacctgtggttcaccggacacatttgtgcctccttcaccccaacacactctgggatgcaggcagatcctaacggttcgtcctgttcctcactagatattagagtccccaagagtcagaaaccggtgtcctgtagcctccaaccatggaggacatgcaccacgctctcttggtggacccactaagacctcattcctaagacctgagactagagacaggcacaccccacccttaccccctgtggcaagatgacagtgagagagactcacagcatatcagcaactccttaaaaattctcacacttagcattttctacaaaattcccttcccttaaaccttttgtagcatcagtagaggcaaaatactgaagaatcatctaacaattctcagccaaattgtttttgatgtttcatggtctattgtctcactttgaaatatgacatctactgtttcttgatgtctcagctaaatctcctctccaacacccacaacaccaagagttccaactatatttattcattgtgttacgggaaaggcgtcctgatccaaaccccaagagagggttcttggatcttgggcaagaaagaattcagggcgagttcacagtgcaaagagaaagcaagtttattaagaaagtaaaggaataaaagaacggctactccatagacagagcagccctgagggctgctggttgcccatttttatggttattcttgacgatatggcaaacaaggggtggattattcatgcctcccctttttagatcatctaaggtaactttctgacgttgccatggcatttgtaaactgtcatggcgcgggtgggagtgtaaaaatgaggacgaccacaggtcactctcgtggccattttggtttcagtgggttttggccggctccttcactgcaacctgttttatcagcaaggtctttatgacctgtattttgtgctgaccgcctatctcatcctgtgacttagaatgtcttaaccgtctgggaatgcagctctgtaggtttcagcctcatttacccagctcctatttaagatggagttgctctggttcatatgcctctgacaattggattctgtatttagatataaaacccaaagacagaggtctaaatgtgtttcttgagggctcctactgggcagataactgtgacagactttggtgagagagaacaaaggcaaaaaatgtgtagctccttcccatgagagactttggagtataagggaagactagatgtgcagacaaattatggactttaccgaagggcctgaaagaagaattgaggaagcagagacgtgcctattcaaggatgagaagaccatggattctaaaggtggtaattttctcaaaataaactatatattcaacttattttctatcaaagtctcaaaggaagattgtaattaaatgtcacaaactgacttcaggatttaaatgaaaagataaagcaccaaaaatacctagtaaaagtttaaagaacggttcccaggaagaggaaaagaagaatcagaagatatctatcctatcagacattaagactgattacaaaactactgtgtttaaagcagggaagtacgggtgcggggataaaatcagacaactggagcagaacagaaaggtcagaaatagatccatacacataagaaaatgtggataatatatttgatatcaatggggaaacaggacaattgaataaatggtaccatgacaatcagttatctgtattttaaaaagacaaattcagatccccacctaatgacgctaagctatttttaattatctacattgaaaaaggtaaatttagaaccacaatttaacaacccattaacaagttttcctctctgccctggctggcttcctggggagctggacgagctctgcctgggtgctcagtgcccctgagccaggacacttagtactgcggtccgtcccgtttatgctgtgtggctcctcagcttcctgacccattgcagggccagatgcacacacatgcatccatgtaccttccccgtctgtgcatgaccatgtatgtcagagcatgacaatatgccacatttgtgttgggattgcttgtctgtgtctccgtgcccaaaactgggggagtgcctgttcctccctctgtccaagtcccacagtgttcaaagtgaattacaggcccaaagtgaaaagtaaaactttaagtcactaaaagtagagatagtcaaccagctcatactagaccctgcccttcttgatataacaatgaaaactctggaaaaagcacaaagcaatggcctgatggcactggaaagtgagaaaaacaaaccaagcacagctgtctgagatcctggaggggagctgaccctggaagaaggagagggaatgctgcgaatttatttctgtatgggattttgcctgagggtaggtcacagtgggtgttgtatagttgcggctaaaacaccagtggaaacctgtggtccttcaggctggagaatcactgtactgagaaaagggcaaacccagctgcaggaaagcgaaagaggaatcccagaaaggagagagctagagaggagaagctccaaattctgtgtgaaaacccttcccaagtctctctctgacccatggaccatccacatacaggacagactctggctaaagatgaagaaactgaagtttgaatgacacccaagaagcagagtttgacgtttgaatccaatggagatgattgcctgtcaaaacaaacatacaaaataaataaacaggcaaacacaactatcttcagaggaatagaacagaatctgcattccccacaacgtagcaacacaatgtcctggccacaatcggaaattactaaacacacaaccaacaggaatgtctcatgcgttctgaagagaaaaaaagccatcaacctgagatgacccagacattgcaatgaccagataaagattttaaaacaattagtataagtatgcttgaggaaataaagaaatattgcttataatgtatgtaaaaatagaaaatcccagaaaaagaaaatttaaaaactgtgtaaaaataaccaagtagaaagtatagaactgaggggagtcaggtgtggtggctcatgcctgtaatcccagcactttgggaggctgaggcgggtggattacgggaggtcaggatttcaagaccagcctggccaacatggcaaaaccccgtctctactaaaaaatacaaaaaacaaaaaattagctgggtgtagtggtgcacacctgtagtctgagctacttggaaggctcaggcaggagaatcacttgaacccaggagatggaggttgcagtaagccaagatcacaccactgcactccagcctgggcaacagagcaagactctgtctcaagaaaaaaacaaaaagaactgagaagtatatgtgtgaataataaatctacagtgaatataaactaaataaataagtaaatgaaagaatagtaaatatgtacatgaaagtaaaacgtattgaagtcttagagtaaagtgaagatgacagaggaaagtcaattaacgtaaaagatagcacactttaaattatccagtttgaagaatagaaagaaaaaaaaggttgaagaaatgaacaaagccccaactacctgtgggacaatatcataaagtctgacagcgtgaaatcagaaaaaaaaaaaaaaaaaagtggccagacatggtggctcatgactataatcccagaactttgggaggctgaggtgggaggatcacttgaggccaggagttcgagaccagcctggccaacaaaacgaaaccctgtctctactaaaaatacaaaaaaattagctggacattgggatgcacacctacaatcccagctagtcaagaggctgaggcacgagaatctcttgaacctgggaggcggagactgcagtgagccgagattatgccactgcactccagcctgggtgacagtgaaactctttcaaaaaaaagaaaaaaaaaaaagccagagaaaaaattaagaatgctgaatctttgagaagatatttctttttaaaagataaacctctaacgagactggtcaggagaaaaaataaagaaaacacaagctaccaacatcaggaatgaaagataggctattactatcatggtacagacattaaaaggataactagataatatttagagtaacttaataccaacaaatttggtaacttaaatatgaaatgaacaaattccctgtaaaacacaatttaccaaaatggacacagacaaaaaataggaaacctaaatagtcttatgtctattaaaaattttgaagttgctatcaaaaaccttcctacaaagaaaatcgcaggcttgagtggtttcactgttgcattctaccaaacacaaatgaagacctttaatccatacaaacctaggaaaaagatgagctgggcatattttccgactcactttatgaggccatcataagcctaatatgaaaacttgacaaatatattatgaataatgaaagagcaacatcaacacagattgaaaaatacttataaaaatattagcaaattcaacccagcaagatataaaaacaatatgtcaagatgtagatttttttttctaagaaaaacaaggtagagtttaacatcaaataatcaatgcagtttaacagaaaaaaattttaaaacatgtaatcatttcaatgaatgtgtaaaaagcgtttaacaaaattaacactgatacatgataaaaattcccagaaaactcggaataaagagatcattcttaagctaataaaggaaatctacaaaaaatacaacattatactaactggtgaaatattgaatattctcctcctaaaatctaggccaaagcaagaattcccactctcatcacttttatttaacattgtaatggtgcttctagcaatggtataaagcaaggaataaaaggcataaagatcagaaaggaagaaggaaaactgtctttattcaaggaagatcatttgattttcaattgcctgttgctaatatatgaacaccattgatttttgtatattaactttgtttcctgtaaccttgttttaaagaattttttaaatagattttttaaaggatgctctaaaatagcacaaatcatgaaggtgcagttgataaatctgactcaattacaattaaggatatctattcatcaagacatgatagaggagtaaaaaaaaaagtctagtcatgaactaggaaaagatatttgaaacccatgtaactgacaaaggattgctataaaggataggtaaagaactccttcaaaccagtgagaaaaagacaaataacatgattttttaaatatacaaataggattgccactgaaaagaaaagctaggtagtcaataaggatatggaaagaagctcaacctcacaaaaagtcaaggaattacaaataaaccaatgttaaaatatcactttacttaacatcagattgcactgattaccaaatgtcgacaagttgtggagaaatagaaactcttatgccaatctggcaaaaaggtaattgacacaccctctttggcaagcattttgacaacagccagtaaattgaagaagtccgtattgttctgatagaaagaaactggaaacattatacctagttgcctatcaattggggattgaatcctgtggaatattatacacatgttaaaatgaatgaagcaaatatatttttattaatgcaaatacatttcaaaagttaaaaataagatataagttgaaaaggctgcatactaggataccatttctgattattttaaaaaacaacaaaataataccatgtattgtttatgggtatcatgggaataatgcccactgactcaggaagagtggttaattctggggagggaggaaaaaggatggattaaaggagtacttttatgattttatttctttttaaaatgagaggcatttttaaagtgagaggcatcaaggcataagtaactgacaagttgatgaatctgggtagcacatatatagatgacactacattagataccattcaaggaaaggcatttgacatatggctatttaaaatttttatttaaagaaatccaaataacgcaggtggtgtgggcagcaagtcccagctgctgggtgtgagagaggctgggagaagccagccctgaggctgggagtggcacatgggtcctggtttgggggccattctcatgcttcatcccggttgcctggccaataccccaggggtttatctggtgagggatggggaagggaccactgacagagtaggagcattgccatcttggacaagcaccgccattttaaagttcaccttgatcaaaaactgcctaaatccaaagggcatcagcctaatggctaaggtcagcaggaccataaaccacaaatgacatctctgaccagaaactttccaaccataagaaataaactcctccccgaccagaggcatgccaggcccaagataacctcccctccagccagagacattccaaccccaccataaagttctccccaacacggaaacattccaagcttgtgataagctctcaccctaaaaccaataaatactcttagtctgtaagagagagtgctcctgaccaaagtgaccagaagcccctctcaggtttattctccaaaatcaacctgtctttgactgttgagccactttttgcatttctttcctctttctttaactcttacaaccacttttaaatcccagaagcatccagcttgatggcaaataaaagtcttaagtcctttcacattttaaaattttaattcccaggtctttgggcccctgcagtgcaatctcaactttctctctatattagcagagtcgacagatccacctgaggatgagtgcctgactgtgtcctggacaagcaaggagcttgaactagagagggaattaacatcccagtggagaagcactagaaagagtcaatgtttaatacaagtaatctctggatcaaatgcaccatgggtgtgtcacccatgctgtgccccaggtcatccctcccctcgaagtctgtcagagaacataaactaaagattatttttctgacttcttgaaaatgaccattactttgttcaaagagaagaagggtcattggtggctgctcaccactagaggagaagaaacggtctctttgatttttcatgggaatctagaaatagaatggtcagaattgaaagtaccttacatctcataaaatgcaaccatagctggtgcctaatcccaccacattctctgcaattgttagcctagatgactagagagtagtttttagggaattcaaaagaaattgaaagcagggcccacccttaagaaatatgttgtctaccaaaacaaaaacatggtgggactatcagaactgcaaagtgactgtatgagatggcccagatggaaaccacacatgacctctggagccttaccctggggcttccctgtttgtgcagagaaaagggtgatttccctgtgtggaggaggagccccttacagtcggctacctttccagggctggtgtccacaggactctgggtggtttgtgctaaaggtgccctgtggacatttcttaggtttgaggcaggcatgcctctcacttgactcttcctactcaccatcagctccatgtttcaaaggatgctttttccctgctgtaatgtattcatctcattcactgtttactccatccaggaactgaaagcaaagtgtgagatcacaaaatatggcaacatcttcaggcaagagcctaccttaattgccaatgcctcctggtggctcttcattatagaggcagcccatgttctcaagacttataatagccctgttttacatatcaaatggcaagaagctaaataccaactctccttaatacattattcatacttccgtggcactcatatgatatcttgtttttcaatgtcttaaggagttttaccaaagagttaagatttgttgagttcctatggacagaagtattattgaacaaagaatatcagtcaatatttatttaacatccactgtgtgcacagccttcagtccaggtgctgtgggaggttacaaaagaagaagatgatatggtcagtgttgataagaaagctgcagtcatggaggcatcataaactccaactcagcccccagcattatgaaatccatgcagcattcatatcgatatgtcgtgtcctctagcagctcaacatattaagaggggttgagaaggtaaatatggtcatttaaaaaatcaattcacagatacacatacagtcaacagggaggaaaaatatgtggttttaggcctcaatgttagcacaacactcctaatagaggaagtcttaaagggaaagaagactctgaattggctctgccaggcagaggtgatctgactgagtcaatggagatgtgttacttgagaggtgagaaagaggatagtaaatggagatgcaacaagaaaatacctttctccagggcagcagggcagggccagacagtcctgagactcagagtagaaatggtggatgatgccctggacagcccttgggcagaagagtacttgacttccagatggcagctgctcaagaacccaaggtgcagtggccatgacctgggctcttcactctcctctaccctcttaggttcttcagctctctgcaaattaaacttgttaaaaaggaagattaacaggagaaaaagaaaacaaacttgatgttgatattttaatttttaagtgcatagagaccttcatagaaaagaaatgaagatcccaagaagtggttacacctaggggcttatataccactttaacaataggtaataaattatggagaagtgataaggggaagggaaagaaatttggagtcctagaggtgggaaattgtgggaaggtaaatatctgagggaaactaatggaagatgagggttattttagtaaagttcatttgtgcagacccatctcagtgccaactttcagtcccctggtaggggagagaggaagaaataccttcacaaaggaaaatttatgtcctgctttgaggcagattaaggaggccaaagtgctctttctgcatttgatgcttcttcattgccttcatctcaaaataattcctattccaaagcggcatatctcggggatagcaattctgatctccttcactttcatctctgctgaggtacaggaagactgacaggtgatgccccatagggtctagagacagaaaagtggaattcaagttttgtgggtgtcattggacatccagccatagtttcctgctggataataatgatgccttccttgcccaccctcgcaaggtaggtgtgaggctcaagcaatggtaggcagtgcaacctgaagggtgaagcactgtccacctgctgttagcagatgtcattgctgttataagaagtaaacacacaatgactactctatagtggttgtgactgtctcaagatgcaaactctgtagacatactcaatcagtccctcatgattctgttcagtttgacttgacctaactcaccggccagcctcctgggctgtctccccctcgaggtttcatgcccagagtgactgttcactcctggagcagatccttgccttcaccatcccttctagctcttctcctgagcctcctctgcttgggtgggagtggctctcagctcagctccctgccaccccagctgcaggaggatggaagtcattgattgcagtagggtgtgtgtgaaagtgggatgggtaaatgaagacaataaaccatcttgacctggcccgaagctcacaggtttggagccttgcagtgcagtgctgacctctgagcccagaagtcagttttccagcaaatggcatggctctggtggctgaatgattaaaaaccttcagcaaaggaggctgaatgcctgctgatcatcagacttttatagattccaggtaaagcaaaggcaggaagagaggcagggaccctgggcttgtttatttgacataatgagggttatttggtcataattcaatacactcaatgtgccaaggtacagtttgcaaaagaacacagccataaagcaggtgagttcagagaaatccagagataatacaaagctcatggggttattgtgagtgacaaggaatgcagaagcaagcactgggatcgcatttcccaacccccaccccactccttttttttctgagacagagtctcactctgtcacccagactggagtgcagtggcatgatcttggctcgctgcaacctccaactccagggttcaagtgattctcctgcctcagcctcctgagtagctgggaatacaggtgtgcaccaccacgctcagctaatttttgtgtctttagtagagacggggttttgccatgttggccaggctggtcttgaacttgcgacctcaagtgattcgcccacctcagcctcccaaagtgctgggattacaggcatgagccaccgcgcccggcccccaaacctttttgacttgtgaacacatttcacagggaaaagaacccatcttacccatcttgtttggaattttacaaaaacttatttgcagtaaccttgtctggcataagataagatgaactgatataaaactattttattttagataagcgtttcatcaaaaatgcaataattcagattatggtcatttgttttcctttttaaccttatttttaattctagagaaattttgatgtgctctatgagacttttaagccaatccatcagataacttacctattgaaaagcataagatgaattggcactattgtcatttttattattattgtcttatcctcttcctcattagcacctttcttctcttctctcttccttccttcattcctccctccctctctctctttctttctttctctctctttctttctttctctctctctttctctctctctctttctttctttctttctttctttctttctttctttctttctttctttctttctttctttctttctttctttctttctttctttctttctttctttctccttttttgacagtttcactcttgcccctaggctggagtccaatggcacgatctcagctcactgcaacctctgcttcccagggtcaagtgatcctcctgcctcagcctcccgagtagctgggattacaggcacacaccaccatgcctggctaatttttgtatttttagtagagacagggcttcaccatgttggccaggctggtctcaaactccagacctcaagtgatccatccaccttagcctccctaagtgctaggattacaggtgtgagccacctcgcccggccccctacatttcttgactggtatttcttttcctttctgctgttaaccaacagctattctgatgaaaaattaatcaatatattgctaaaatcatagagctttgaagcacttgatgaccaaaactgatgtaactactaggaccttgagctgagcaggggctgcaatctcaacatcagacaaaatagaattcaggccagcaggcatcagacatgatgaagacagacgcttggcaggtcacagttcacaatggagcaataacagttataaatatttttgcaccaagaaagggataggaaaagtatatttattttataagccagaaacagtgagatacaagcagaaatagacaaaacccataactggtcatgagaacatcattctgaagataagacaagtcaagtgaacaaagaaaaaagtaagtaaaaaaatagaactcaaggaatataattaataaggcagatctgatgaatagacatatacactgtgtatgtatgtatacatatggatatgtcaaagtttaattcccaatattaatacaacttcttctcaagcacacatgaaatattcacaaaatttaatggtacatttgcacacaaaaaagcaataagttccataaagtaaaagttttggctgggtgcagtggctcaggcctgtaatttcagcactttgggaggccaaggagggatgataacttgaggccaggggttcaagactagcctggggcaacatggcaaagccctgtctctactaaaaatacacacacacaaaattagccaggtgtggtggtgcacgcctttaatcccagctacttgggagactgaggcatgagaatcgtttgaacctggaagacagaggttgcagtgagccaagatcatgccactgcactccagcctgggtaacagagagagactctgtctcaaaaaaagaaaagtaaaaatgttataatcactctatgatcaagtgcaacaaaaccaaaaaatattaacattattgcacatggaaatggaaatatcttctattaaatacttgtggctaaaagataaattactaaccaaaattatagaatattttagaaattatgataataaaaacaccacatttctgaatctatgggcaatatttaaaatggtaattagtggaaagtgcatagatttaaacacatgccattaatccataaattgaattcccaaaccagaaaactaggaaaagaatagcttgttgaaaaaaggctgaaagaaagcaaagggaaagaaatcaatgaagtacagaagagaaaaagagtggaattctttttcacaaattcaatcccagttatttttaaaaattaaacaaaatatgcaaaccactggctaacccaataaaaaaaatgaaaaaaggatccacaaatatccagaataagaattgacaatgaaggaaacaactattgaaacagaagagtctttaaaaacggtaagaggctaccctgaataactttatgcaactaatttttaatatctagatgaaacgcgtaagttcctaggaaaataacagtttaacaaaatgggtccaatagagacatagggctgaaataaaccgtagaagaaatggaaaacgttatcaaggagctgtcaacaaaatcattaaacaggattttgcttatttttttaaaaaagaaagagactttattccagtaaacattttgcaaaccagggagacacccccttcggtacaaaacaaaggtgcaatctgagacaacaaagagaggggttgtcttttaaagagaaagctccctctgggttcccactctcgtctgctatgcaaataggggatgcaaacttgcttagctgtggttagttgacgcttgtttagttctgattggtagatgtgggccacattctcctggtgagctccaggggccgaggggaggctttccagtagccgttgatacaggagtgaacaggagcagctatgaatgtcccagaacgaagcaaacatgtgggtttccaggaatgcagagtacgtgtgtgacgtctagtcagcaaatggccacacggctctattttgaatttagccccagttggctccccgggatccaccttgaagggctggttctttcgggattcccagaaaaaaaagccgtaagaatctccatgtccagataatctcacagggaaattctagccaagcttcaagtacctaacagtcccaatgctgcaaaaattgtttcagacacttaaaaacaaaggaaaatgcacaaatttatacaaaaatgtgaactgaaaatgtgtcatagacaaaagtataagcaccaaagttataaaactcctagaagagaatataatagaacacgtccgtggccttgaattaggcagagatttctaggtaggaaacataaagtttgaatcataaaagaaaaatgagaaaaactagatttcatcaaaattaaagatattttctctttgaaaaatattcttaaggaaatgaacgaaaaggtaagtcacagactaggagaaaatatttgcacaaaatatatctagtaaaggacttgtatgcagaatatataaagaattttacaactcattacaaagaagaaaaagacacctgagttaaaaagtgttgaagatttagacagatactttacctgagaagatgtgtgaaaaataagctcatgaaaagatgttcaacatccttagttactagtgaaatgtaaattaaaatgaaaacaggatatcacattccacacaccacaatggctaaaatgtaaaagactagtaaaccaaggatgtagtaagcatttgcaaatctcctccattgtggctggggagacaaaatggctcaatccttggaaaacaattttttcagattcttatgaagttaaacataacaccgtactatccagaaatccactcatagctacacttccaagaaaaaaggcatttcctcaagcatttacccaaatcccttcacatacatgtgcataattgttcatagtaactttacccataatagtaaaaagctgggaataatccagatgtcatcacctggtaaataggtaagcatattgcagtgtatcctgctgtggaatactactcagcaatgaaaaggaacgaaccacccttctgtgcaacaacctggaagaatctcaaagaaagctgtgtgctgtgtgaaagaaaacagacttcaaagactgtgcactgtctgcactgtgtgattaaacttacttgaaattctagaagaaatgaaactaaagcaaaaaaacacagattcttggttttctggcgctagggagaggctattgacagcaaagggcacgacgggattttcttggagggaatgaatgttctacatcttgattgtggtagtgtttacacagttgtatacatttgtcaaaactcaatgaactgattcatttaaaatgggtgagttttattgtatgtgaattatacctccgagaaactaatttttaaaaaaatctcaaggcatgagcattgccatcatcagcgttactaatgtgaacacagtgaactgatgaaatgacggggcaatttgcaacgtgtgataggcactgagatctctctctggacatcaggaagctgcgtgttgtcagatgccgaagccgaacccacttgcccattgggctgcaggaaggctgagagtctgtccccagcatggatagcagagggcgctgtggagcatcattagcctgtagggttctttaggggaaaacaccttaatgagccctgtgcgctcggaaggttgaatagagggcccttccttcctctaagccacatttctggttgcgccacattaagtcaaacaattattaagtgctgagcagtctttggatcacagaaaacaaacacagaggctgcagccactgggccctgtggaaaactggcggccgtcctgcgatggtgtcagctcatccgtgtccgcgctgctggaggcctggcaggagctgagatcagagcccttcagcgggagtggggctactcctccctcccctggtttccctggaagctgagaaagttcccaggaaagtgctgaaaacctcccaccactctttacacagacctgagagggggctgaggtgggggaagctctgttgcagagatgggctgactcggggaataggccggtggggcgggacagatgctggagggacagatggggcgtcagaggagacagaggctgtcagggagctgtggtcctgcacatgggaaccagtccttgcccagcctgtctggaggcccctgggctgctgctagttactgagagggcgcagtggccaggctgcacctccctgtggcctggtccctccactagctggaggaaggtggggctgctccctcccagccagtgccgagtggctgcagacccagaagacacacgctgtatatattcctgcatgcatggccctgaaatggtggcctcatgggttgcagtgtccacgctgcttccacaaggaagaaacggctgcttgctccacgcctgggggccccaaggctcaggcatccttgccgtggcccacccagcaaagtgcagcaagagggaaggcaacacgcctgcctatttcactggcaagggcaggcccccaggggtttctgggagaggtacaatagcagagttccagcttggggtggggatagctatgtgtcaggaccacagcattagccagggccacaggcaggtgaggcagaggtaggcaaccatggaagagcccctgggagaggaaccccgatgtgcttatggaggggcttggtaggcattggccctcctgtgtgagcaggtggaatgctgagggtctgatggccgggtgcccgccactgggacagtcactgtgagacaaccaggaccacgtgtgtcttcccggaagaatgggcctaggatatgaggatgtgcatgtatgaacaatcatagcaagaacagctctaagcacatcctaattcaactcatgaagcctcaccacaaacccagaagggaagatgttatgaatatctgtacttagcatatgagtaaaactagggtcaaaaagtctacgtaacttgtccaaggtcacacagtgaccctgagagagaaatcgctgtagagccgaagtgcgatagatatttttgagatctgattcacacaccctcattgcagccccctgactccagttaactgcccagcatcccatggtgggggtcagattgggcttctaaggcagggtgggttgagggggacatcacactggggctggcccctgaagcaatagctagagatattcatgcgtgtaccacaactccaaactatagataatgaatataaaatgcatgtaatgaatatgcagtctattcccattacatattctctatttgcaaattcgcctactcactaaaatttattggtgaccctaaatcaatacttggggtgctttcaaggtcgtttgcagaaacgtacaaagtggtgacaaatttgagtcacagacatgcatattcccaactgaagtcacacaaggccttttttatttttgagatggagtcttgctcttttcgcccaggctggagcgcaaatgtgcgctcgcagctcaccacaacctctacctccaccacccaggttcaagcaattctcctggcttggcctccagagtagctgggattacaggtgcctgccaccacacctggctaacttttgtatttttagtaaagacagggtttcatcgtgttagccaggatggtctcgatctcctggccttgtgatccgcccgccccagcctcccaaagtgctgggattactggcatgagccaccatgcccagccacacaaggccttcttgcctcaacccatactgtgaactaatgtccttttcttggtctatgtagtgccacgtttttatgcctgttgttggtgatttcccatttaagatgcccccatgtgccatagtgaggagctgtctggtgtcctgggtgtgaggtgatatgcctctggggaaaacaccaggggcagggcagcctcactggggctgggagacagggtgccggcctggagttcagcattaatgtaaccaccgtgtgcactccacaaggtgtctacaggaaacaccctcgagcctggctacatatggctggttaatgaaatgctcccagaagcttgcagaaacctgaccctgtacttccccaggagcgagggttccagattcactaagtcagggctggcagcgacttcatagagcttaactacatgaatgccagaacgtactgtatagatacccactataaatcagcactaaagtgcctgtgcacatacagctgtgcagcacttaacgacagggaaatgttgtgagaaacgcgtcatgaggggttttgtcgttgtgtgaacaccgtagaatgtgcttaatgcatagctagagggcagcgcctgctgcacacccaggctgcacggttggctcccaggctgcaaacccgtgcagcgagtgactggactgaacactggaagcaaccgtaacgcagtggtaagcatttgtgtatctaaacatagaaaaggtacagccaaggccgggcatggtgacttatgcctgtatccccagcactttgggaggccgaggtgggcagatcctgaggtcaggagttcgagaccagtctgaccaacacggtgaaaccccgtctcaactaaaagtacaaaaattagctgggtgtggtggcgagtgcctgtaatcccagctacttgggaagttgaggcaggagaatcacttgaacccaggaggcggaggttgcagtgagccgagattggtgccattgcactctggcctgggcaacagggtgagactccttttcaaaaaaaaaaagaaaaaagaaaagatacagtcaaaacatggtgtgaaagataaagaatgggacggtatgtaggcacttaccatgaacggagcttgcaggaccggacaagacagggagggagtggggagtgaattcgaaggcccaggacacgactgtcctaccatagacttcataaacacacgacatttataaaaaatactattctttcttcaataataaaattaacctcaacttactgtaacatttttactttatattttttttaatttttaaaaattcttttttttctttttcttttttttttttttttgagatggagtttcattctgtggcccaggctggagtgcaatggtgtgatctcagctcactgcagcctctttctcccgggttcaagtaattctcctgcctcagcctcctgaatagctggcattacaggcacctgccaactcacctggctaatttttgtacttttagtagagatggggttttaccatgttggtcaggctggtcttgaactcctgacctcatgatctcctgcctcggcctcccaaagtgctgggattacaggcgtgagccaccacacctggccaaaattctgactctttttaataatacttgcttaaaacacaaatgcattgtgcaactgtacaaaaatattttctttctttatatccttattctataaactttttagtaattttaatattttttaacttttttagactttttgttaaaagctaaaacaaacacacattagccgaggccctcgcagggttaggattctcactgccaccgtcgtccacctccacatctcgtcccactggaaggtcttcagggccagtaacacgcaggaagctgtcatctcctatgataacaatacctgactctggaacctcctgaagggcccgcctgaggctgttcacagttaactgtttttatataagtagaaggagtacactctaaaataacaataaaaagtgtagtatgtacataagccagtcacactgccatttataatcatagccagtattaggtggtgtacatgattttatgtgctgtactttcatacaactggcagtgcagtaggtgtgttgactccagccttcccacaaacagcttagtaacgcgtcatgctgtgacgttacaatggccctgatgtcaccaggtgatggaaatttttcagcttcattgtaaccttatgggatcacagtcatatacgaggcccactgttgaccaaaacattgtcatgcgtggtgcatgactgtgtatgcggcgagcgctaggtatagtgaatatataaagaataagtgtgtgttatccaggattaccacattctggaggcagagctggctgtcctacatggtacttggaagaagtttgtttatttttttgatacggagtctcgctctgtcaccaggctggagcgcagtggcgtgatctcagctcactgcaacctccgcctcccaggttcaagccattctccttggaagatgcttttttataggaggccacaggacaagaccacaaggccaccggcggcctctggcaggagctccatgtagtgggggcctgctgtgtgcaccaggcagctcacaaacattattattattattattattattattattattattattattattattatttgagacaggatctcactctgtcacccaggctggagtgcagtggtgtgatcacggctcactgcagccttcacttccccgggttcaagcaatcctcccacctcagcctcctgagtagctgggactaaaggtgtgcccagctactttttgtattttttgtagagatggggtctcagcatgttgcctaggctggtcttgaactcctgggctcaagcaatcctcctctcttggcttcccaaagtgctgggattacaggactgagccaccatgcccagccacaaacgttatttttaattttcgccagaaccctgctagggaagtaatcattactcatattttacaaacagaaagcctgagaatctgagagatttttaaaaacctccccacggtgacccacctgggccatcaacctgcacacatggtgacagctcctgctgttcccacccccagcgagctgaccgaccccgtctcctataattgcttctcaagccatctctgttacctggaccagccaggcagggacctggaggagcgcagggagccaggagggcaggcagttgacttgagggccgcagcggctgtcctggttaggtcgatggccactgggccctcccgccaagcctcaccggctctgccatccatgaggtccctgcctgcactggatagggattattggagcctctgcagggaaagggaacagaagggaagggaaccaggggcaagcagaggagacgagaagcagcaggagaccccaggaggaaggggcagggaggcaatgattgggggagaaaatggaaaagagggcgaagggaaaaggaagccttgttttactcaaggggtgggttcaaatgtcaccagctgttgctccagggcccctggggggaccccccaaaggaggaggaagggggtggcccactctgagctatcttgtggtggcacgtggttaattaactcactcatagtgctggagccagcaggagctgtactatcggtaacagatcagagtggcccacggacccccaagcccaggcccatggcaaacacaacggaagttgcttcagaatgcctgctcaaggatccgaagggcaatgtaggaactggttcagaaactggggccttcatggatcagagaatttctgaaggaggaaatgggattggagtaccagcatgagaagaaagttcccagaaagacaccatgggaaacacaagtgcccacatattaaagacgttcctgcacctagagcctcatgccaagtggcctgcagacaactgcctgagaacaaaagtctgcagaccagaaactgcccgaagaggcatgaaaccagaagctttcacctcatccggcacccaagaaggccccagtgccaactccgggagcagaacctccacactcttcacccgggaggcacagaaaattcacatgcccctggagagcatgccaaccaccctttccaggaatccactggcctgatttggcttttccgccagtgtggccagggctggctgaccctggaacccataaactaagtgtactgggggggacaaacgagagaggacacggcagtctgggaaggataaattcacaaacatgagcatccgtctccgccacctgattatcttgagtgtttctgagaccccgtgttgctaacaagggccactgttcattgagctgatgatatgttgtaggtaagactgagacacagctgagacccaaggcagcatgtggcctcctcgcaaagcaggcatccggagagttgatgtaaggccacatccgttccttgaagaagcacttcctaatactcccatcttccaataggaagctagtggcactggccccaacccaccctggagggcagaggccttggattttctggggtgacaggagtgggctattgggtgacacatttgctaaggcaattggcttcgggtaggagagggatgttgggggaagcaacagaaagactggcctagcgtcatccactctgcactcccaccaccgagctgaatgacaccaggacctcttaaaggagacacaaaagaatctttcaactaaacacagagctgctattcaatgcagcagtccccactgagtatctatccaaaggaaatgaaatcattctatcaaaaagatacctgtacttgtacatttatcgcagcactattcacaatagcaaagatatggaatcaacctaagtgtccatcaacaggcaaatggatttaaaaagtggtatgtatacacaatgaaataatattcagccataaaaagaattaaatcatgtcttttgcagcaacatggatggaactggaggtcattatcttaagtgaaatgaactagacacagaaagtcaaatatcacctgttctcactcgtaagtggatgctaaaaatgtgtccacgtgcacatagagaggaatggtgggcaatggacatgtggatggctgacgggggtagggggcagatgatgagaagttagttaatgggtacagtgtacgtgattcaggtggtggacaccctaaaagctctgacttgactactatgcaaactacacatgtaacaaaattgcacacgtaccctgtcaattggtacgataataataataataatgaataaataagaatatttcacacagtgatctccgcacggctggcattgccttaatgaaatgctgtcaacttcctcccttgaatatcctcaactgttagcagattaccaaagctaccctcaggcagaggccagaaaacacagaagcaaagagttgggagagaatttttggcctacctggtcaaggcccctccctgcttgccttagaaataggagacgaccggctgccgcacaatcgtctcaaaatcgaggggtctgcgatgcattcggtcaaagagaaaggattttgcaattgcaatctgaagtcacgtatcactccaagaggtttttagggctagtcatttgagtttttataaaaaggactgagaatgggagttacaaagtgattgtgaattctgaaatgttcttacatgcaatacttttttattgcttttagagaaacctgaatgtatttgatgaattttttctcttagaaaaatggaagggacattaaaactgccaggcatggtggctcacgcctgtaatcccagcactttgggatgccaaagtcatccactttgggaggaccacttgatgtcaggagttcgagaccagcctggccaacatggtgaaaccccatctctactaaaaacacaaaaattagccagtgtgatggtgggcacctgtaatcccagctactcgggaggctgaggcaggaggatagcttgaacctgggaggaggaggttgcagtgagccaagattgcaccattgcactctagcctgggtgacagagcaagactctgtctcaaaacacacacaaaaaaaccctgcatatacactcacacatatgcacattcgcacatatacacacacccatacatgggtacacacacccatacatgggtacacacacccatacatgtgtacacacgcacaccaccattaccacctctgtgttaatgaaaccaaaaagaaatttagcagattttaagggttttatttaaagaaattatatgttaaaccattgaaaatgaggaaaagatggttaagaaaacccaggatttcatgaagtatgaagctgataaggcgaagtttcttctttggtttcggaacacccggtgagccagatgcatcctctggaaccagcctctcttagtaatggcagtctagaagtttaaatgcaagatggttggtaagggaaccccagaaatgggagtgcctaggctgcgaagctggggtgggcgtgcatcactttgcccaggagcttcctactgaagaaggagctcctttcccggggagggggtgtaaagggaccaaatcttcccaccccaggccagagtttcctctgtggggcgcattctccccagacaagtgaacattttctaggtggacctttaggtcacataaaaaaaatcactcggaaaatcctgaacatgaaatatttcgctctttggagtgctttgatatcctaacaaaaggaaaagaaaaggcatccttcaagggccagtagctctttccccattttcctggatctgcttggtctttttttacctcgccacactccgagtcaggaacacactatcactaagcgggtgggagaagtggacccgttcacctctgccggcgggaccctcccgggactgcccggagcaggacgttgtggatgaggtttgtcattcggggtcatgtgggggagaacggggaagccacgggagaaggggccaggtctgcttgagttgggccctctctggtacccagcacagtgcaagacactcagtagcctccaaatgcagatgggcttgcaataaaacaggcaacgcctctgaacgttgcaacacctggggaggcaacagggatgagccgctgtttctagagccatcacagatgacgcagtggcaatgctggaggctataaacttattgaaaagacgctgtctttgccaagaacattctggaattgccttcagaatcccataggaggcaggggccctggcctcgatggcactgaggctgcgaggcagctcccctccctgcaccccacctctacggacggaggaggaatcatggtgtccgggaaccagacagagagtcccacagcgacgttaccttccacagacttcgggaagaagcaccagggcacttcaaagatgaagttggagaagcagcacttccgagaggcgcattcctcggggctgatgcccgggtagccacagtttcttcggtctgagacctccatgacgcactgatccgactctgccatgggacaggcacagcaccgagacccagtcaggcctgctgtgccctggaaagctccaccccttcctcctctgagagcagcgctgatttgcagcctccgtggatcatgaggtgctgcctggggcagcatcccccgggacggcctcccccggggactgtggaagtgtcggcccctgggaccgcctcccccggggactgtggaagtgtcggccccagcgacgcttggctggcctgtcctccgcgaaggtggggcccatgtggggtggtcacagtcagaagctctggagtcccccgccttggggaaatcattttgcctctcgggactcagtgttctcagtaaatggggtggtcccccgggccaagatgagaaaaggtttgtgggcaccttggtaagatggaaagcgtttggacatggtattgattcccaaagacactgccattcagtgggcgctcgtgaacaatccaccatctgcctggtttccctgcggggcccagcaagcctcccagcaacaatcttggggatgaatcctccttctccagaggacgtgcctggttccacgcacacaggtgcacgacacacacacaaccttcctttgagcactcgtcggcgttacaacttgggtcctgatcccgtgcactaacataaaactcactcccaaagaaccctagaaggcttcacttccttccctaacatttgagggctgtcagcccttatgttactgctgtcctattaaataccttcatttccccatggaagcttcttcagaagtcacacttcaaaaactagaggagacctactatatatatatatatttttttctcaactaaagtaaaactgatggctccacacacacatgtctgttgaaagaactaacagtgtagaaacagggtaggtgggaaattttcatctcactgttggctgacctgggttacctctagactaacagtccaggctggccccaggctaaccaacctgggctacctctagactagcagtccagactagtcccagactaaccaatctgggctacctctagactaacagtccaggctagtcccagactaaccaacctgggctacctctagactaacagtccagactagtcccagactaaccaacctaaccaacctgggctacctctagactaacagtccaggctagtaccagactaaacaacctgggctacctctagactagcagtccaggctagtctaagactaaccaacatgggctagccccagactaaccaacctgggctagccctagactacctctagactagcagtcctctaggctacctctagactagcagtccaggctagtcccagactaaccaacctgggctagctccagactaaacaacctgggctagctccagactaacaaacctgggctagccccagactaaccaacctgggctactagcctcagactaaccaacctgggctagctccagactaaccaacctgggctagctccgattaaccaacctgggctagccctagactaaccagcctacgctagccctagactaaccaacctgggctagctccagactaacaaacctaggctactagccccagactaaccagcctatgctagccctagactaaccaacttgggctagctccagactaaccaacctaggctactagccccagactaatcaacctgtgctagctccaaactaactaacctgggctagccctagactaactagcctacactagccctagactaaccaacctgggctagccccagactaaccaacctgggctactagccccagactaaccaacctgggctagctccagactaaccaacctgggctagccccagactaaccagcctacgctagccctagactaaccaacctgggctagctccaggctaaccaacctgggctactagccccagactaaccaacctgcgctagctccaaactaaccaacctgggctagccttagactaactagcctacactagccctagactaaccaacctgggctagccccagactaaccaacctgggctagccccagactaaccaacctgggctagctctagactaaccaacctgggctagccccagactaaccaaccggggctagctcgagactaacccacccaggctaaccctagactagcaactgggcctcctccggcccctgctctgggctccgcctgtgaagctgggtcctgggttgccagctgctggcccaggaagattccctggaagattaccttgctttgggagggggtggaaacaccaggggaccccagtgacactggagtcgaaacagcatccattgtcaaaacactggtcactggtgattccagggaagccgcagttcgtcctgttatgggggctcagcctggagcactggcagggggctgtggaaagaccctcagtcggccccaccctggtaccccagaccacactgctccttctctcagaggttctaggggatgcctctactgtcttgttgccacatagagaaacacaaagtcttatcttgcccatatttaagcaatgcggtttcctcctgagaagccgatagggctttgctgaaattgttatattagtttaaaaggaaaaaaaaaaaaaagccaggcatggtggctcatacctataatcccagcactttaggaagccgaggcgggcagattgcttgagctcaggagttcaagaccatcctgggcaacatgtcgaaaccccatctctacaaacaatacaaaaaaaaaaattggccgggcatgatggtccacaactgtggtttcagctactcaggcggctgaggtgggaggatcacttgagcctgggaggcagaggttgcagtgagccaagatcacaccactgcactcctgcctgggcggcaaagccagatcctgtctcggaaaaaaacaaaaacaaaaccctcctagaggagggtgaacagatggacccaaggccaagatccaggcgagaggtgagtgctctgggactccaaggacccttggtgggaatgccctcctggcccgacacggggcccgctgacacctgccgtcactcagcctttccctaggagggaggcccttcttggagccaccctcctgagcagtggcaaatcccatgtgaacaacacacattgccagatgcctttatagccattccccctctcaagttaatttatggttgtgctttttttttttctttaagagaaataaagaaagcacataaaaagaccctctccttcacttacagggtttctcactccccgccagggcacatagccccaggacgaggagcgctgccaggagctgggcgtctcgccgtcccatgtctagctcagctgcaccccagggtggcttgcagaatgcatggtgtccactgccgggtatgttttataatctcccctctgtttgtccaacaagcagagataacctttcttctctgccccgtggccccagcccttccaccgtggaggcgaagaggaggcaagaggcagctgtgccctgtgcaggcgaggcttccgggccagggtgactctctccctgctcggtgatacctcttcctgccctggacagagagttgggtcatgccaggctgccagcgtggaaaaccggccacgtgcaggtctggggctgggcacacacagggtcacacccaggaagggataagctatgcatttctattgatagagtgggcagggaccacaggaatttagaaaatattagggccaagtttactggggaaaatgtacaggccagcagatagcatggaaaagtcccctccctgaggaagggaagcatctcagaggaggtaagagactgctcccagggctgtggttagagcctccccaaccgcagcacgatgccctttgtcccatcttcagcaggaggggctgctctccatggagatgaggctgacagggtcagcggagtagcctgtgacaggcaggttttaataagttcattttcagccaacccctgaaatgggttatttttgttccatgggaatgctctacatcttctgaaagatggcacctgggacccagcccatggccttcctggggtaggatgtgctggagaaggattctgtggacctgacagagaagacagaagccagagagtagacacccggaaagaaagagggaaaagtgtggtgggaaggacagaggggacccgaagttccccacgccagggaaatgacagggggttgccagtctgtttctgatggttgagcagtcaggggcccagagacgcaggaaacccaaaatccttggtccaccacggggctgtcctcagggtctggagagcaggccccatactccaggcccccatcctccaggccctcgtcccccaggctccatcctccaggcccccattctccagggctccatcctctaggcccctgtcctccaggcccccatcctctaggccctcatcctccaggctccatcctccaggctccatcctccaggtttcatccttcaggccatcatcctccaggcccccgtcctccaggcccccatcctccaggccccatcctccaggcccccatctttcaggcccctgtcctccaggctcttgtcctccaggccctcatcctccaggcccctgctcctccagaccctcatcctccagaccctcatcctccaggcccccatctttcaggcccctgtcctccaggccctcttcctccagaccctcgtcctccaggcccctgttcctccagaccctcgtcctccagaccctcattctccaggcccccgtcctccaggctccatcctccagggctcctctgggtccgggtcaagtacctccaggctctctgctgactgttcaccactgggcaaccacagggactcgatccatgaaaactctggcaaggtcagtttccttgttctacatccctgtcactttagtcaccatcatgatataagtgactgagtcattgttttctctcatattcccacccacctctcctctctgcttcctccccatcaactcgacttcccaccgctcactgcagccccttcaggattcctgctgcgaccacctgacccatgcaaaagagaccacttctcagcctctctcactctcctggccctggcggaagcctgtgttgtcataggcatgcttccctggaatcctgctcaggcccccacgcagggacactgagtgcccacagagttgggaaaccattacacgagatgggacgtctgcaatagagtggcatcgctagttgaaagtggagctgttcacaacctccacaactgtacttggtggccacgtccccatcacatgggctcagactgggggctggacattgactttgagccccaagtcttcaccctcatgcaaaaaccatcctccttggagatgcaggctgggaagggcgccatgtccggagtccctgccctgctgtcatctgccgacctttgtgcagcctgtccctttcgttaagaatttcagcactgagttcactgtgttccttgtcatgctaagacttggccacatcccagccatcttcaacatggcggtcgatgtttcatcaaaattcacagtcgctcagattttatttttcctcatctctaggaacttccatctccactccacttctgccacttctgccaccctcccatgaccacactcagaacttgagctccacctctgaaagagggtatgcaaatgtcctttctgcccaggatgtcctaagctcctaacattctccctttgtctgaatcctaaagccctccaatcccctattcccctgtgagccccctcctgtctatccttccttcctgcttctccagcctgatttccacagtgctcacttcacccaccgtcttcctcactgctgtttcccactgtctctgtgcctatgccatctgcctagcatggccgacacctaccttgaattgttgccactctcaacgcatgatctcagcgccatccaggcactcagggctggcgccctcctctttctgtttatccttctccacccctgctcacttccattttgcacactttggggatgatactttccatcagttcacatagaaagtcaacaaatgggaaccacctcagctatcacccatgtggacttccgcttttgactatggagtcactggtaccaggctagcctcccaccatgagtaactctaaaactacataagtaacagtctgcagatgctgagcagcaggcagtgccagacagcgatccctgagagaagggaaacaatagggggagtcccatggctgccttggtttcctggagacgctctccagactacagcacagggaggggaacccaaatagcactgaagtcccatcgggctgaggagacagaggtcagaattggaagcttctgaggcaggcgggttatcaaggtaagagaaggaagctccagaaatataaaagtgtgtcctttgagcttttcatcaaatactatgctgttcgtgcccacaaggccaggctaagtagcccctggggacagaacaatcactggggaggctaaactgaacaactagtgtagggttcgtggggctggaaagcatttgagctcagagcagccagaggtgttgaccacttcaagcattcaataaaggccatgccgtaaaaagaaggctgatctttctagaggaaagctactcaaaatccattcgaacaaaactttaaaacaagtcttgcaggaatcaagttaacctgcaagtaaattaactgcttgtattagttcactcaggttgctgtaacaaaatactacacattgtgtagcttaaccaacagaagtgtactttctcacaattctggtgcccagaagtccaagatagggtgtcagcacatctggtttctactgaggcctctttctgcttgcagatggctttttttccccatatctcacatggtctttcctctgtgcacgcacatctctggcgactcttttcttataaggacaccagtcaaattgaaccagggcccaccctaagagcctcattttaacctgattaccccttttaagacactgtctccaaatgtagtcacattcttaggtaatggaatttaaggcttcatatatgaatttgggggaaataattcaaccgataacactacctgagagagcaaagcattcaacactttactaatgaagacagcaaaacctaaatacacaacataacatccctaacgtctaacagaaaatcagaagttactagatgtgtggagagaactaggaaatatggcccataatcattagaaaaatcagtgaacaaaaacagacttagacatggcataaaatgttcaaagattgaaagaaaaacataatataataaaggaacaaaaaggaatctcagtagataaatggaaactaaaaattaaccaggtacaaattttagaaataaaaaatacaacatctgaaatgaaaaatacactgtatgggtttttgattagatactattagatgctgcagaggaatggtcagtttacttgaagtgaagccagtgcaagataaactatgcgaactagagcataaagtgaaaaagggctaaacaaataaacaagattccaatgaccggtgagacaatgtcaagcaatctaacatacatgtaattgatgtaccagtaggagaggagagaaaaaaatcttttaaagaaatacttgatcaagaatgagtattgagtaaatattcattagatttttctgaagttggtgaaaagtataaacctacaaatcttagaggctcaaagaacttcaaggaagataaataccaaaaatatcacatcaaggcacagcatgattcgtctgttgaaaatccggtgatttaaaaaactcttaaagcagctggaggaaaagacttctataatttgaatgtccctccaaactcatgtcgaaacttaatccccaatgtggccgtattgagaggtggggcctttaacaggtgattggatcgtgagagctctgctctcatgaatgaattaatccactcatgaattaatggattcatgggatgatggattcatgggttattgtggaaggggacctggtggctttataagaagagagacctgtgctaggacatgaacacactcagcgccctcaccatggaataccctgggctgccttgggacacatctgagagtccccaccagcaagaaggcgctcaagagatacaacccctcaaccttggacatcccagtctccagaactgtaagagatgaagttcatttcttataaatgaccagtttcaacttagcaacagaaaataggctaagacaaagacatacagcatggaggagaacataataacaataatgactgataacacagtattatttactcaacactcattcttgatcaagtatttctttttatctgataatgcaaaccagaagacaatgggataacatgtgtaagtgctagggaaaagttctatactctgaaaatatgctttcagaacaattgcagagttgattcattgtgacaaagactgtaaggcctccaaaacctacaatatttactatctagccgtttaaaaaaatccaggctggttgcagtggctcacgccacaatcccagcacttagggaggcctaggtgggcagatcacctgaggtcaggaacagcctggccaacatggtgaaattccatctctactaaaaatacaataattagtcaggcatggtagctcatgcttgcaatcccagctacttaggaggctgaagcagaagaatcacttgaactcaggagaggttgcacatacccctatattgtagccttaagctgtctaaaaataaaatttaaaaataacaatggagggaaatatttgtattctatttttcttaagaaaatgttacagaaatgagccttgtgagccttaatcctttttcctccctctataatcttgtcctgaaattaagatatttagtatactggttgttgggagacagttctccataaagttctcacatttctgcacatcctgtgaataagaaactaactatccttatggcataagacctaaacttaaggcacaatattaagtactgccttgacatctggtgaaacagagagggcctcaagcagcctcaccgaaagttcccctcccatctctactcgtggataaggtcccctagccaaacaaccctccctgtcaagggatcaggcaccgtgcttgcttatccgtgagtagcagatttcagttttctgccagcccacagaattatttaaacaagccaattgcatcctcctgggagaaccactagccactacgccctcttgatactacaaagcctgctttccgcagcctttgcttattcactctgctcctgaatgccacctctgtgtggctccacatggcacagtgtcctcagcccctgagctataaggatatgggactcacaaactgctattgttctcacctatgttgtgttggggatggcgtgttcagtcatcccatcatcctagggtgaaatccctccctcactaacgaaatgcatgggaggcaattaaaacagttctttcttccagactatctctccaaggatgtttgggtcacaaacaatcttggaaagtggataaagtgtctccctctgaagcaaagagcaggcaagctcactgtcccttataaaacacttggatccctaagtccagggcttctctcctataaggcaacccactgtgtgtgcaggcacccatctgagcccattcctggtcccagtcccttgggggtcttggaggcaaagagaaccaacacaagtaacctttcttcatgctgcttgctgtagcatgagtaataaagtcatttatctttgaaccaggaatctcctgtcttctgctagcaaacaggaaactggcagactcacctgctggcttgcacgtaggatataataagctcagcccttcccacttctcgacactgatagactagatcagatgaaatgtagaaaatccttccaatacttgcctttagcttcactgagtccccttgtagcacgtgcatgtgtgggcatgtatggtttggtctaatttagtctgtttgctacctcaaaaatgtccagctcagggcactgttaagagctgaaaagaacaagtcagaaatcctttaaaaataatactatttattcttgtgttaccaactggtgtcttctgtctacttggacctttaagtcagggaaccccttcttcctaatggccatcccttccttctggtaagttacaaggactgggatttgccaggtgtgtgtctctttcttatgagctgatgtttcctatcagactcataaaaattaaatattgcaacaaaccacccctccctctacttgcaaagaaaggtgagggagttttcttaagttaacgatatctttcccagtgaccctacaaatatgaacttaagccacagcttgccttcgagaattagttcctggtctgacctttagttcaataaatgccctgaacagaaccctgttgtgtaggaaattatctagaagcaactgtggcctccgagtacatagccagtggcagaacagaggtgtgcatagaccaaattaaggtgtgaaacctgctatttattaaatcgattgacagcacgtagtgaaaaatgaagggaaagagaaggtgaacacctcatacaggtgtgggagggtagaaggaccacatgcctgaattctggccacgaggaactcacgcatcctctccgtctctccaccttctccaccagggtcatagtaatggacatctcagctggggaccaggaggtggagggagcctggggctaacacatgctcttgctttgtctaagagattctgggggagggcttgtgagctcagctgcagccccgcacgatccacagagcagcccatgtttactgcgcatttccggggccaagcgcagggtgggtggtcaccgtgagctgctggttcagggctgaaggagttgtcagcctagagcacaccatcggttccctgtgatgcggccttctcatccttttctctccctaatgacgttcttgttggttccatccttctcatcacacagcatatctcacagaagaccactctttcactgtccaccttgaatactccttatgaatgtgtgcccccatatgcacctgacatacctccagtttcccaaaatccactttgttttcttgcctcccacagcagaattgccttatctcacacagtggtgacagcactctgtaataatctgcatgggccagggctccttggttgcaggtaacagataccactgttacggcccaactctgttcttctatgttgaagccggaacccccagcgcctcagaatgggatcacatctggagaaggcgcctttaaagaggtgattaaaattgtgaaatcaagtttagcctaaagcttcccccttacatattttaaatttggactaaaggtttctctgtacatcgtgaactgtaacaggtggaggcgtaaaccgaccgtagcctacacttgtgccaatcaccgagttctgaccaatcaaatgcagccaactgtccgaactgaggtgccagtcaccgagttctgaccaatcaaatgcagccaacagtccgaactgcgttcaagtgaggcaaaggcggagctgtaaccagtcgggctgtttttgtgcctcatatccattttctgtgcctcactttcctgtctctgtccataaatctgcttccaccccgtgactgtgctggagtctaagcctactctgactcagcaggctacccgattcgtgaatagttctttgctcaattaaacttctttaaatgtaattcagctgaagtttttcttttcttttcttttcttttcttttctttttttttcttttcttttcttttctttttttttttgagagggagtttcactcttgttgcccaggctggagtgcagtggcacaatctcagctcacgacaacctccgcttcccgggttcaagcaattctcctgcctcagtctccgagtagctgggattatgggaatgtgccaccacacgcgggaaattttgtatttttagtagatggggtttctccatgttggtcaggcaggtctcgaactcctgacctcaggtgatctgcccgcctcagcctcccaaagtgctgggattacaggcatgagccaccacgtctgcccaagtttttcttttatcaagttaaaatggggttgttagggtgggccctaatccgacctgactggtgtccttatgagaagaggacatttggacacacagaccccagacacacagacagacaagcatgggaagaggcagcacaagggtgctgcttgcaagccaaggagcagcttacaagaaaagtgtaaactgacatgtaactccattgagcagatctgaagtggaagggtgctttttatttttttttttaagacagtgtctcactctgtcgcccaggctggagtgcagtagcacagtctcgactcactgcagcctccacctcctgggctcaagaaatccttccacttcagcctccctagtaactgggactacaggcatgtaccacacactcagcgagtttttgtatttttagtagaaacagagttttgccctgttgcccaggctccactgagtggaggcccagggaaaccacaggaaggcagtgacccaccttgttaactggctctgcctacagtccttggtgagagcggttgttcctggccatcgtggctgggccataggctcactgctctgtggtagatggaagatatgggccttggtaatatactgaaatgccacaggaaaccaaaccagaagtgatttaacccacaagcacacttaggtttatttaacatgatgtctcaaggtgggtggggggctcaaatcagtagctcagggttattaaggctctaggtcttgggccttacctcattattacataatggctgcctgcaacaccacatcacacccaccttccacaacacccaaaggcaggctgcaagggctggcctaggaagccagagggcgctcttcattcatcaagggagaagcctgccccaccttcaaggagatgccccctatgtctcatgggccacatagaattgcacggccacttctggctaaaagaggggctgggaaagtgaattctttctcccccttccttcgtagagtgcaagttaggtaagaaagaacggatggtggacagccaggaaacagtcagctacgagatgttgtgtggaaagcccacctttctgacactggagaactgtgggaagaacggacaggccacacaccagctgggctctgagaacccccagcttctgctccacagtgagccagcaggaatccaaagggcatgggcagaccccaggggctccttcaccccacccaggggtagagagggcaagacggagtagagcgaggtaagagactgagcaatgcgttcccaaagactgtgactgacagaagctgtgcaaattattatgacaaactgaattttaagaggaattggactaaataaagttagctcatttttacctgtaattagcagacagagagtgtaagatcagacataccatagatggaaaagaaaagctaaaacttccttgcacatctgagaggtaagaggaggtgtctgtggcccccctgacacatacgtgacatatgtattattacggctcatgtgtgtgctgctgtgtgcagggggcagggggcttcccgttcctgatggttcttcttggtgggtgtctcccggcctctcaggcctctttatctgctgaacgtggtagccaagggtttgggaatgatttgccagactggttaatgtggaaagagctggccccgctcagttctgcacctccctcttcctccctggaaccgtctggctgcagagagcaggagctttccagagctcccgggggatcccatctccagtataactgtgcaacgtgtgcccagcacaagagcaccagatggagggacaggtgggaggaggaggaacccagggtgcatttagcttggggcttgctgagctgaggtccccagagcaaggacgactaggttggggggacaccctctcccaatccttgccaagctacagaggggccagtgggaataaagtgacattttggcttctgtatccctcctctgctgttctattttctagttcgttcagatctgaggttggggaggggttttcctggaggggtcagtccatgccaccctctgcaatttttattacacatgctttcagacattctgctacaggtttcatctcctacgccaatttctatttgggaaagcaaataaacggaaagctaacttgtgtcacttggtcgctggggcatccgcagtgagtagttaagaaatgccaggggagtcggtgtccattttcatgcctggacaagagtgcgtcttggacttgcgtcctgctgcacaccccaccgtcccgctgcacaccccaccgtcctactgcacaccccactgtcctactgtacaccccaccgtcctactgcacaccccactgtcctactgcacaccccactgtcctactgtacaccccaccatccctgctttctgcactcagctgcccacttgtatcccagctcaggaagcccagaagatgcagaacctctgcgagagcccagggtgaaacgctgcgcttcactttcaaagaaaggaaaatcattcatattctttaaaagaatgaacagcacagattaatatcgatctcttttaatttttaggccaattttgagtagtcaaagtcagagcagtcaatctgtgttgtgagccgaggcacagctgcagaagcgtgtctgaggtgtccggtggaggtggcagccgagctctgggactaatcaccgtgctggggacggcaccgcgtcaggatgcaggcagatccctgcagaagtgtctaaaattcacactcctctacaggggtgagggggagggagaaagagatgctttagtgaggataaacattttctttcacatttaaacaattacagagtttttactttaaagtatccataggcacattctttagaaaacatgaactgtcagccgggcacggtggctcacgcctgtaatcccagctctctgggaggctgaggcgggcagatcacctgaggtcaagagttcaagaccggtctggccaacatggtgaaaccccgtctatactaaaaatacaaaaaaaatttagctgggcgtagtggcacacacctgtaatctcagctactaggaagctgaggttgaactcaggaggcagagattgcagtgagccaagatcgcaccattgcactccagctcaggggcaacggagcgagactccatttcaaaaaaaaaaaaaaaaaaagaatacatgaaatgtcttcagatttcgtcatgccttccccctctatcctaggcaagctagaaagcgttaccaacagtggctcttcccaggcttttggttagagatgtgaagagaagccggggggaaatcaggtttcttcccaagtcccttagccctgcctttctattcctggacctgaatgcagcctgactcaggctaccccattgcaccaccactggcggccgtgactctgtgtaaaggcatagctggtgatgctgatcagagcctctgtagtcttaaatgacttttctaactaattctaaatcttcagaacccatcgtataaaaaggccataccttctggagggacgtcgatggtattaggatagaagcaccaggggaccccacgaacggtgtcgtcgaaacagcagcccttatttgcacactgggagggcgtgacaccaggaaaaccacaattctgtctttcacggggggccactgtacacgtctctgaaagtgcacaggtaagaagcaaagtaagttgtgggctgaattccttgatgttatcatgcacacacccatccagcttccttctccaatgacatcagcaactgtccagtgaggcggatataaaaccctcaggacatgagagggagacgtggtcctcacatcctgatgtgcaaacattacgctcagggaaaatgcaaggtgccccaggtttgtggactttgcatctttctaggtaacttatttattcactttttaatttcaacaaatgattattaaattttactcaatacataaatatttactgagcaccatttgtgtgcatgagaagtgggagctagcatggcaaaagccaggcactgtgccaggtgagagagacccagaaattaaaaccagagaagtcattaataagagtctaaatatctgggcccaggctcatgcctgtaatcccagcactttgggaggctgaaggaggtgaatcacttgaggtcaggagttcaagaccagcctgaccaaaatggtgaagccccatctctactaaaaatacaaaaaattaggcgggcattgtggcacacgtctgtaatcccagctacttgggaggctgaggcaggagaatcacttgaacccaggaggcagaggttgtagtgagccaagatcgcaccattgcactccagcctgagtgacagagcaagactccatctcaaaaaaaaaaaaaaaagagtctaaggatctgatggaggagaaaggcaagaacatgtgcgagacaacgcaaggccatcgtcccagggtgcccagggtaaccacgggggtagggcactccccggagaggccaatgacaagcaggttgaacaaagcaggggggctccctgcaggaggaggttcaccaggtgaagatggagccgcatgggcaaaggccattccagagacccaggtgtgttcaggaggtggaaacccattgcaggtaaggtgagaggaccgggtggggtggtctaggaggagccgacagagggtacaagctgtgaaacagcttgaagcagggcagtgaggaaagggatctagaggaggaagacacgtggacagatggggctggctgggggctgccgcaggatcttatgcaagaggttctaacaccagagcttcaggctctgagctccgcggaatcaaaggtctcagaaagcaacctattaggatctggtggttgacagcctgcagcagggggtgaaagaggagcccagagcaccctccggtccctgtccctgccttggggcataggaggggaggaactcagtctggccacactggctcaggtgagggcgccccaggggaggccgagaggggctgttctcttgtctgctttgctatcagggactgcctcgagatgtctttggagaaagtgttcctggcttgctgggaaggatccgtgttcagctcccgctgcccagcagcttccatgggaaccttgccctcctggggtctggatccatcgcgacgtgaaggtgatcatcgcccacccccgggacactgtgggggtcaagagaggccccgtggtgagggaggatcatcatcctgggggtcgggggggtttcctcctcagggaggaagatttccagccccggtgctctgcctccggcagactctgtcttgcccacccgctttgtctttgtcgcatgatggaaataaatggaaatggtttccacacacgaatgcactaaactgtaatcacaattttctagatttcagttgtaacaggatcatggacctgagtgacccgcaaagacgctctgagccttgagccagagggtgtgtggggtggggaggggagtttgccacggcctctgtgatcccacagcacagggggcagagctgggggctggggtgggggcaagggcgcaggcagatgggcctgggggtggccagcacggggacccacccagttcgttctgtacaccgaggccacttcctctctcgggttccaaagctcccccgctccctgccatgggcttgggggtcttcccactgcagcccaatgctggctgctcttctacgctgcccaagcccacccctcaggcccggtaccccacagcagagatcaagaggtggctggagggcagtgggggcacggacagcaccactgggcgctccctcttcaggcctctctggaaacccttgctttggaaacgtagaaagccctttctcctgcccccaccttgaaactgtacctaataacggcaaataagttattcagctccccacagctggcaaagtgcaagtcgcagatgctgccacacagcatttcctgacagccctagggcagaccgttgatccattctgcaggtaaaggagttgagatgcaaacacttcccaaggaagcaagaatggcctcctcctccactccctagaaggacccagggcaaccgatccacttgacaacaccagggaatatgggttgccagccacgcactcatgagagaggtggctttgactcccagagcatggatcccaggggagcccaggaacctgtaggagagggtctcccagttggccaccactgggacgggcattcgggcctgtgggagagggtctcccaggtggccatcactgggaccggcatttgggcctatctggatgggccttgggagggtctgcccctgggggagatgttggcatgaacagtcaaaagcactattctgagaccccacgccaacacttcctctttgaaacatgacacttgggaggattgtatagtcttcctaacacaggaaaacagccccgactgaaggcagccccctcctcgtcgcacttctcgaaggtctccgggggccctgccaccctgagttactctccacctgcttttgccgatcctgtaaattggatatacttttaagggcctagaacagcacctggcacaaaacaggtgctcaaaaatatgtatgtaaaacagtggctcctggcggaggctgccagagctggctgtggccccacagagcaggaagaagcacgccttacctgtctgggcctcggccagggtgccgagggccagcatggacaccaggaccagggcgcagatcaccttgttctccatggtggccattgcctcctctctgctccaaaggcgaccccgagtcagggatgagaggccgcccgagccccggattttatagggcaggctctgtttgcttaaagagcgttagataacatttgcctaaggaggcccggggatcctctgagacaataatctccactgatttttatcaaaggtgtttcctagacatggtcaagctacatggaaggatttgctgatagacagagacgacatgtggtgaggtcatcttggctgagggatctgagattcagaaagtccctctttcccatgggagtctcctccaacctgaccttaatccaggtcctactcatatctgagaggccctcccgccagggtaaatactgtactcactgcagaagtgattcatagtgagagatggccggaaaaaggcttggccgtgacaacagtggctcacggggtggccaccgtgaccttgcagggggaagggaaggagctcatgaagcccattccgtctaggcctaagctaattcttttacagtggaattgttttaataatgaaattgtaggcctggcgcagtggctcacgcctgtaatcccaacactttgggaggccaaagcaggcggatcacttaaagtcaggagtttgagactagcctggccaacatggcgaaaccccgtctctacaaaaaaaaaaaatacaaaaattagccaggcatggtggcgggtgcctgtaatcctagctactctggaggttaagtcaggagaatcacttgaacctgggaggcggaggttgcagtgagtcgagatcaccctactgcactccagcctgagcgacagattaagtctccttctgggaggggctgggggcaggagggagaaaaaaatagtatatacgagctgccatcaaaaactgacaaagtgaacgtggttcactcccctgtgtctatggggctccctccctccccctcccacaccttcccagttggtcccctggactcctgtattttagaggacagcctcctgctctcctgtaccatgcctcactcccctcccctgctcggagctttctctttcatagctcttattacctcctggtggataaaacaagtgactgacacattatgttggttatttattcattgcactcctccctgcagcagacgggagggcgcatgggagcagaagtcctcatctcctagtgccttgaggtggccccagaccctagaacagtggctttgattggcattcgagaaacagctgttgaagagctgcatgaagaaatggacaacaggagaaatcttttcttcttcagtgagaaattaggccctgaggaaaatgcatgctagcctaacaaaggtactatcttttcttgggtgacctagtcagtacatttctgcagcccctctgggaggggagcctgggccagaatgggggcggccatgttcctcttcgctccatcccaggacccagcccctcctccagggctgccactcctgcaccggggtctccactcctgggccagggtctccaggaggggcctgaccgcaggacccagggaggggccgaggcctggtgtcctctgtggtcagcttaagtttattgaaaacaggacgggggcaccaggcccagggtggtgctcatagtgacggtggttttcgctgctctaatttctcggatcaaaatgggggctcttggaaatgggatgtaaattgcacaatcatttggagaaaaggtgggcagtgttcggtgaggtttaagccatacagattttacagctcagcaaattcttctgtttccaggcctggtctcttaatcccagaaacatgttcatacttgggcagaagaaaacacaggcaaagatattctttttagcattgtttgtaacagctggaaacagggaaagaaggaaggaaggaaaggagggaaagaaaagcaaaataaatattcattaaccagggaaagggaaaatgaacttaaaatacaatgcagtcgtcccttagtacccctgggggactggtttcaggaccccccacccagggatgccaaaatccacaaatgctcaagtccctggtataaaatgacatagtgcgcagaaaccacgtgcatcctctcctacactttaaccatctctaggttagttataatacctgatgcaatacctacacctcatttcattctgcagattctacatagtacttgacttgcggcacacccaagttttgatctttaagatgttgtaaataagattttaaaatactttttttttttgagacagagtcttgctctgtcgcccaggctggagtgcggtggcatgatctcagcttactgcaacctccacctcccaggtttaagtgattctcctgcctcagcctcctgagtagctgggattacaggcatgtgccaccacgcccagctaatttttgtgtttttagtagagacagggcttcaccatgttggccaggctggtctcgaactcctgacctcaggtgatgcacccgcctcagcctcccaaagtgctgggattacaagtgtgagccactgtgcccagctggattttaaaacagttttgatctgacattactggaatccatggatgtagaacccatgaatatagagaactaattgcatacatgtattatactttacatatattatatatgtatgtatgtgagtatctttcagaagatgaaaatgaataaataatgagaaatattgaaaacaaagcgaagtgaaaaaatccgttaaaatggtttgtaaagtaggatatcatttataatgtagatttccaaactatgtgaaacaatgtgatatactgttggaactgcatccagatgaacaaaatgatgacagtgtagacaggaacgagacactgacttcagcatgatgggtctgtctaggaaggaggaagcaggaaaaggtggcggggtagggcgcaaaggggccttcgatgtctccgtaatgttttcttttgttgaagaaaatctgagggaaataaggtaaaaaggttagcatccattaatgaggggcagcgtagattcacggatgttgttctagcattctgtacatgtttgcaattgctttcttggaaagcccagctcctatctccttgggagagctgtgagataactaccaagtgccggagtttggcctcccacattagggttggagcggctggagctgcccccgggactctccgtttctcgggacaagagctttatccctgtgagagtgggcggaacccaagaccacaccatacataaccttatccataaaaacttgttgaagacaattccagtgtggcgagggagagaatgcagaggcaagcgccagtccatcatcagtgggggaccctgtgccagcattttcacagctctgggtcttagttttcttatctgaaagacgcagtggctgggccacaggacatctgaagactccgcacctcagaccctctccggcaggcatctatggccgtgggggcgtctgtggctgtgcaggcattgcttgtttcctgcgcccagccgacctccctgcggtctggcgagagcccctcattttcagtggggggccccgcagccgcccagattccccacaagggggacgcgcagttggggagtcagtctcctcctgacgctccccacctgcccgctgcccctgacctgtgccttggcaggagggggttctgtaggtggccctggagggagggaggagtttgggaggaagtggatccgggctctcctccaggatccctcctgggatcacctgggacaggccacgtccccctctcagccacagcccaggtgggcgtcctctccacacaccatcttccccaggccccagagcagacccctcacccccctgccccagcctggggggtttaccagccgcaaggagacttttacagtcttcactctcctcgcattgcccagatccgctgtggtgaagcccgtttcctgccaggcctctggtcaaaaaagcaactgccaccccagggaccctttacaaggacacccagctgaggccctggggttggggtcctcaggtattggaggaggcaggtactttcctggccagggaacttgaggcacagacccacagcatggagcgggaccacattcctcaaattaacccagaaggagaggggaatgattggagtgtgaggccaggctcctccagggagagtggctgaggcgctatgcttccatggtgacagtagggcggtaacctcgtcaggttagccagcttcttccagagccacacacacccagaaagggaagaggagatccaggactgagcatggacgcaggacgatcagaaaggcgtccttggtggtacaccctccagacaccatccactccctccggacaccgctcacaccctccagccaccgccaactccttctggccaccaatcacaccctccggtcactgctcagtccctccagtcagggatcactccctccaacgaccactcacaccctccagccactgctcacacactacagccaccactccaaccctccgttcaggtcttacatcctgtggccactgctcattccctccagtcaccacccacaccctccagccactgcccacaccctccagccaccgctcaaaccctccgtccaggtcccatatctgatcactgctcactccctccggccacagcccacacccttcagccaccactcacaccctctggccaccactcactccctcaagccaccgcttactccctctgaccacccctcacaccatctggccattgctcacaccttcctgccactggccactccctccagccagagctcactccctccggccacacccttcgggtgccactcaaaacctccggccatggctcacaccgtccagccaccgctcataccatccagtcaccacttatgctctctggccaccgtgcactccctctgaccaccactcacactctccggccactgctcacacactactgccaccactgagaccctccatccaggtctcacaccctccagccaccactcacttcctccggacaccactcacacactgtggccaccactcagaccctccatccaggtctcacaccctccggccactgctaactccctctgtacagggctcactccctccggccaccactcacaccctctggccaccactcactccctccggccaccgctcactccctccggccactgctcactccctccggccaccgctcacacccactactttgcctggccttgctctacttttgagttctgtgtatgacacgagctgatgctgatctgctgagcaacctgttccgacagaagaatgccaagtccacaacgcacacaggagagatgacagtaatggagcccctggaattcagtggatgattttgattcacgtcaccagtccacgcagacacgccagacaatgagggaaggaaacatattatttggaatcaaaggacaataatacgtcaagcaccaaatgctacaaagaaatcatgaaaataggccttaaacgagtcattcctagattaacctccccacatgtgaaaataagtcttggaagtagaaagggtgggtttggttctggtccctagagatgaaaacgtgcagtgactgcagttctgcacttctgggctggtgcgtcttttctgagtggctgttggtggctttgcacgtgaggtcacataactgcttatctcgtcaggaattttgcaagacccctggagagaaaaccagatggaccagtgggaaaggccgcccttgcaagttgctgcttcttttgttcttagtgaagatcagaaaggagcgtgaggctaggcgtggtggcccatgcctgtaatcccagcactgtgggaggctgaagcaggcacatcatttgaggtcaggggtttgagagcagcctggccaacatggtgaaaccctgtctctactaaaaatacaaaaattagttgggtgtggtggcgggcacctgtggtcccagctactggggaagctgaggcaagagaatcgcttgaaccagggaagcggaggctgcagtgagcagggatttcgccactgcactccagcctgggcaacagagcgagactccatctcaaaaaaacaaaaaacaaaaagcagcttgaaggttgtgctggaatcagatggaagggtgcctctttcgggcctgctactggtgccggaactcagagctccaagggtgtctgctcgtgtgcaggttcctacacgggagtccaggggaggatcgggctgtcttcatcacctcaggaactcaggtggctacttgtccccttcctcttcaggtttttaggtctctctataaatgaaaacaaaggcgttattgtttttagcacttccagccatccgtccaacatgatgacggagcgggcacctgcattttgccctgtgggaattgtggggctgttctccacgatgaagacaaggttggcctccccctggggctgccagctctgagtggatcccaggcaggcatgaaaagctccaaccagcaatgcatccgcaggtcccatctccgccctgcgacagttccgtcacttccgtaggaaacttccaggtctcggcactatgttcctgagttctggtttgagtcacaacaattttgttttaaacccccaactagatagagaaaagtgctggatgaaaatgaagatgaggccatgggcatgccaccaactagcacacgggacacttccccgcaagacagtgagtcttccaaaggccctcacgttgactttcctcacaatggacaactgaaacgcacagcgggcctgctggaaagcctcccaggaaaggaagtctcttctgggtctcccctaggacgtctgaagagggacttgggaaagggcgtgtctgaggctgcgcatctctcgcatgcactggtgggttggaggcagcggatgactaaggcgttgtgcagggagcaggggccccaggcatcgccggagccagcgtcacagacgagctcctccaccacagcttcaccacaacaggggaaactgcctccaagaccctcccagggtttctcagtgtgccctgaagcccccatgcaacacattcaccagggtcttcaccccagacctcccaatcagactccagataaacgccctgcaatcttcacatttaacaaacatcctgagagaggcttctgcacccctaagtttgagatctgttgattctgctgtgcagtcacactggggccacgtcggggatctgatgtgaggcacactctgcccttgttagctgggggggcctcatgcaggtcgtctccgctgtagtacagggagggtcacaggctctgtggcccaggacggtgctgacatgggaggggctgaggtggccccgtcatggaaccgttgtgagcgggctccccagactgattttgaacgtttgtctccagctcacccacgacagctggaagacacggcggtgggcttctctgccttgcgccttcagtgtcttaagggggacttttaggatcaccagctcagtgctcagcccctggggatctgtgtcccgtgaaggcctccatgtactgcagacccgtgtggaggaccggcttctcctttcctgccctttgccctctgtgcccacgcgacccttctgtgccccccaggctcccacagcaccctgaacagtgaggaggtctcccattcagttgtccatcctggtcctttctacagtgcgggcgggctgggctgagctttatactgaagagcatagcaggccactcagtgcctagtatggggccaggctgcctctcccagcaaggtgagcaggagcaagcactttccacccagcccgagcacagccctcaccacgccccgagggggtgctcagggctgcagggcggcagtgctggaggtgaagctagcccaggtctcagtcccaggcctcaccctgtgcccgtgggcaccattctttagtttctcatttaaagcacaaaatcagtgagagcaaaacgggaattaacgcctgaggcacattcagcatttgatgtcctttcttggccaattgtttcaaattaaatgagctttttaaaaaggtctttgagccttggagacagaaagctgactggtgggtgccagaggctggggagaaaagtggagtggggagtaactgcgtgcttctagggtgccgcgtgtcttttgggagatgagaatgctgggaactgacaaaggtggtgtctgcacagccctgtgaatgtgctgatgctacagggttgttcactttaaaatggtgaattgtatgttatataaatttcacttgaattagggaaaaaaaacgtacttactttgacgtcattgttagttcttggaaactacgactttaagcaaaatgatatataatgaaaccaattttttttttctcatcgactttataacaaaattacattgcaagcaaggacgttgctggagggcctgtgcgcactgtttctcctaaagctgcagtttctaagatcccatcaaccgtattaagtgaggacctcctgtgtttgaaaccatcccaaggagagacttcatctgagatcaagccagcaaatgtttccccggcgcccacatgagaaaggcgccgtgttcacctgccagcacgcagctgccagggtcccagcgaagccctaagcctccttcttcctcctccaccgtctcaggtttcccctccatgcccgggtcctgccaagccagcctcgctgttgggtgcccccctgcaggcccctcccacttccacgcctccccctccgggaccccccacccccccacaccaccaatgcagagctccccaagcctctcctgactgctgcctctcatccctggctcccagcgaggttccagcccctcagcaggcaggcaaggtcctctcccgcactgtctcagccccccgccccctcccactttctccctgctcctggcacacggggcacgcccgacccatccccatcccagcaggggctcctcctcgctgcctcctcctttcccatgtcgtgaggctccttcttcctcccgggccccagctcctctgcctgccaggctgcacccacccagagctgcccaggactagctgtgatctctgttttcagcacaagcgtctgacaccctggagccaccaagtcactgctgctgaattgacaaccactgggtcacgccctggtttttatagcaagaccagggttgcatttaagggaccttagggtcaaaagccagggacaacgtgagctggggagggcgccgcacccacctccatctgctcgtggatccagtccaggaaggaggtgacacgggtgtacaccccaggcttgttcacctctgcgcagccgatgccaaagctggtcgctcccactaacttccacagcctcctctcttgacacaccaggggccccccgctgtccccctgggtgacaggaaagaagcaaagattgggggacagtcaccgccatgcgagattgctttctgtggacagtctgccgtgtgaggctgcttgctatggagttgggaccccccttcatgatgtcccaatggatgacccaggttacagaagggaacccaccagcccttccagacacagcatccccaagggaggatgtccctcggcccctttggggtgctgcctccagctgtgtgtcccttccagaatgcagaccctgaccctctgaagctcaagggcagctggtgagagggagggtccacctggccagggccctcaggtgacctgtgatccacctagtagaactggagtcccagccactgcagctttcggagggccagattcactggttccccgccacctgcctccccaccacctgcctcccctgtggtcccccacaaagtcagaattggaggggagcagcatgagtcccctcccaccacccagcacccacgcagagccagatcactgggtaaacacagggctggcagccaggaaaaggagtgatatcttgagcaaatttcttctccacgccctgtaaatttactttttgtcctgtcacagggaaacgctggcaacgacctgtcccaagggctgggtcaccctgccacggcctcgcccaccgctgcggccccgtacctggcagctgtccacgccacccgtcaggtagcccgcgcagagcatggagggggagatgatgccaccgtacacgtccctgtggttgcagatcttgttggaaatcaaagggacggccgcgtggttcaggacaggggaggcgtcacctgcttcaaagtgagtgaggggatgtgtgtgagaaggaagcccggcccaaaacacagaaggcgcatgctgagaccaggggggtgagggaacgagggacgagggggatgctctctggtgtgtcgcaacagcggaaaaggacagggccctgcgggtgggacgagcagactcccactgtctcgaagcacctcaagcccgagcttgccctcctacgagtggccgcaaggggccagtctgcttcaaggcagggccaccgactcccctaaggtgtccaaagaggaggaggagtaggggcaacagtggccaagacacctccccagggcaccagcccaatcagccatcagaacaccccaggttatgggagggaaactgaggctcaggagggtcactcactcagcgtctttgtgaactctgggatggtcagcagaaaaatgaccccaaagacattctcaccccaatccccagaacctgtgactgtgtcaccttacagggcaaatgggacattgcaggtgcattgagggacaggccttgagtggggagatgatcccaagtaagagggtggacctgacgaagtcacaggggtctttggaggagccggaggagaagctgtgacgacagagcagggaccagagtcagagagtcagagagagattcgaagatgcggcattgctgccccggaagaccaaggaggggcacgagccaagcagtgtgggcagagtgcagacgctgggaaaggcaggagacagattccccaagggcctccaggaggagccagcacagcccacacttgacgccagcgccctgagactgagtttggacctgtgaccttcctaactatgagatgatacctttctgtcattttaagccacgaatttggggtcgtttgttgcaacagtcacaggagacttaatccacgtgcagtgggccaagcacgcccccgacaccgagggatggacccctccaactcagctggtttgtgacccaggcatcttggtgttttaaagactccatagattccatggagacaacaaaatcacacaatgacaggaccctgaggggctgctctgaggagcacatggtatcacaagacactcagcttcctgcccggaacgtggcgaaacagctcaatgcattatgggagaagattccaggacaggctggagctgaagctacatcaggacaggggctcgtcggaccttttgcactggacagagcagattgacagcgagaagaaaatcggcagcgggatggagaatctcctgggaggatgaagctgttgcacagcctcctcttcagagcccagtgtcatcagaatgactctggtgggctggttggtccggaatgagagcccaccatgagaggaaggggagcgtagattggtgtcccagctcccaccacacaccaggggtgctggttctgatgaagctagaaaggccctggaccagccacactggcacagaactgggcctgggccatgtgggtgggttggaaactacagagagctgtgagtgccctcggccaggtgggcagcactgccagtgggtggggggtaagtaggcccacagactcgaagcatccgggttagctcctgggtgccttcagctgggggtgggctcaagtaattggtgttgagtggaaaacactgaaattcctgtgttaggttgaactgtgggcccctccaaaatatgcctacctgccactatggagcccaaccttatttggaacagggtctttgcagatgtaattaaggtaagaatctcaacataagatctcccagcgtttagggtggaccctaaatccaacgacttgctgtccttataagacacaggagagggaagtttgagatacagagacacagggggcaaagccacgggaggaaggaggctgaggctggagatccagctacaagcccaggaatgccagtgcagctgcagccgccgccaccagaacccaaaggaaaggggtcagagcctccaggaaaaccaccctacagacacctcaactgcgtgtggaaataaatctccactttttttttgttttgttttgtttttttaaacgcaaagtctcactctgtcacccaggatggagtatgatggcatgatcacggctcactgcagcttagaattcctgggctcaagcaatcccaccccagcctcctgagtagctgggaccaccatgtcaggctaatttttgtttgtttgtttgtttgtttgtttgttttgagatggagccttgctctgtcacccaagctggagtggagtggcatgatctcggctcactgcaacctccgcctcctaggttcaagtgattctacagcctcagtctcctgaatagctgggattacaggtgtgcgccaccatgcctggctaatttttgtatttttagtagagacagggtctcaccacattggccaagctggtctcaaactcctgaacctcaaatggtccacttgcctcggcctcccaaagtgctgggattacaggcatgaaccactgcacccggcccaggctaatttttttaattttttgtagagacagggtcttgccatgttgcccaggctggtctcaaactcctgggctcaagcaatcctcctgccttggcctcccaaagtgctgggattacaggtgcatgccaccatgcctggctaatttttgtattttttgtagagacggtgtctctctatgttgcccaggctggtctcaaactaatggcctcaagggatcccatagactcggcctcccaaaatgctgggactacaggtgtgagggaacacacctggccaatttccatcgttttaagccacgcagactgtgataatttgtcacggcagccacggaaaatgaatcctcttcctactaacaaagaaagtgattgatggaaaaacctaagactcatgaccagctctgtacccacactaaggaaagggtggcccgggcttcatttgcatggactatggttactgccactcctacttcccttattattacagcgatctcatctgctgctgcttccacttgctctttgtaggatgaaagaacacatcttccaaagtcccacaagacaaagagtcttcacaaatacgaatctttgagttctgaatgaagcctgggagggttgtctaggtgggctctgtatgtcctcagttaacaaggccgggggtccgggcagggaaagggaaacacctgctgtgttcgagaaggtctaactctctcctgagaaggtctgcagggtcatgttgtccccataacaatggaaccgtgactcctgacccacagttccttggctgactgtgtcccgagcagctgacatgcactccctggccggggtatctgggcagcccatgggaacatcacaatgggacattgggggagccccctccgcagccctctgggttctgagcccctggactccgaatcttggcttcagcccactgacctccatcctctgtggccccccatcctgacgtccagcacacttttccatcggggaagttctcttcagagttgggcaggcacacaggctggatcatttctgcttgaagggaaacaatagttcacaactcaattgaagcaggagtccgagaaaacaatctcatctatgcttctgcctctgaggagcccaaactatctcccaagggaaggaaggtcaagcccttggttacttgaaaacgatcagctcacagcaggagccccttaccccatccaccacacccagagcacttaaaactgtaaaagagccctccaccgtcgcagcgtgagggaacctagaccagggtcagcacaccttttgtggaaagggctgaatagtcaatgttgtaggcttcgtgggctgtgcggtctctggctgccattggagcatgaagacagccccaggtaacaggtacccacataggtgtggctgtgtccagtaaaatgtctatttaccaaaacacgatggggcagaccaggctctcaggccaacgcgtgcccactcctggctagatcacagtgtgggtgttgcctatagaacacggctccatgaatattgctatggttcctgggatatctggaggcgacgagtttgcctgtgtgtagggctggatcctgtgggcctcccccaaagccagagtgccctgcacatacctcgggctttcgtgtgaacacaccctgaggttccccgagcttttctgtgcagaacagtaatggagaggtagagaaggaataaaagaactcacttgaaactttggcaaagtacaagtgctggcacctcatttcctataaccaatatcattaataatagttggcagactggcaccaccataatcattttcctgcttctctggaaatatttgtttctgggcattacgtgtccatgtgatggatgcagtaatgactctgccaggtagagcctgcagctggtctcaggtcaggattctgcttcaataagagggaattaacctatttattatgctttccctgctttcttaagaaggaaagagggctttaatttaattgggagtagtctcctagtactttgtttgcatctacgagatgtttgaaagttttatcaggtgtggctcttctggcattttcgtaatgtccagagggcagggcttgactttttcaagaaacagggtctttaggagctgctggttgggagagaacttttctgtacttccagggagctgagggtgcccagcatctttcagcttgtaaagaaatgagaggactccaccacaccacctggccagcctgggaggttctgtttctcaaccaagatggcccctctacctggagaaaccaggcaggtgggaggcactggctgagtgacccctccacaataggctcctggacaggaaagtgctctttgtccctacagatggatgactctcttccaccacctagaggccccagctggtctggcctcaagaagctctttctgcctccaggtggcaccaacagggagaaggtggcaccaacagggagaaggtggcaccagacaaagcacacagcccacgaaggctctaaaattattgttggaactacagcccaccaatctacctggcagagtcatcagtgcattcattctgtaggccaggatctacaaactacatttaaacagggtaacattgaaaatgtaggtaggactcaagtctgcaaacatgagagccacattgtccaggatacaattgaaaatcacttgtcataccaagagctaggagcatcacaattttaatgagaaaagataatcaactgatgccaacaccaacatgaatcaggagttggaattattaatatctgacaaggattataaagcagccatcataagaatgcttcaatgagcaattgcaaatcctcttgaaacaaaggaagagctgcagaaccacatagagacccagatgtaccattgaacgtgagtggcccggccagcttcataagggcgatgtcattgcccagcctctttggcttgtacttgctgtggtagacaatcttctccaccaagtgggatggggctggattgtccaacagggaaactagacccacctggatggtccatgacttggggaggtacaagctgaaatgagaagagcaagaggtgaagcacaggaaaagtccaaccactgaactcattgacctcaggtatcctgaaaacctaggaagatggtgggagaggttatcaggcaagatgtggtcccatcaccctgcttgtttatgctgtatatgcaactgcactgccacgccctacagaaacacagacccacaccccatgtgtttcccagacctcactctcagcacctctgaggtcgtcttggcatttgagggctgaactcaacattggtcactgcaaggagtctatcaggcactactgttcatcaaacagcaacaaaatagggggtaaaaatatcagggagaaccattgtgtttggaagtcttttctgtagttttcttgcactctaaactcctgagattttaagaagagacccagtacctggcccccaacatattccctctagcctcccgcaccaccgtctcaccctgtctctgccataacatggtccactggaattagctatgggaaggtctaggtcctttcatttttgtgggtttcctccagcacaggagcttccttcctcttctgtctgccctttctctaggagctacaatccttaaaacaagctcagggtcacaagttacccccagctgatgatgatgggtccacagtgaggctggagactcctctccaactgtacattacttggaggttagtctctctgtcttccctctggacccgcttctcaccacccaaagcagccccaccctgacatgacccaggagtgaacaggggtctgggaagatggtcagcagcactcactcataaacacagtgtgcagcagtgatgatccacaggggcgtgatgacagagcccccgcacaggtggtagccctggaactgaaggctggcctgccagggccactgcgagagcaaggacatgtttccacccacgatgcgtgagctgtagccccttctatgaccacaggctatggaggggaacaaaggcttgtgggtccaccctgcagacttctttgggggacatggtgtcaccaccatgcacctgctcctctctccccaccctcactgcccctgctcccagagctcacagcagctctaagacaagtgctgcaagggggagctcagcaggggaggtggtcaggctcttggggagacctgaggatggtgggtgctgtggaggatgcggtgggaaaagcacctgccctgcttggtcagtgcccagcattggcagcaccactccccatcctattcccccagtgatgacaacaccctgggatgtcaggagcaggcaggaaccttctgcagccccctcctcactgccgctggtgcacgcacctccctgactgctccagaccccacccttgtggtgtgaacactcccctctgccaggaacgaggggcactgcccgaggcctggagtgggcactgtgcacgtgtaaggaggaagtgggaactgagtcagggactcaaggctcttcagagtgatgggacatcatgggccttggtcctgtccgctgctaatgagttgctctggctgtctcccccacctgacaggtgaggccgacaggtgaggatgacactgctcccctcctccagcaggtaggggtacacagagttcccgcctggcacccaggaggaagggatacagagccccatggggggagaggactctgagggcaaggagataggacttagcatgtgcttgctccccctggacccctgcctttctggaactcttacctgtgcactgcaaggtaaccacgtggccagaggcacatccctccctaaagcggagaaaaagtaggctctgtgaaaaatgccccagatctgtgaaaggaacactcttaaaaactcaatcttagggtaacagaaaaataaattctatttccccctctttgaatatagattacaattttagtctatgttcaaaaaaaaaaaaaaccatgaggatgaggtcacacaattcattgtaaaacactcaactaacagtgaagtattgtgtacacaacaggccgttctgtatttctaagctttagatagctagtgataaaggatgtgtaaggagatatattctatcaacatgtcacgctgtcattgcatggcgattcagcccaatgttctccacctcctggcccctagggacacaagagtgcccaagggacagcgtggcaagctctctaggactccttgtagcctgggttcacacatctggcagaggactccttccccagagcaataaagtgtgattgccccaaaattgacactcctacccccacccccacacacaggtggagaccagggtgtgtgcttttctcatagtgaagggaaagggatcccaaaatctttgtaatgttttctgccttttgagccccagctcatcatgcaagagaaagctagtgtcaccagactgtggatttagcacccaacacatgagctgtccctccagactgcaggtgggtcccggggtgcttattcatccccgacggacagaccaacaagcctactgttcccagagcagaaaatgcacatcttagggtttgggcctagatgtcagggagagaatatggaattggattcagaactcttggctgtatctgctacacaccgtctaacctggggcaaggcatgtggtccctgtaagtttcagttacctggtggttatttaagaacacctggttttaccttccccatgagttgttggggaaaacatgtaaaataaataatgaatgctaaaatacttcgtaaacaaagaaggataaatttctatcttaatttctgtttttcttccttttaccctccctctcttcctccctccctcccttccttcctccctccctccctcccttcctcttttcctccccaccccccttcttgcttgcctgctttcattccccagacacacccagagtgcctgtcacatgacagtacattggtcacactcacagcattgttacccttctactctatttccttccctttctttattgggccatactccctcaggttctcacacccccagcctggcgcatccaccagtctcatcaaggtggccaactcccaccttccatctgagataacacatgcatgcctcttaagtccttgtggagttgtgcatagcatcacaaatccagcaggtgactcgatacctgtgcagacaacagcatcgcctgaccacctacctcacatatactgagtggtgtaatgcagtcaccttgtcatctggcaagaggtgatcgatggacacaaactcctcccggaactgcccctccagcgagctcactctgaggttatctgaactcacatagctgcaagcacattggaaagacagacccgacgtggtaactttacactttgaagcattcaaccgatgtgcgagtcacaatattacagggattgtacatgggggatgtcattttgtccccccaaacccatcaaaggcttcctttgccaagagaatgaagttcactcaccctggcaaggcattcagtccaggcctgctgtgttctgggatgacccccgcttctggcctgtacctgacagccccgtccacccaccctgggctgcagccacacagtgagtgaccatctcctatgtccttggttgagtcactctttgcgcattccagtgaaatgccttttgcttggcctgaagcaagtccagaggggaggtgagcacaaaactaggtgcagtattgtcggggggcacccaagcagggacaccaagttctccaagaacagtgagttggaggaacaggagagacatccctcacctgcccaggaccagcgcagagccccactggaaagagatgaacacaaacaagaaagcgattccacgaacaccagagcccagctcatttttacagtgccaggacacaggtcttctggagaacagtggtgaaagtgatgcaactttttaaagaagaatcacatgtttggagagtcacaagatggaagatggtgaataaacagccatgttctccttcccttgtgaaatgaacaaaacacagtacagtaggcttgttttcatagtgaacacaccagcttatcaacaggatttcttcagcttactgtaaatgctatgggggtgtgtatgtagaatacaaagttcagtcaactttgagttttgaggaaaatgtaatcaaggcggcgggcacgaccttcgcagcccttccagggattgctcaatgcacggattccgctggcactggcatgaaagagccgatggttgctgggatggcttggccccagtgcaggtggcggggcttgtgccaggcaaggggaccccagtgctgcaactggagccccatgaactgtccaagtctcaaaatggtaacaatgacagccacaaccacacactcgcccagtgtgctcttgcccaccaagcccttccacactcacagcgtcagcggaacttcagttcccctccaagtacgtgctattatcatccctcttttctaagaaaggaaactgaggcatgaactgtgtgtggaacttgcctgagtctacactgggatttgaacccaagcaatctagcttgaccgtcctttggttatttatttatttatttatttatttatttttgaatcacagatctctgacataggatgtagtagagcagagaagattaaagaaggattttaaggagaatttaagaaaatagaacaaaatgcagaaataaatcttagaaactgaagcaatggatagagaacaaaagaacaagcctatagagaagaaagtaggcaatattggggtgagagatgggggacatcgcattccctggatttccttgtagagggagcatattaaggatgagaaggaatattttaccaaacgggctggggtggaagagagacgggaaggctacccccaccatgagtggcctctacctgatgcctgggacagctggggctcctgacttgggtctgctgggtggggaaggagagggattgagctgagtttttctgcataacagagcagagaggccttggggtttgctcagacagagcggtggtcctccaggacagaggaggagggcagagagaagagaaaaggaggccccccaacaccccccacccaatgagtcagaggaagaggctcagcggggaagagaaatgcccaatggggaagctctcagctgtgtgcagtgtgtgtgtgtgtgtgtgtgtgtgtacctcttcctccttgtctctaaggagtaatacatcattcctgaagacgttagtgtggatgatttttgctcttctcattgaacttgaattgcagctcatttctgaatctcagttggtgtggagggagagggaggcagacctcagggctggaggctggagggcattttggcttccaccagctttggggaaagacagccgagaatatgattcatggaatttgaaaactgagactctgtggaggactcagggcagtgtggctttaacgaccccatctacttgagtgcaaagcagaatgcagcctgcctgctttgagtgctgagacttgagagcaaaggggagtaaggaggctgctaggggaacccgtggaagtacagcggccgcaggaagtcagaaggaaggggccaggggagagaaggaggcccatgcctaggccaaaactgtgtcactccaatgcaaaaaatcatgtaggcaacacaaacactaaaaagtgaatagtcaactgttatagttctttgttctacatgttgctaaacaagtgttttggatgattgtgtcttcactaaatttctgactttcaacaattggttctgtggggttcttggggaagcgtgcatggacattgatgtgaccgccaggaccaagcaggaaagtgtccaggaagctactctaggagctgcaagctgaggagctggagggttttttggttttgtttttgttttctactttgaaactttttattgcatgttcgtatctccgatcctggcctggccctgggaacccccaaacatgccacttcccatgtgccttgagcaagtcacttagcctgtctggccttggtttgcttgcctgtgaagtgaggatgatatcgggcatcctaaggtggatgtgaggatgtaatctgagagcgttaaagcacccaatagtgcccaactaaatggtagttgtctttctttattgttatcctctctgtgttttgcccatgggttggaaatgctctttaacttaccttgggaaacccagttgggcacaggcaacatttgcgtagtgacccttccagtcatcggagcacatggtcttccacgaagcagctgtgaacacctggagcacggcattctgaccacccacccggactggccgatgtgcagaaagaaaggcttattagtggccagtggaaccctgagaccataggcaggggtttctccacagccagctcaaacccctcctctgccaaatctgacccacttcttgtccacggcagcctccccatcacagagcagtgactctggatccctgagacttctcgctggtctcatcttattgcttatgtggtctccccaagagagccagagctccatggaaggccctccctgaccccccagcccaacatgtctttgggcaaacgccagttcaatcccagctgaagacatgacctaaaaatggcaatgacttggacccattttacagatgggaagggtcagggttggcttctgctgcttccttctgtttccccaggggaagagccatgaccttaccacagcggtactcgtcctccccgtctttgcaatccgagactccgtcacatcgagctatcagctcgatacacttaaaggatgagcgacatctgtacttccctgagcagtcgaagtggactgggaaaagggaggaaggcaggaattaaccaacagctctttcagagtgcaacactaacaactgtccccctgccacacagtgcggagctggcccgtgaataatgaaacctgtattgaaattgcgtccctgtcagcagcctgtttcctgcagcccagtttctgttttgaattccaaggggtggggctgctgtgccccactttatctcgctatgtggcctggcccaggaaccacagtgcaaggtgaatttagactctggaggtctcaaggtcaagagagaaactgcatggcggggggccgacctgctgagccagccgagcaaggagtcctgactgagaactgctcggccttcctggtttctcttaccgaaggcagaaagtgaacgaagtgtggaccacacagtggggcaggtggcgaattgaactgacctgtgattcaggtatttgaaagaaaaattgttccctattagagaccctccatccaaatgacccactttctcaaaagccacatgcaccttattgtaaaaacagctggtgcgcctgcattgcatgaataggtctctttgtcttctccccgctgccccggtcagtgcctccctcccacctgcaggattctatttcatcagctgcctttggccactcctaaccgggcaggttccttggtgacaaagccatgagcatggccagcagcccttgcggcaccccagactgactttacattcatgtgggcaaataaaacttcaagtcagcaaaccaaaaggatgtttgcctccagtaattaaggctgggcagcagcaaaatgctgggatgagagggggcgctcatgaaagtttaactacttggctaggtatttgagatcctactaaataatgaattgtactcactgcccagaccaatggccagtgctaatatcaatgcaatgatcccaatgacgatgattggaaaaaacttcaatggcagcagtgacaggatctgtgcagcaacagcatctgcatctgaaaaccagaaaaaggaagagcagaaagccacagaacctgacttggagtgccatgaaacttacaaatttaactatcctttccccctcccctctttgcagagaagtctcagcccaaagaaaggtgccttaattagggaaagggccacccaccaaggggcacattctctagttcagtcctacctgctccacctctgacccggttattccatgggggatgaggggatgtgctatgggttgaatagtatcccccagaaagacacgttgaggtcttaactcttagtacctcagaatggcatcttatttggagatggcctggagagtctttacagagtcatctagttaaaatgagtcattagggtgggccctaatccaacgtggctgttgcccttataaaaagggggaaaacagccgggtgcagtggctcactcctgtaatcccaacattttgggaagccaaagcgggtggatcacctgaagtcaggagttcaagacaagcctggccaacatggtgaaaccccatctctattaaaaatacaaaaattagctgggcatgatggcaggcacctgtaatcccaactactcaggaggctgaggcatgagaatcgcttgaacctgggaggcagaggtggcagtgagctgagatcgcactgctacactccagcctgggcaacaagagcaaaactccgtctccaaaacacaaaaacaaaaaggagaaatcaggacacagggacaaacatgcatgaagggaagaggatgggaggagacacaggcagaagccagcctcatgaagatgaaggcagagatgggaacaatgcatctacacaccaagaaatgccaaagattattggcaaaccaccaggagctaggaagaggcagggcacggtgccctatgggtttaagagggagtatggccttgatgacaccttggaattcagacttctggcctccagaactgagacaataaattcctgttgttttaagtcacccagttttggggactttgtttcagcagccctatgacactaagatggaggggaagtagcatcccaacttccaaggctgtttccctgcagaggagggggtgaaacccacacggggggcttgcaggcagaggtagtgctgagatctcccagaggagatgcaaggacaagatgttgatttttgtttgtttgtttaaattttttcttatagagatggggatctcactatgttgctcaggctgatgtcaaactcctgggctcaagtgattctccccacttggctctccaaagtactgggattacaagcgtgagccaccatgtccagccgaggacaggatgttgatacaccattctccacaattgctgtgcacagacactgacagctttcattccagatcatctcttcaagaatgtgtgtagagcaaacagccttggaagatacagatagcgtctccctccagagcaagaggcaggtttgtttactgtccagtttaacaaatataatgccttcctccagagcaaagtttgcacaggtctgcttgcagaccactgtaaagatgagggttcccttaactctgggatatgcagcagcaatgcaaactgcctgcacgtgcggcatacacaggctgctccacatgcctctgtgggactgagaaggcaaaggcagccagcacaaacaggatatttgtgccccttgctgcactgtgaggaatagagtcctttgtctctgacccaggactctcgtgtcttccaaagcacccatgaaactgtggcaggctaaattttggcttgcaagtagggtgacatctcaggccctttacagttcttgcccctagaaccaggcaaatctggtggaaacaatatgtaaggagtgtccagatgcctggccagaagtataagcctctctgggcagcaggagaattcccactagcactcttccctcctggggagagcaggccatttcacctaaattacctcatcaatcctaaaaatacatgaatgcccaagttgtctttgttaaaaataaggaagaatggaatccagaaaggggagagaagcctgcccagggtcacacaattgcccaggatgagactggcacctgcctctcttctcctagtcttggacatgttgagccgagagctctgtcatggaagagctaaaaagatctttccctgcctgaccgtggagactcacaacttctaccctctggcaataaggagtgtgataatgaaatgatcaatatcagttgaggctgcctaagaaagaagagaatttgaagacaaaaatgatgaaaagacatggaatgcgaggagaaaagagtgtgcagaggagagggtgagcaggagatggaggaagagcagggaaatagaagctgcacttcgcagatgtggaggctgtgaggaacgcagagtgagggaggatgagagaccgtggcaagttctgtgttttaggcctggacaagctcagtggtttgttgaagctgcattatccatacctagaacagcaggggacacacagtagtccttgataaaaatgtgctagatgaatgaatgacatcatgataatgaaggccgttttaactcagggtctgagaccaagtccttccaggacagcccatctgcggtggtgagctggcagaaaggatcctctctccaccctcacacctcgatcccccgcacactaacaattctcctctataaggatgcccacccttcgtcttatacttagaaatctgcaggaaccccaggaatgacatcttcacattccagctgctctgtatttaagttggatttagaaaatgaccccaaattgtcaaatcaaagattgacatttaatcgaaaggctgtgtcagttcccgtttgccctgcttctctgtcaggctgccctgagggcactgcaggggccccacgcctcctctgtgcttggtccttgaggacattgcctggaataaacaatgaaatgtacagcatttctccaaagaaggaatgcaaatggcgcacaagtatgaaaaagctttcaacttcttgaccagcctgcccaacacggtgaaacccgcctctactaaaaatacaaaaattagctgggtgtgggggcatgtgcctgtaattccagcaactcaggaggccgaggcaagagaatcgcttgaacccgggcggttggaggttgcagtgagccgagatcacgccattgcactccagcctgggcgacagagcgagacctcgtctcaagaaaaagaaaaaaaaaaagctttcaacttcttgagaaatgaaaacaatgcaaatgagacataactacatgccaacttcacaatgattcacatgaagtgaaaggaaatggtcccccacctacagtcacaggggtagaaactgtgtaaacttcccagctgtgtaaacttagacaccggaaagctcaaaaacagatgaaagttttgacctagcagttccacttctaggaatttatcctaaaatgtcaccatagatatacgcaaatatcgacccccaaggacacttagaagaatggcacttataatattgatgcacaggaaacggaccaaattacccacaaaaaagaacgggtgaaataacaaatgaggtacacatataatggaatacctataggaggacaagatgatatagaaaacggttggagagattttctgtaaaggaccagacagtaaatacagcacttaaactttatgggccatgcggtctgtcctaacgaccccactctgctgttatggcgtgaaagcagccacagacagtatgtgaacaaatgagcatgtctgtgttccaataaaactttatttacaaaagaagggggtgggccagatttgacccatcagccatagtttgtcaacatctagaaaatatttaattatttaatgccatagaaaggtgaaggtgatattgttaaaattttttaaaagcttcaaaataatacaaatagtacatgttacttccaaaggaaatatagatatatagatagaaaaaggcaagaaattcaataataaattgctaataggattatctctgagtaatgatgccgtcgtgggtaatttttaaaaatcttttcaatgaactgtattttctaaattgttcttctaatgaacaatacattactctatttacaaggaaaagtttttgttcctccccactacttagtcatagcaaaataatcaaaaaataagagaaaggaatattatagtgctattaatattcatattatttatattataaaatattaggaacaactataggtcaaactatgatcaaatggctgtgtaaattgcatatctacttgatggaatactgtgattccataagaaaaaatttataaaaaccttttatggaaaaaacccacctgcctatatctgtactgtgcatgaaaccacacatacgggcaaaagcaggaagagactttgcagacataaaaaccaggtaagttttgggagtcaggtgattgcaagatttttttttctttcattgacacttagctaattttgagccatatttttaaatgtgtgtcttttcagttacttgaaacctcttctcccacctcccatcctttccaaacctcctccaagccaattttccagttggtttaaaagaaatcattagggtgacccccactcccactttctggaacctcaggcagagctcctgtggttcctccctagcaccaatgtgtcaggaatctgcctgcgtccaagccctgacttccagaaccggcaaccccacagctccctttgaccagtcctgactatctctggtcaaaaagatcctagccgtataggttgctagagagtccactgttttatcaggcatttgtgacttatttacgaaaccaacttttttccttcagttgttaggagccactccgtcatctgctgctggattttaatctaggcctctaatatctttggcgacatccagtttatcctgagttttcggagggactggtggccactgcttctcaggacttcctggaggactcagagatttcctggccaggatctgacctccttcaggattgacaggacaattgtggagccccagtctctgaaaacctccaacaagagaagaaaacaccggtctccagggagagagcaaagggcttaacgaaacgatcccctctccaatgccccttctccctgagattctgcagatctagggaagtgcaggtgtccagcctgtgggtgtcagaatggctggggagatatttcccccacagggacagtcagtcacattggtcacctacatgagggtatgggcagaaatcacagagtcctcacctgggtccacttacctggtgcaacaggacttattttcaaatcatcaaggccaaaaagcgatcggaatgagaagggggcttcaacagcaggcggatcattttcccccatggtgactatttcaggacctctgacatccggctccgcctccacctctacctccttagccgaggaagaacagaaagcatttgttcccctatttatacttgtagcatcaggtgcatcttggtcatacggtaaatctttgaaattcgacagtccacacaaagcgcattcagtatcgattaaccaaaaacagtcatctggtgagaatgcattttcgtctgagctacagcagataacagaaaagcttctagaattagcaaaaaaaaaaaaaaaaaaaaagtatgaacttaattctgctaagacaatgactttcccattgtttgtccaaccaatcttcaaatcgattgctttagagggactccctctcaccatttagaagttgccatattgctattgttcagaagataaattactctcaaagccctttccattgcttttttgcgattgttttcacctgtcccacataaacgcaattctttccctgtgcgtgtggtacacctaccataagcataagtagtttcggtactcacataattcccgagtcccaaaaatgtagatggcaccacggaagagatagtaggccacagtgttactggcttcccataaacacagccctttcctggctcacacgggcatgacctaattaagaacgaaagtacccgagccgtccggtgcccggtccttcccccacatagcaaagtggggagtggctttggaccaacggcttgcatcaaaataaccccggggctgtgtttcctacgaaagaattccacctatcacaatgccaaggagaccagagacctttctaagtcattccctgtaactctgagagggcggaggaagcagggaaatagcagaagattcccaattaaattctagttccctctcccagatatcaggcatggctgctctgggaacctgcttcctccaagggctaaaatccacaggggctccagcaggcacatcagcacagacactcagatcatccgctttcattccctttgtgactacctgttgtaacgtttgaaattccaaagggatctagtaagccatttgaagcaacccgtgtttcccaagatcatagtaaaatctaaacaagagttctgtgccaaaaatgttcatttcatttctatcgcaagaagagcttgaaagagtaacttagaaaagcaagaagttcatgttgggccattttctggctttcattcttgctgatacctctgtttattatcagcatgtagcaaattacatcgtttatccatataaaaagaataagtgggcaaatggcttctgaaagatggaacctgggtgagaacatcccctcccaaacaggctgtggttggcaagctgtacaacactgagaagtgttgagaagcatcttctctcctcacacccattttactcaccatttctggagctgccatcattaaaagcagaaataatttcctttttcattataaaaacaagtgtgatggtaagcaggccgccaacaggttagtccaatcggggaatattttccccaagtcactcagccttgtcgactcaatcatcgcagcaaatggcattatcgcgggcatctgtgtaacccaagctgccgtgggcctatcaaatagcccttggtggtatggctgcagagaccagggagggaaaaatgtggcttccctttaattagtcagtaaggtgagcaaaccttttcagaagctttgcatcagggagtgatcggaacacagccgctccttttacttgaaagaaggggtaggctctgcccagtgctgagcatgtgaccgtcaagagggcagacatactctctggtgggggtttctgtccctccctgtaactgagcccccaagttcaattctgcagctactcctgcagacaaaagatggggagcctgaagatgctcatcacagcctgcgctccacaaaagacacgtcatgtttccttcctcggaggcctctgcatcccaagaggcttctgcacacagcactgcttaaaggggtttaaccgctgctgtggggaccagagcgctgagcatctttgaagggctgaatttaccattgtggatggcaactcgcaaatccatgcatttattcagcaaatatttagcaagcatctgccatgggccagactctagacacagtgcagccagcaagaaaaacaaagtgctcccatggggccccagatgttaagcgctaggaagagattaggccggggagggtctgagagagatgagggcagagtggtacaggacggcctctagggagagtgttgtttcagcagggaccttgatgatgttttagtagagaccttggtgaccagtgaagtgagtcttgtgaaattcctccaaggagggcgaccaccagctccaaagcctggaataggggccacgctggagtgtttgaggaaccccaagaggggccgtgagcctagaaagcagggaacagggaatagccgatggcagatcccaaggcccaggggcatgggaagggctctggtttgcctttgatgtgtggaaagccttgggcgatctcaatggggcaaatttgggttgacaggcagggcatagagtggggtaaggatggggggacacaaggacagccacaaggaggctgcacctcatgggccacaagggccatgactcggcacgagtggtgatgacggtgaggactggctgcctgaggttgattttgaaggcagaattggcaggatgtgctgacggcaaacgcctgagagatgcgtccaggcagtccttgattaagacagtcttactttctccgtcccagtaggtacctgcccacacacctgtcagtgcctttgggtgtgatctatggtctccttcaagctcacacatctctccttcacctatttcctgactactctttctggtccctcaacgaatgtttgccctcaaaggcaatgacaggaaatttaacatgtcattctttctttgcttttacctgtgtgttataggagatgctccccgctggagtacagctctggcgggacagagtctggaatgcactttcactcctaagaccccgccgtgcccagcacagccatgtgtgtgtgacaggggctctgtctgcatagaagagctgatcataaaccctggggggacaaataacaccaaatcgacatacaataaccaactacgagggcatgttaacacgtgtgtcagatgtaggtcaaaggtcaagccagctccccacggggtagcagggagaggccctacaagggtggctggtcttccttgctgtaaaatatcctctcagaaagtttaccgacaaatcaattccactgagctcaaactaaaattttgaggaaccaaacaaataagcttatctggggcccagcgcgtgatagttacgcagccagtgccatgagcagacttggtttcagggcatgagcgccttatcctatcctgatgtctcctgggagccccatgaagctttagtaacgatttgcaaacagcttgagttacaggcacattctcttcagtaagtgagggaggaaactggtagactcttccctgatgggcttggaagataacttttcaagttaggaaggcaggatgaagctagatgtaggcatcttctggcctacacaaataagatttttttaagagaaatgcatagaagcatttttcattttaatatgttataaacataacacaattgctcaaaacagggtttattatttagaagagaaaaatatacttgagtagagactatatttcatacccaaatctactttttccctctgggtcacaagctttctctatttgcagactttcaaattcaagataaatcatttgattgtggaattatttcatcttttgaattcctcaaagaaaaaggataatgaagtgtgtggacattatgctaaatgaaataagccagacggagaaagacaaatactgcaggatcgcacttatatgtggaatcttaaaaaaaaaaaaaaaaaaaaaaaaaaaaaaaaaaaaaaaaaaaaaaagttgaatacatagagaataaagtggggttctcaggggagggtgtaggggcaggaaatggagaggtgtggatcaaagggtgcaaagctgcagatgtgtaggatgaagaagtccagagacggaagatacagctgacagccagaggtataatatcttattgaatactgaaaatttgcccacagcagattttagtttcggttaccatgaaaaaaaagtaaaaaaagtaacaatgcaagatgatagatatgttaatttgcttgatgacagcgctcatttcactattatgaatatagcaaaacatcccattgtacaccttaaatacgtacagtaaaaagaatattattattatatttatttattattattattattattttgagactgtctcactctgtcaccccggctggagtgcagtggcgtgatctcagctcactgcaagctctgtctcccaggttcacgccattctcctgcctcagcctcccaagtagctgggactacaggctaccaccctgcccggctaatatttttgtatttttaatagagacagggtttcactgtgttagccaggatggtctcgatctcctgaccttatgatccgcccacctcagcctcccaaattgctgggattacaggcatgagccaccgcgcccggccccaaaagaatattatttaaaaatcaggcagggcacagtggctcacacctgtaatcccagcactttgggaagctgaggcaggtggatcacctgaggtctggagttccagccgggccaacatagtgaaaccccatctctactaaatatataaaaattagccaggcatggtggtgtacgcctgtagtcccagccactcgggaggctgaggcaggagaatcacttgaacccaggaggcagaggttgcagtgagcctagatcatgccaccgcactccagcctgggtgacggagtgagattctgcctcaaaaaagtgaaaataaaactatacaaataaatatcacaatatgctcacatttaatggtgaaatattgagaccttgtcctctgaaatggagagttatacaagaaggtgcactagtaccacatctgttcaacatttgacttgggttccaagtcagtgcaataaaggcaaaaaaaatagaaggaactattatgcgtagagctgccatgaacattcatagaccaatctttgtgtggacacacgttttcatgtatatttacctttataagaaaccctccaaatgttccccaaagtggttggacagttacgcattcccaccagcacagtgtgagagctcctgttactccccagccttgtgtaaacctggtattttccattttagctcttctggtgggtgtgctgtggaatcacattgcggttttaatttgcatttccctgatgactaatgatgttgagcatcttttcatgtctatgtatatatcttctttttaaaagtatcttttttgatactttgcccattcttaaaatagatgcttgttttcttattatttgttataagtatatataaaatattctgtatattctagaaacaagtcctttgtcagctatatgtatagtgatactttctcccagtctgtggttcaccttattatactctttaagatgtctttcaaagagcagaagttttcaactttggtgaagtacagttcatcaactttttcttttgttggtttattcgctttatgtcctaagaaagttttgcaaactccaacatagcaaacattttttttctaggttttcttaaggagttttatagttttagcatttacattttgagttaatttttgtatataatgtgaggtaagggttgaggttcgtttttcctcctaccaatatgcagttttcctagcactaatttttttttttttttttttcagacagggtctcattctgtcacccaggctggaatgcagtgatgcaatcacagctcattgcagcctcgatttcttgggcttaagccatcatcccacttcagcctcctgagtagctggaactaatgccaccatgtcttttttttttttttttttaagagacggagtctcactctgctgccctggctgatctcaaactcctgggcccaagtgatcctcccactttggcctcccaaactgctgagattatgggctgagcctctagcaccatttatcaaaagcattatccttcccccattgaatttcattggcatccttgttgaaaatcaattgattgtaggtgtgaatctttttgcactacccaatgacacactatgacacaccatggcaacctgatttgtaaatgtttatgaaaaagcaaaggacaaaaccagagggtttagcactatagtgattaaaacagtgtagaatgggcacaaagagggacaaatcaaacaagagagcacacaagttagaaaaaactaatccatatacagtcacttgatttacaataagcctcctactgcaattcactgggcaaaggatagccctttcaatgcggaagtagatgaaagtttacccctacctcacaccatacacagaatgaattcaaatggatcatagagctaaatatgaagagcaaaagtagcaaaacttctagaacaaaacatagatgatcttcatcgatgttggattaacaacaatctcttgaacaggatgcagaaaactctaaccagagttcccacaaattgataagaaaagcaaacaccctagtgaaaaaaaaaaaagagcagaatatctgaacaggaacttccccagagaggatattcaaatgggcaataagcctgtgaaatggtgcccaatatcattatccctcagggaaatacaaatgggaaccacagggagatacaactacacaccacccccaccacagagtggctaaaattagggactgataatattaagtgtgcatgaggatatagagctttgtacaactgcttggcagttcctaatggagtttcacgtgctctgtgatccaacaaccccactcctagatgcacacctaacagaaatgcatgcacaaggcactcaaagacacatacaagaacgtcctcagcaacattagttacaatagcaaaacaaccgaaaacttcctgaatgcatatcaacagagaaatggataaatgaattatgttatatttattttatttatttatttttgagctggagtctcactctgtcccaggctggagtgcagtgatgcaatctttgctcactgtaacctccacctcctgggttcaaatgattctcctgcttcaccctcctgagtagctgggattacaggcatgcaccaccatgcccaactaatttttgtattttttagtagagacagggtttcaacatgttggccaggctggtctcgaactcctgacctcaggtgatccaccccccccttggcctcccaaagtcccaaagtgctgggattacaggcgtgagccaccacgcctggctggtatatttattaatcaaatactacacagcaataacagtgaactaactgtggctacaagcaataatgtggataaattttacaggcataatttgaggaaaaagaaatgagatatgatagagaatatgctatatggttctatttacataaggctcaaccacaggcacaattcatatacaagtgatacagcagtttactttctgggggagggaggagataactggaggaggctgagctgggggcagaggtgcatctgaggttctgagaatgttccagagcaggctatctccaccttggcactagtgaaattttgttggggagactgtcctgggcactgtgacattcccggcctctacccactagtgccggtaccacgatgtccaccccacccaccaccacccccgcctcattttggaaacaaaaatgtctccagacatttccaaatgtccccttgggtggaggaggtacaaaattcccctggttgccctgtttgattttgggtcgtgggggaattaggggtgtgggctcatttatggaaattccttgagctatacacatatgattcatcaacttttctgtacacatataaagcttttaaagtttttaaaataaaaaaacaagtcaatgaatgactgaaagaaccagtaagttttccagcaatccgagacaatagatagagtggggtttaatgtcttgttcacagacaaggagactgggatccagggtgggtcagggcagggggccagcaggatccaggagggaactcattccctgacttctcctccgcttccttcccccatgctctcacgcattcttgctcccgaatactagccaagtccctacagaggctgatcccgtgcaggggctcggttggacctttagcctcaaactcccgtggtggaaacagttaggattggtggacgctgcacccagcatcctgcaaacagaattctgaaaactgatatctcatgcaaacaggatatcaacttttgtcagaaagatcaaaaagagcttgaggtttttcttcacagcctcagccttgcctctccccctcttgctttatctcctcatttctgtgtgcaggcgagcttcttggcctaagggcaggaagagatggcagcgggggagacgcagctctacgccaaggtctccaacaagctcaagagccgcagcagcccctcgctcctggagcccctcctggccatgggcttcccggtgcacaccgcgtgagtactgcccagagaccccggggcccagccagtaaggctggtgccagaccctgctgcggcccccggcatggagctgcaggggtgtagggtacggcttcctgccaaagcagtgcaccttgcagggtaagacactgcctcttcacagggccctcttctgcttctcgtaaatgaggtgatcttgaccaagcttgtccaacccacatgaggcccaggacagctttgggcttaagccatcatcccacctcagcctcctaaggctgccctgttcaatttgtgttggctgcccaacacaaattggtaaactttcttaaaatattatgagattttttttttagctcattagctattattagtgttagcgtattttatgtgtggcccagggaggcacaagaatacccctgatattcttgaccttttaaagaccagctcggctggctgactgggggaccctgaaatttgtgaaaatcagaagccatgtattactctgggtgccccattttgggggtttggaggagattggggcctggttgtaatctctttgtgtgcagctcagtgactctgaaagtggcgtttcaagatattcaaactctaacgtgaaaggccccaaagcccgctgagtctctaacactgggaccaactgtcagcagggctgtgcttccacgctgcccggggaaagtcacttgtcctcagagacaatcccttgagtgtctgataacgaaacaaatgggtaggaaacttcagacacagtgtgagcgcgaccctgcttacccaagggaaaggcctgcatgtggaagagcttagccttcagagttaccactctcggagagggaggccacgacaccaacattgggttacagctttcatggcaaaccagtgccttaaatctgacccattcattttttcacatggaaaaatgtatcagaaacacactttaaatctgacccattcattttttcacatggaaaaatgtatcagaaacacactttaggtaactttgggttggggaaggagctaaactttccttccacactataacaaaagcttggccaaattgggtgaagtaactctgaagctagacaaacccatttcttctccccaaatcagggctttgtcgtcactgttatgttcaagctaagccaggggcctttgaatggggagtggggtcaggcatgtgcagggcggccaccgggcaccgtccaggcattacagacaaggcagcttttgtccactgctcaccacccagtgcaggcaggacactgggcccagagagtgcattagtggcggaggtggaacccgaaccagctttccatgcctttgaaggagtccacgctggattttactactaaacgtatagcatggacttctactcaaaattccttccagtttaaacattaagcacatgttggaggaagagaaatgtgtgttaatttccccacaccagagcacctcatagtaagtgccctgcaccaaggctgccttgttcaaacctctccaggtggccacagccccatcggtgcccacccaaatagcagcattcggcatcatgtggtgggttcctcatggacgcccgctgtttccagtctgcattcctgataaattacctttgctatattccattctgtttcatttggtccagttctgcccaattcaatgcaatgtacttacgtcccgggttaccgtgatgaataagactcagtcctgtgttcagggagttcttggtctagcaggggagagccgtgggtgcaaggggactgtgtaagccgtaacaagtgcctgcctgggtgctttggaaagggctgtttcccagcagagaggtgtgggaggcgagcctggggatcagggtcgctgatgctggggtgaggaaagcgtgtgtccgagccaggggcacgttccgcagggtgggtccatttgatctaggcagtggggggggggggggcaggccagggagagggattgcaggagcgggcggaggtcaggtcctcagccctgagaccccgtgccaagggctgaagcgggtagccagggaaggacagtgagggggaggtgtgagctggtcagcattgtccaaaaccacgatggcagcactcaggggacaggcgctagaacttccagctggaagttcagcatcaggccctcttcagagcaccccccaaagatcctgggtgtgcaaggccacaccctgcctctctgacccttttcccaagaatgggcgacgtgactttgtgtctgtgtctgctcttctgcaggctgaaagcgttggcagccacggggaggaagacggcggaggaggccttggcctggtgagtgcagctgcttctgtagacccaggggcgtttgggctgaattccctgtgcctaaggactccctcccaccagggctgataccaggaagagccgggcgcctctgggtgggatggggccactgcggaagtgaaacaaaataacctccctgcctacccatagtgcactgagggaggggcacagggctttggttaaccatggaaagagaaagagagaactctgaacaaggctttcttcacttacaaacctgattcaatccaatttgactgccaagaagaacaggttcatgtgctttgttgagtaaatggggaagacatgattgttgtgttgtgataagcacgtaaatgagggtaattgttagaataaagtaattaggttaaaaatggtaacatttgggtttatattagtactgctaatattcagcctatttcagtaattgaagagcaggctgggattttgcatacttgtgtttgattatgtcctcctcaactgcctactacgatggataagattgagatagataggaggatgtttgtgtttattgatggaaagatttgagacataattgacatctttgctgatagagactagcggccaccatgctctcgggctgcctctgaggggaagggagtttactggtggtcatgaagccaggtgtgtgggtctaagggtgccaggtgtgtgggtcgggtgagggctctgatttgaggtgacctcaccaggtaccagctgcgtgagtgattcttcaagccacccactgccatgggcctgttctctgctctggggatggagaggagggccaccgtttctctaaaaccctctcctacccggatgtgctgtggggagtccttcatcctctgccctgagatagccacggggaaaatcaaacaataaaaaccaggtcctgggaggctggagtgtcctctccaaagcaggagggcagatactgatcctgggtctctgaacgtgcagtgttcccaatgggatgccccctcctcctccagaaagtgtaggccacgggcaaaatgggcaaccccttcacagagtccactaaagccagttgccaattttggatcagaaacaagcccactgctgtgaagggcatggccagcacctgcccactgcaacccagtcaataagactaggaaccccaccaaaaaatagggaggcaatggggtcccctagactgtcaagagcaccccaacctctcactagtaaccagggaggtggtgcaaattaagatatcattagagcaaacaaggtaactccaagtgttgatgagggtgagggaagcagggcctcacacgtcactggtgtcactgaggaaggcagtgctgggtatctgccaaccttggcaatatgcacagcccaccagcctccgtcgtgcgtctaagcagattccctggagaaatgcaaggagcctaaagagacatgtacaaagatcttgattgcagggttatgaaatggttttaaaataaaataatttagatgttcatcaatgcgggaatgaacaagtgcaacattgtatatgtatacatgaactattacacagcctttaacaaattcgcgctgacaaacttcactagacacgtgtgtatcaacagggattaattgaaaagacatggtagaggaaaaatgccagttgtagaataatttgaataacagcttatgatttatgtaaaacaagtgctatctataagtccgttacttaaatttctgggagaaggcaaagcagcttcaccctctgggtgaaccctggaaagggggagggtgggaaccacgatggagaggagtggcaacttcttctgtgatttttattgaagagaatatggtcttgcgtaagttctgtttcctctagtgattgaatactactttctaaattgaaaattatatcacaggcactttgctgagtaattagaaattcttccaaaccatgatttctaatgaatgcacggtaaatagatttgctatcagttatggagtttttcttctttcttctaaataaccctaaataaccttctaactttcttctaaatagccctaaatagatggttcatgtgcaaagttttgcctatacagtactttgtgctctttcctcgggagaaatttctggaagtagaattattaatgcaaagagtgtgggcattttaagactctcaatacctattggcaaattgcttcacataaaagttgaaaggtctgtccttaagtcctgctgcatcttttacacattgagcagaacttttatcctttttattgaaaaaatctttgtgaacttgacagatgagaaaaatgccgtctcggagctattttatttccatttttattgttagtgacaatgaactcctatgttgggtcatccgtcgtttttcctttaatttaaaataactgtctgcctgaaatcccagccagtcaggaggctgaggcaggaaaattgcttgaaccggagaggtggaggttgcagtgagctgagattgtgccactgcactccagcctgggtgacagagaaagactccatctcaaaaataaaataaaataaaataaaataaaataaaataaaataaaataaaataaaataaaataaaataaaaactgtctgaatctaaagaaacgcagcagctacctaaattttgtctaggtttttggttttggtttttatatgtaatttgaagtttgaggtaaaatacaaatgtgaggtttttccacaaaattttcccacaccatcaaggagatgctgggcccacggatcattggaagaccaggttttaggtcttgctgtcaactttctttcattttttctacctttgactttggaatcagactaaggtgggtctgagagcaggacttacactgaccaggtctgtgccacacacagctgtgccgcagtgcctcccaccagtaggatggctgtgagattaatttatgtcatgagcatatatgatgtcttcagtgtgccctataattctgcattgctgtcattgtcattctgttgtgtatcctcaaaggggaaaactctttttgttgtgacagtgggtgatgccggcttgctctctgttgcaggctgcatgatcattgcaatgacccttccctagacgaccccatcccccaggagtatgcccttttcctctgtccaacggggcccctgctggaaaaacttcaagagttctggagagagagcaagcgccagtgtgcaaagaacagagctcatgaggtcttcccacacgtgacactctgtgacttcttcacggtgagtcaacccagtgtgccttcaatgctcacggcagctggaggcatttttctgtgctaactaggccatgatgggacaaagttgacttatttaaatgggatagtccagaactgcatcattagctggcaccttcatatgagctgtcctttattttcctctttgccttcatctggtcaactcctattaatccttcagaacccaactcatttatcctctcccctttttgagtcttctccagctccccaggcaaaaggagttgctgcccattttctcgttcatgtgtctagtggcacttttgtatcatacgggccatgtgtctggtgcagcaccgcatccctcaccagaccgagtccctcaagggaaggcagatacctcactcatctttgcacccccagaaactagcacagcccctaaaacagagtttgtgcttccaaaatgtgtggtaagtcaactcaaggatgggtgattgttggctacccacaaatgcagaacttttccctgtctcagggaccagccgtctgattcagaaaaaaaatggcccagtgggtagctccacagcaaaacacaatggcccagcaggcagctctacaggggcaccgggaagacaagaagaatgtgggagctgctcaggagaaaagaaggagaagggagagacagacagccactgctctactcagctccgccagaggggcttaaggaagggcacacccacttctgctaccgcggcctggccccaactctgctgttggcaaactgatttgttccacccatttcaaggaattccatcagggcccaaggaaccctccattccaacaccaggcccctcggtgctggatggaaaggaggaatgcaaacctctgaagggaaaagatttctggaagatgtcccaggagaagcagtaccttccaaagcctccaaccaccaccccggattgcccgagacttgcagggatccccagagcacaagactaaacctggaaaagccccagaaaaatcgagagagttttccccctacatcgacatcaatggtacttgtgacaagctgactcccttctggttcaccctctggagccaacggggaaaggcaaggcagcccaagccatgtgacacagctcagaaatcagagcaggccttggccccccactccttccccagcccactgaggtgcaagcacacacacacacacacagatagacacagagacacacacatagctcacacacatagacacacacagattgacacagagacttacacatgcacacagatacacacacatacatgcatacagacatacatagatatagacacacagacacacacagatagacacagagacgtacacacggcacacacagatacacacacatacatgcatacagacatacatagatatagacacacagacacacacagacatggagacgtacacacggcacacacagatacacacacatacatgcatacagacacacacagagacacagatacacacagacacacacagatagacacagagacgtacacagcacacacagatacacacacatacctgcatacagacatacatagatatagacacacagacacacacatatatacatgcatacatggatacagacatacacagacacacacagatagacacacatacacactacatgtacataggtacacatgcaaacagatacacacagatatacacacacaggaatacacagatacatgcacatagacacacacagacacacacagagacacacattagatagacacacatgcacaaacacagacatgcacatacatgcacatacatagacaaatgcacacatacagacacacacataagcaccacatgcacacatatgcacacagatacacacatgcatacacacagacacacatatagacatacgcagacacacagacacacatagacatacgcatatgcagacacacacacagacacacacacatatagacatatgcagacacaaacacactcacacacctccctctgtcgttagctcctcccagtcccccaccccagttctggcctggccgtggttagtggagctcccctcacaggcagaagagtgtaacggagactcactgtgtaccttgatgctgtaaaatgaaaacactaatcttccgaagtgtgatattgatcacagctacacttataacatgactattcttgaaaattacatatctgaggccaagaaacacaatgtgagacggattcaggaatggacatgtgttcactgggtggttttgtgttgagtgccgttgagggttgcagagaaaacagacagggaggaatgtcaggccggcctgtccatggggagacggaagctgcattaaacactgtgatctggcctcatacttgggcttgtaagaagcactgtgggaaattccgagggcagcccggtgctgggaagagaagggatcaggccaactcccgccaggagggtgtggtgtctgggtttcccctgtggtccgatgtggccaatggcactgggaaggttttcaagcccaggaagcagcctccccagggcggtaggcaacaccgagcccagatgtcaggagaggctgcgtctggctggaggatgggggtgggagccccgtgggcaaggctgtcgggccagcacctgtcgggctccgtgggcctgagggattctccaggtgacagagagcctgcggcctcaggggtgggagctgcatcagaaagagggtcctgcagccactcagggggcatcagggaggccgggccaggggctgtgcaggctcaggtcctccagggagcagaccccaaggcagaattcccagtgcaggagacgcacaggggagagactgctggtgaaggcaaaagaggaggagagggttggaggcaggcagagcctcagtgccttagaggagtccctgtggaacccgactcagtgctcagccgtggaagagagggtggccccgcagctggaagtgcagctgagtcccgctcactacaggctctgagcagtgcctgggcagccttggagtctgctagaaacctccagaagccaaatcatgcaaacctgagcaaagcagtgtgccatgggactgaggaaagggcctggcaggtgatgagcacgtgccatggagggaggggatgcagttcaacgaccaggggatttccaacctgggcacctaaaggagactccaacctgcaaagaaacttacctgaaatatttgaaaaaaccgaggtccaggtatagaacaaatccataaccccagacacaaagggacgcaataaattatgttacagcgctttgaacagaaaagaatctcactttaattgctgcctgattgttattaattaaattaatagatgacttctgatgagaggtgtggaaacacaggctctgtctctgtccccttagtgtgaagaccagaaggtggaatgcctgtacgaggcgctgaagagagctggagacaggctcctgggctccttccccacggccgtgcctctggctctccactcctccatcagctacctcggcttcttcgtcagtggcagccccgcagacgtcatccgggaattcgccatgaccttcgccacggaagcatctctcttagcaggtgggcagccctggccagttgcaaacacagggctggattcacagtgagtgagccctctgtggcagggactagcccccggcacatggatgcagtgggtgggttccaggggagcagagcccagcagcaatggtgggatggctgggtgggctttcttccgggctcagtggctgcacctgtcctcacccaggcacttccgtttcccgcttctggattttcagccaggtgcctggacatggccctaacctgaggctgagcaatttaactagagcctccttcgtgagccactacatccttcaaaaatgtaagccattagaaagcttccggaccagctttggtcttctctttaggcgggaatagccttgttctcattatgtggtttttaaaatgcttagctatatgccaacagcctgggaaagtgccccagaagggtgtgccaagcatcaagcctgagtgggtgactgtgacggggttggaggctggtgcacacagggagtcagggcctccccaccccagccttgagtgggagacacacaagtcctacgtgacttatttctgtattttcagtatgagcttagtgctctctccttggcctctccagggaaagattatttagactcatattcagaatcatcaaaattcccttctctccaaacaccagccctggcctggagaccaaggctaccattggggtttagtggaaaggattgtggacttgacgtcagaagatgtgatttttttctgtgtccctgatgagtggcatgaccttaatcaagtcatgtccactctctctgtctctttttctttctctacaaaacaatgagggctctcactcttcaagaacaatgttgcctgagtctgtggcccatcctgccatagttcccgggacacagaaggcactcagtattgctgagatttgccgactctaaaatctgacgaggccgcagtgccttggtgggagggctccccactttctctctctgggagcgtgtctgtctgtgctcagacatgtatgaagcacagatcctggcctgtaaatccatccctgaatcctgggcttccacttggatggcagcttgtgagtctggagatcgaatctgctgaataattagaaagtcgcccccggtctttgtggattagtatcctttatcaaatgatggctctttcacacccaggccctcccccagtgaacctcattggcagcatcttaaaaacaggaagactgaggctgcaaagggtgaagggcctgcccaaggtcctgtggtgtgtagagcggtgtcccctaaaaatgtttgtccaccaggaacttgggaatgtgacctcacttgggaatagggcctgtgcagatgcgattggttgggaggaggtcacactgcattagggtgggttcccgtaagggtagaggccgcacagagacacagagaagccatgtgccgactgaggcagagactggagtgatgtagccacaagccaagggacgcctggggccaccggaaactggaagaagccaggaaggacccttcccaggagctttcggggagagcacagccctgccaacaccttgattttgaacctctagtctccagaaatgggaggcaatacatttctgttgtttgaaaccaatctagtcccctaaccaggctggcggagcagggacctgaacccacctctgtcctgctccatgctgcctgggttcatgctgggcagccccacttcctgtgggagccagcgttgacctcacatctacgccccgaccctaagcaggctgtgtcctgcccttccatggcccatgctctcagcctgacaccgagggggtggaggggactctctcagtgatgagtgaccagtcactgctctgaagtggccgaggtccctcttggggcaaatgcatgaggcccccttgcccgcgttggtcctccccagtgaaacgtgcccataggcacaggtccgcagagagaaggaaacgcaaggacccgttcagaagtcggtgtgactcactctgacgtcagcaacctgcagtgggtctttcccaggccacactcactcgcatggcaaggcggtcctccccgactgctaaaaacaaaagtcaggaaaggaatttccccaccacctacacactcatgctgctccccaccacctacacactcatgctgctctgggctgtgcagcctcagtgccccagctttcctagagaccgtgggagcttcccatttgcctctaaaggctcacctctcacgtgggagacagcagtgagccccaacttcggggctccagggaaaggcttgcatcaaccttgaccttttttagggggtgagcagatcctgtttgtaagtgccctgccgtggagtgggggcagggtacgtctgtgcaccgacacggcgtctctagcaggaaactttaggttaggaggctgatttcccactgcagccttggcgagcaggcgctgccgtcctccagcagatgctgctgaagcagaaattgggcaggcccagaggctcagtcaaggtcaccctgcaaaagggggcaaagtgcagcctaaaactaggtctatctgacaccaaagtttgtgttgttcccgtcaagacacagaccgcctccctaggacataaaatactttgtggctcaactgaaatcagatcctggctgctttggtgatgccagctgctctgctcagactgacctgagagcccctggcaggaccagggagggctagggccacaggggcagaggacacccaaaaagacctgaggctcaaccactcccaggacttcctgcttcaccaaaacaaggtgaaccttaaagacactgtgtgttttatagttttgttgcctaaagagttttcttcttgaaactctacgattaaacaaaaagccgttgaactggagctcgggcctgcaagtccaggccactgggtaacgtgcacaccccggggaatggaggagccgtttactctgtgcatctgaatcgtgcattcgggcagctagcctgcaaaccgataggcccccgagaccctgaacccacatctccatatcgtcctctttcctacttcctggaaaaatctacagggatccagccatctcctttatgatgtgagttctgagcgggccaaatgagctctgagttctgagagcccttgccttgtggaggaagcatggaggtcggaggaaggagacatttaggtaacggtgtcctggcaccctctgtgtttccctgatttcacagactgctccgtgaagccttgcaccaaacagctgcatctgaccttggcccacaagttctacccccaccaccagaggacgctggagcagctggccagagccatccccctgggccacagctgccagtggaccgcagcactctactcccgagacatgcgctttgtgcactaccaggtgagagagctgagcaggggctcataagaagcagatgaatgggctgggctcggtggctcacgcctgtaatcccagcactttgggaggccgaggcggcggatcatgaggtcaggagatggagaccatcctggctaacatggtgaaacctcgtctctactaaaaatacaaaaaattagccaggcacggcggcgggcacctgtagtcccagctactcaggaggctgaggcaggagaatggagtgaacccgggaggcggagcttgcagcgagtggaggtagcatcactgcactccagcctgggctacagagcgagacgtctcaaaaaaagaagcagatgagtgaacggccactcacctgacagcatgtaccccctggagccctccaagggagatatgttagtagcaaggaaaatttctattgcttctctaaagccattctctttcttgtgcaatttacaaccagcattcttttatatgtgagttagagatgcacagacaacaaaatagaagcatttccaatattagaaaaggaagctgggtgtggtggctcacacctataatcccagcactttgggaggctgaggcaggtggatcacttcaggtcaggtgttcgagaccagcctgggcaacagggcaaaacgctgtctctactaaaaatacagaaaattagccgggcgtgatggcacgaacctgtaatcccagctactcgggaggctgaggcagaagaatcacttgaacctgggaggtggaggttgcagtgagcagagatcgtaccgttgcactccagcctgggcaacagagcgagactggcaaaaaaaaaaaaaaaaaaaaaaaagacagaaaggaaaggactattgtaaagatctatgaatacatgttttgcttattaattcttttttatttatttattttttaaatgtaggggccatgctaatcttctctgcagcattccaattttagttatatgtgctgccaaagtgagcacaattcactttaaagaatgatttgagtgaaacctcattctgggacttcctgcccatgaatcgatgggtttagaaacgaagtgtgtgatgctcctttcagacccagagagcacgtgtgaatgaatccaccatgttctgtatcgtatgaggtgtcaataacctcacaccgaggaaggcggatgtgaaagtctgcttatgccttcagatcttttgtagacaaaaaagtacctagatggatggatgatggatagatcccaaaatgtatctcttttttttttctttttttcttttttttttttttttttttttgagagggagtctcaccctgtcacccagggtagaatgcagtggagtgatctgcgcccacttcaaccttcgcctcccaggttcaagtgattctcctgcctcaagcttcccaagtagctgggactacaggcacccgccaccatgtccagctaatttttgtattttcagtagagacggggtttcaccatattggccaggctggtctcaaactcctgaccttgtgatccacccacctcggccttccaaagtgctgggattacaggcgtgagccaccgcgcctggccccaaaatgtatttctaaatctatccaaagaattctatgctgcgtttcattacattctgtgctatatattgccagacaaagctttggatggagtcttggagacacagaacacattggaggggcagaaagcaggaggtggcaggtgataggcctcctattgctgccattttccaatgtaaatctttgctcgagacgtgaaacccctttgcctcttttctagaccctgagagccctattccagtacaaaccccagaacgtggatgagctgacgctaagtcctggtgactacatctttgtggaccccacgcagcaggacgaagccagcgagggctgggtgattgggatctcacagcggacgggctgccggggcttcctgccggaaaactacacggatcgagccagtgagtctgacacgtgggtgaagcacaggtgagtgctgcctctggctgcagccccgtcatctctctctgagttactgtgtgagagtgcccacctgccaacagtgtgcttctagaccattccattattggtaaaattgcattctgtatgctgacaaaattattcctgcaggtatatagtaaacatcttggttcgtccctggttttctgatgataacattcaaaaaagaatgaattactctgcattagagtaatttgagatggtaatccccaaattactgcaaaatactacttctttatcacacacataataaattatactcagaggtcctgagcttgggtttatttattcttctgctccgtgtatgaaatgtaaagtcctaggtcgtattattagttttctatgactgtataataaattaccactaaaacaaagtgcaattattatcttatggtatttatgggttgagagtcagagtccagcttcactgggtcctcagctcggggtctcaaggctgtaatcaaggtgcctgccagggctgggctccccactgaggcttcacaccctcgcctgagcatacacagttgttggtgggagtgatttccttgaagctgtagggctcctggtgagttgcttcttcatcagctgaagaatctcttaattttagcaccttttagcatcatctggtgaggctaaggattttcagaatcatcagatactggttcttttttgttcgatgttcttccctcaatttatctctttcctctcccgcttcactataaataacatgaagaaaccaggtgatacacttaacactttgtttggaaatagccttagctatgtgaccaacatcatcgcttacaagtcctgctctccatggacaatttcattaaactctctggcacacatgggaaggatcctccttgctccgatttcctggaacacctgtcacattcctttctgagttctccccggaggattcacctttagcatccctatttcctctagcagtctgttcatggtgatttgggctttctctgctgtgctactcaaaagtctcttagcctctactcgctgccaagtcccaaagttgtttccacattttaagttcagaaggtttccaacttacaatggtttggcttaggatttcataatgttacgaaagtgatatgggttcaatagaaactgtacttcaagtgcccatacaatcattctgtgctacattttcagtacaacattcaacgaattacatgagatactcaacacttgattataaaatcggctttgtgttagattattccgccctatcataggctactgtaagtgttctgagcgtgtttaaggtaagctaggccaagctgtgatgttcagtaggttaggtgcattaaatgcattttcaatttatgatgggtttgttggaacataaccccatctgaagttgaagaacatccactgtttgttagagtagcaccccattcctgataccaaatttagtaaaagtttaaccagagatgcagaaccagtcactttcatacaatatataatacatataagtatatgtacagttgtcccttgctatctgcaagggattggttcccggacccccacagatacccaaatcctcatgttctcgagtccccgatataaaatgctgtagtatttacatgcaacttatgcacatcaccctgtatcctttaaatcatctctagattacttgtgatatgtaatacagtataaatactatgcaaatagttgttatacggtattgttttttatttgtattttttaaattgtattgctattttttaattgattaatcttttgaatatttttggcctgcagttggttgaatccacaaatgcagaacctccagatacaaagggctgactatacatacatagtattttatattatatacacatgtatcacacacatatatatatggaaaggtatatatgtatacacacatctatattgatttactacaatgaattgccttatggaattactggggctagctaagcaagggcagacaggcaggaagggaggagcctacttaggctgaaaacccatgggcaagctgaagcttgttgtccacatgtggcagttggaaggaccacccgggtgatgggagagcagtcacagacacagctgctattgaagtctctgagtgtgaggaaagcctaagtttttaaaaaaaaatgccttccaactgcataagtcagacctgctcagaataaccttgcttttgattaatttaagctcaactgattaggggttctagtcacatttgtaaaatctccttccagcagcacctagactagcatttgatgggatagctaggaaggctgtgtgtgatgcttaggatggctactgcctcccttccatcctccagctctcatgagaatgcctcttgtagcccaccctgatcagacatgtgctaaaaaggaagtctaggaactgtcgttcagtctggccaagttgccacaccataaagccattgcaaagtgttaaggtggctcttgtgagctttttcactctcttctcccaggttccagttaggagagtggagagagcaggcagaggtcagagtacacatggtgaaaaaagagaaaagctgctcagcctcatgggtgtgcctgttggggtggagctcttgcaggtgtcaagactgatggttggaacaactgaatgatgagagtgggaggagaagggcagaaatacacagaaaaaccctatgttgtggttctgggcttcctggcaccttcagagctgtgtggctggggaagagagcctggaaaaacaccatcgtggccatccctctgtctccaggcaggaggtcttaaaaccattttatatttcactcatttgtttaattctctcctaaaatgctccacagcttctctagggttcccctcaccaccctgacaaataaataaatcattaagttgaacacagatgtatcagcatctactcaatctatagattttcagatctgtgctggacatttgctgtggacttctatttccagcatctatacatccagggaattattttctgtacccttcctaatgagattcatgcacatggcaaaactatgaaaattgtgacgttttatttgagtagtcattaaaagctgcttaaaaattgtcagaggctatatggataagcctctgtgtggataagactagcattttaagtaaattaagaaagaacgtattttgaagagctgaaataaatgattgcatattggtcatttttatccaaacccccaaaaaagaaaagaaaagatggtttaatagtacctgatagaagctcttggtgaaatgattagaatttgcaagaaatagtagtaaaaataatggaagtattgtctgaaatatttataaaaggagatttggtgactatggctgatttctttaagtattatatttctttttgctaattattcatacactgagatttgtataacaagccagggacagtacctatgtccctgggctcccccactaaacataatagccacttgacattcaaggagagcagattccagccaaagccccacagctgtgcatacatgacattccatatcatcttctcttgaggccatttaacttcttaccctaatgaataagaacttaggaccacaaaatgcaaatgtgggatgaaaaatgcagccgtagtcacacgtctttatttattgatgtgttgactcctaatccacttaaatctattttaaggcagcttaagagatgtccaatagctttgcacactaacatcaccccctgtgcctggctctgtgccatgcatttcccttactaactgatttacttctccaataccccctggataggcacttttattgatccattttatagttgatgaaactgagacacaaagagatcaactcacttgcctgtgttcacacagcaagtgagcagaggaagccggattccagtcttatacctaatcccacgcttgggctttcaactatgacctcaactgcctatagaagagatcattaaaatttaaaaataagtccataaattaaattatgacacatccatacaataaaatatttgcagctttaaaataattaaaagggagaattttatatattgatttgaaaaaatatgcaagatttattgataaatgaaaaaaataagttgcagaacgatgtgtatggcatgatatacttgtgggggaaggggagagaaacacataactgtctgtaaatacatgtgcacaatatgtatttctatacatgtgtatgcctaaaggttccctggaagggagagtgtctagaaacttctaaccatggttaccggtgggtgttgggagtgggagccaggagaatggaacagaaatgggagggagtcttttcaaacacgaccatttcataatgtttaaatgtatgaagcatataaatgcattacttactcaaaacataaattaatccattttaaatttcaagaagagaatgtaagaaagctgggtcaaagggagagtaaaggtggaaaagctagacaaagccagggctgaggtttgtccataccatggcgtgcgctgtgagctcccagctccgagctttcccacatccagtgagaaaacagacacacattcaaccaacagtcatggccatcccagatgcgtgcagaccagcggttcaggagaaacacaatttgctgacatagacatgtccgtgggtccaggggccacatcaaaatcacaggatgtgggtgccacaagggattgtagagataaccgaaggcagctcccctgcttgagaggtgagaagactcgggcccaggaggccaggtgacgttgtacaatcaaggaagctcttgctttcttgcaagctcagttcaccacctgatccaatcaacagtttaaggaatagagaggagatgctggctatgccctaactaaccatctcaatttcaggagggttggggctcccctgtggccccgcatcatttagcatgtccttcgctctctgcccgggatgggagagtttcacagtcacagaggaaccacaaagactctgcagaagatgagtcagcggctatgatacttttcacttcacaattaatacatcagacacctgccatcaacataaccattccagcttttatgcctgacatttctgggactattctttccagaggaactttctcttgagaattaatcagtattaacaaaaattgcaatgaaaggaaagagaaataagcactgggctaggtgctgtgggttgtctgattggtcctgctttggaagcaccctcattgtggctgggggagcatcaagacaccctgacaagctgtgatctgtgcttatgggccagtgaggcagatgacgggagctgttggactccactgtgctggctaaatcttttcaaactgctgaaaatccttattaaacatctaaagctttcaaaatcggaaaatgatccttgaatgtctccacacatcactgacatattcattagtggaaaatggggtcagacagcaatgtccagaggccagctgacccacggactgacagatagctgtgcagatgttgaataattacttcctacgagccctggtcaggactcacacttgcacgatccaagcagcagaaccactggcattagagtgcctggaaacagacctgcaggcgcaccaggaggaatccccctgcccgccacagagggcacctttccaggtaagagtctgcagctctgatgaatagtacttgtcaattaacacaccagtcacccatcaccactataatgaccccagcctcagcctccgtgccagacggtgcagggattctttggacttatctaccgcaaaatcacactgtaatgtttgtccattgctttgaagatcagagatggcctggagagactggtgatggaggaccgtattcacaaaccacagcagcttccaatcctctgtccaggagagcagaggggagcacccctgtgggacaaacaacaggggggcttgagtgtgagggctcgggagaataagtgccatcccccagtcaagatgaggactttcccaacactgaagacagacacagcagattacttcaaaaacctcagagcaagtttacagcaaatatctcagacataagaaaggtacaattaagggctaaattgcattctgccaacattcatatgtggaggtcctgacccctaacacctcagaatgtgaacttatttggagacagggtctttaaagaggtgactaagttcaaatgagggcattagagtgggccctgatccaatatgtctggtgtccttataagaagaaatgaggacacagacacacacagagggacagcctgtgaggaaacgaggagaagtacctgtctacaagccaaggagagaggcctcaagagagaccagcctcaatggtggcttgacctcagactcgcagcctccaggactatgagggcatctgtggctgtcgttgaagccgctcagctgtgggactttgttatggccgccccaggaaatgaacacagggacgtagtgatgcaacccccagatggcagctatgtccttttaagaaccagggagaattcaaacacatctgtttcatggtgtaagttactgtcaagaggctctcttaagtcaaagagaaaaatggaaatgtgaaaatgctaagctcttttctttctccttccgtcacccatgttcacagcataatcttgattgtatttcatttgaaagactagcaaaatgcactccgtttctctctgtaaacctcacagatgtcatcagttgatagcaaagccctactgtctgcagagcgagccgcagggaggctgtgggtgccctcgccttgccctcaggaaggggaaaccaaccaatatttcctgtgctaatgtggggctatgaattgtgcctcactgctctgagcatgttaatttgaagaggaaactgtcgattgttccaatgagactatctatattcttggtctacttaggatcaactcaagtgtgcatttcctatctaatggcatctgacagcttgagaagatgcaaagtaaattggcctggacctgccatagtttatagatggagacagggcaggtaatagtgtgagaagatcatgtgtaacgcagatgctgagatgcagaagaaaagatgcccttcctggctctggacgggtctcggtggaggagtgggagctactgctggttttatgagaatgtggggacttgagacctctatgggagaaatgcaaacatttgcaaatgggctggataaatagaaacatgccctgtgcatggctgagaacagtaaactgtggtggtgtgtcagttcctcccagagtggatcaaaggggatggtgtattagtcagggttccccacagacagagacagagacaaagacagagagacagagagtgaccgagagagaaagagagagagagatctagttgaaggaattggttcaagactgtgagcctggcaagtgcacaatttgcagggcaggctggcagatgggagaccctgggaagagttgaggttacagctcaagtccaaaggtggtctggaggcaggatttccccttcctcatgggaccccagttcgtttcctcttaaggccttcaactggttggatgagacccactcacagtgatgtgtcgagacattcaaggaccattttctgatttaaaaagctttaaatgtttttaataaggactttcagctatttaaaaagattgagccagcaccatggagtccaacagccccatcatctgaagggtggtctctgctttactcagcctagtgacttaaatgttaatctcattctaaaaaaataccttcacagtgacatctaaaataacatttgacccaatacctgggtactgtggcctagccacgttgacatgtaaaattacccatcatagacggtgatcattgtaataaaacaaacacatcatccacacttcctgagtcctgagcactttgcacacgctacttcattttgtgctcatgggaacctttctgctgaggttgtcccggacattctcaagtacatacatgaccagatgctgggtctccatggcaacaacatggtctcacttctgttcaagccgtgctttccttcccctgcaggatgtacaccttcagtctagccacagacctgaactccagaaaggatggtgaagccagcagcagatgcagcggggaatttcttccacaaacggcaaggagtcttagcagcttacaggccttgcaggtaatagaacattcccttttttcttttaagtaaactaagcaaaactacactttgtattaacttcacggtggacacagcttcgtaggtgtagcttttgttccatagacacatcctccctgccctagagcgtggtcagcaagggggcctcccaggtctgagggtgccgggggtcctgccctggtctgtctgctctgggcagacagggagccaccccttcatggcagagtgccccaccttgagctcctcaaggcagctgaatcccgagttctcatcccattccctcattcatgagccaagaggtccccaagacgtcacctgccccggtgccttggcccctcatcttttgaggcaaaactctccataacctgggggtcagcagactcaggccagggtccagggcacagcagggcaccccgagctggccaccctcatggggcacatccaggagtgcaggctgccaggcagggacaccaaggagcaggcagcccctccctgaacgcaaacaagtgacatcacatccctgatccctgtcctgtgatctgaagcttcacactccttacagaggagccctcaggaaggggctgtacctgctgctggcctttgtctggttgccacagtagtgaaaatgcctctctgtccttgttcttcccaaattcgtccgcctgtgccctgccatgtgccgcacacgttactttaggatctctcatccttgctatccccaatcgacacaggaggcgctattcctgccccctacccattttacagatctgaaaactggggctcatggaggctaggaagcttgtcggagagcacacagactcctaaccaccctcccatcagattgttggaaggattatgtgagatgggccatccagtgcccaccacggccaggcccctggtgcggagaaactattgtgcccagagggtggggtcacagtagccaggcttattccctagtccccagggcccatcctggtgcctggtccataaatctccagaacaaccaaaggaaggctctgccgggacttgtcagtggctcaccctaaggtcaacgctcaccctctgttacggattgaattgtgtgcctccaaaattcctatctcgaagtcctaacccccagtctcactgaatgtgattgtatttgtagacaaggcctttaaagaggtatttaaggttaaatgaggcaacacaggtgatgcaatctgatccaatctgactgctgcccttataagaagaggggatgaggaaacagacacacaagagggatggccctgtgaggacacagggaggggacaccaccggcaagccccagagagaggcctcaaaaggaaccagccctggcaacaccatcatctctgacctccagcctccaggactgtgggagagtaaacttctgctgtggaagctaaacagtcaacccacacgcagcgtccctgtcgccatttgcacctcctggcagctggtgcaaatcagcccaaagctaagtggccttggcaggtctttgcagccttggtggctaggtgaggaggccttttcttgagaaatcaagaatgtgtctctgaagctgggtccatgagaaatggcgatcagcgttcaccatgtgagaaaggcccagacttgggagagccgagactccccagggctgtggcctggggattatttaaaaagctttaaatgtttttaataaggactttcagctatttaaaaagattgagctagtaccatggattccaacaaccctatcatctggagtaaaacagagaccattctgttttactcagcctagtgacttaaatgttaatctcatttttaaaaaataccttcacagtgacatctaaaataacatttgacccaatacctgggtactgtggagaagtacccaggtattgggtagggggagagcctggaatggaagtctctgctcgtagctcagcctgtgtctaaaccgtgctttcaatggctgaaaacagaacatgcatctgcctgtgaactggcccccctcacacggtcttctctatagggatttcaccccttccctacagtaagaaaagacaactggccacaggtctggtagaatcatggccccagagatgatgccctaatcccgggaacttgtgcatgtgaccttattaggaaagagagtttctgcagatgggattgagtggagggtcttgaaatgaggaaatgatcctgggtcatccaggagggccctaaaccccatcacaagtgtgctgatgagagaaaagcagaggggatctgatacagcagcagaggaggccatgcagccagagaggcagagactggagcaatgtggccacaagccaaggaacacctggggccaccaggagctggaagaagcaaagaataaattctcccctagaatgtcagagggagcatggccctgccaacaccttgactttggacttccagcctccagagctgtgagagaataaatgtctcttgcttggcaccgcccagcctgttatggcagccccaggacaccaatgcagcaccttctgtctagagaattggtgcagccctgcctcattccatagatcccaggggtcagtccattccactccccacagggctttcttttgctttatcatcatattcctgtggcaaagctccacagaagaacatttaaaatgctctgagctcttccaggaagaaaataccccaaatccaaaacttcagcccgcaagttgaaaacttcagggactttgttactaggcagaatgagtttccaagagcatgcatgctttgcaatctacttgcagatcagctctctacagctctctaggatgttttaatattcattctgggataggggcggtgggtgctgcctcttggtgtcagtgtaggcaacctctgcataaccacacttcacatgcaagagagcaagacagcaagacaaaccttcccctgaagctgttccccaggagatgcatgtttctatcctgaaacaaacaactgaagttttccaataagggaaagcaatactattcacttggccttaccgtatatccgttttgaagactcagcccagtgaccctaagaaagtgtttgcatggtgactgcaaacgttctcactggctcaccaatcccatagtttatgcacctaccaaatgtagccagggccaccgagaactgtctggtcctgataaatttcagcagctggaaattctgcatcgtccgggccagcgtggacttcacaagggatccacaggatctggcaggagctgcccgtggtgctgaccccgagaatgctttcaaggcaggtgaaattggcccccaccctactttctggtgtcccttccttcccagtagtttccaatcacttccctaggtacagggacaccacgggggaccactcttgccagagcgagtggccagttagtgcagacccttgagactggatcactgttcacagaagaaagtccagacaggaatgatcagctgcactggccaggtggaaaatgagtcccttcctccctgagggtgtttggatgttaaagccatttgcattttcctctctaggatttggagggaatcagggcgatgctggggctggtgtatgagggtttatgcagacaaggcttacctctcctcacctctcttccttaccctgctcagtaggaaaacacacacaagagctgccctctcattttagcccagagagagctgtgtggccaagagggagcagggcagggatagtgcctgtctgagctgcctcctgcccaggggtcctccctaccccgtccatccctggtcgcctgggctccaggcaggatttggtccccagaaggccccacagcccacctcccgtggcaggccgtgttcgctctgcccccaccatctctgttaatgactcatctttccatgttcatcccttggcccagggagacctgcagctccctaaagcagggatgctgtggactgcagcttcatggaccagcatgtgacatgctcccccctgcggtgccatgtcacagggaggttgaggcatgagtcctgggtgccagagggcagcaccactgggcctgtgttgctgcagggttccccacctcttgctctgaaatggacccccctggatagcctgggcctggctctggggctgggaatgtaggtgaagggccgatgtcagctggcacattagtgccctccagggaagcagccgagcctggtgtctccctccagggtcctggtgcagggcttatgctccacgcagctgtcctggtggcctctagctggctcggcccctagcactctgctctctggtcccagggggggcatcctcagctctcattcactctcttcatctcatttgctgtgggttcctctcaaggccagtccctcaacttgatcagccctgcacagcatggggagaagggtggcctagcccctgaggacagagccccccacaacaccatcccacacagtggaggcccctcccaaagggtagccagcctcgctgccccaagcatgacctttgggctacttccccaaagcacaggctccccagaaagagggcgggcgtgagccctgtaactgcaaggctccaaggccatcctgcggctgcctgaggctggggaggaaggtgccagagagctgctgtccctggctcgaagctgctggccaccgccaaggccagtctcatgccgagaagaagtaaataaactataaagtactgttttcctttagcattcagccaaacagagaatgaccagctatgggaaaacagcaaggggatggatgagggcttctccccttggtgctcagaagcagaattcatacctgggagccataaaaggacggcccctcaacaggtcaacaccagggcagtcctggagggtttctcagaagaagtgtgccagcaagagaggagactagatatatagataggtaatctatactataacaatacatattataatatagatagggataatgtcctaagacgtctctatgggaatgataaggacttagaaaagacagaaaagtagaaaaacggatgtgtcatgataggggccaatcctgtctcttttcattttcttgatgttagaatgcccagaaaataaaacattggaagaaattgaagagattgtcaatttcatgtcctctttcattctaatgatttgggcaaaatgggctgagctattgactaacgaaggaaaagattccctcgcagttgctgggtgactgggagagctgccattggtgcaagtccagtgagttggatgttaaactgcatgtgccttgcttcctgccccaccccccaggctaccgttgcaaggaagagcgtgctggtggttcgccacggggagagagtggatcagatcttcgggaaggcatggctgcagcaatgctccactcctgatggtaggtcacactcaggcgggtctacggacagaaacactgtagatctaaccaatgagatctccttcttaatgaccttacatggcaccagatcccctgaggcaccattctgtagaatgaccatgtgtagactgtatgtgtggaaaacgtgcctgctacatcttcctccaggggtgttccatgtatgcatttgagtgtctgtgttggaacctctccaacctaatcttaactgatgtaatttttggctatgctgcttaacagatggacgtattcttgaacatgcctcttgcacaccccagcttttctcctctgaatgccaggaagtaagaatagtgcttataaatacacatacccacaagccaacctctgtattgatgatcaatgtccacatcaatgctaatctcctaataggaagcctgtagtgtcacaatttctaagccatgacccattacataaattaaggcattgaatgtagtgacaaaatcaattcacagttgctaggttagccgaacccttttgggatccccctccagaagcccagcagacccaagaaagtggtaaatgagtagggaaaaccattggcagatgacaatcacacaccagaaaagattctgagcagataacatcatgatcaagcatatttccaagaactcacagagctaataatatggtcacctctataaaacaagatcaagtaaagatacaagagcttaaagcaacaataagacaataggtggctatcaggatgcattaacaaacatataagaaactttttttcaataaaacagtttttttagctattgaattactgaagctatagattgaactgacacaccttgtccatggtggggagaaccaatacaaaacaatcaacaccaaaaatagttattgaacttcatagaaaaagaaaaaatatttggtcatctggacaaaagatcaagtcacttataagggaaaatattttaaaggcactggaaatccccatctgaaaggaaactcctggtggatcttttcccaaggtagagaggcccttgataaagtgaagaattacatctagtttgtctgaattttgtatattgcagggtttaataaatcacaaggaggtatagccacgtcctcccccaaggtgaccaacctcagggaacacaagggagatttggggggctctactggcctctccccagctcagctcacttttggcccaggcacccacatcctcacagggcccctcacctcaccccatattccacacagactctgctcccatcaggacctgaccttgccccacatccttgtcctctcctgagctctgccctctgcccccagagtgatcacagctgaagtgtcaatgacagcaaaatacctaaatggagtgtcttgacattttagagggggatcacagatgcctttgagaacacaatgaaattgatggactttctctctgattttaaaactgcctttcccaagagctaatgttggcattgaataaacacctctaaaatgcagtgttcaaacaagagtctctgcccatggaaatcccagggagggagtcttcagaaaactcctatatggaaactaaaatgcaggcatgaaaaattgccccccgctgacccctgctgccccccactgccccctgactctgggtttgtgcaaggctgtgggccaggatgaaggggcctggcatattctggggtgcaaagggcagggcctgctatgtatggcagagcaggtctcaggaaggtcagtgtggctgctggaacctcctaataaccaggaggcttggggtccctttggagaatgtgaaggcaaaccagagtgcactggagggagcagtgtgtcgtggtgtcctgtgtgaggataatcagtcatccctgacgtggtgacatgagaccagtgccccgactcgttgaccactccctcttgagtcagactctgggctatgggtgttacctcactgacacctcgcaatcgctactctttccctgttttttactgataagagagatgaagtcatttatttctggctgcacagtgaggagatggtgatgccaggatttgctaccagactgtcagatcttagaactcaaggtcaaactccacgtgaaccctggcaccgggcagcctctggtgggagacagtcccagtgagcccacttccagcctggcttcaagcaattgactaaagaatgcacaacacaggcatctccagctcaagcactctgtcccctgagcaagaaggatacgtttaaagctagggggatggatcattgatgccaacttcagattcttaccgagttacactaaactagtcatagagacactttatcaggttcttcatcaggaaaatgtaagagtgaatcttcatggggcattttgggaggacaaagagggttgcatagttcctggggctgaaacctaagttgtctgcatttgagaaaatgttgtgtgcacagctgagcagcactttcttctcaaattgaagccacgttgcagagaatgttcagaaacaacacagttgacaataatttcaataataacattgctgttagagtgggtcttggtcttgggagttttgtggaacaaatctgtactaacttgatgaaactgaacgtctgatgcttatttatacttcagggaaatactacaggccagacctgaatttcccctgcagtctgccaagacggagtcgtgggatcaaagactttgaaaacgatcccccattatcatcgtgtggcattttccagtccagaattgcaggtatgtttgaggactgtctagtaggaaaggtaacaataacagcaacactgattatggctagcaggcatccagcctgagccctagctacacaccctttgatacagtgttagctttgtctccagtctgctgaggaggctggggcacagagaggttaagcaacttgcccaaggtcacacagcaagaaagtggcaatgtagaggtttgatctaggaatggatgattcaggaagttggcaggaatgaaagaaaggcatggaaagaacaagagaggggaggaaaaatcaacaaccaaggagctccaaggagctcacttttcaaatggaaaaccacatcctctcattcgttggttttatttcaaaatctgtcactttgggcttttgtttcatgtctggcggttctgcttctacgtgactgagtttatgtaaacagaagagaccattgagttcatcgagtcttcatttcctaaattcagaaaatggaatccagagaagcaagttacaccaatggttaactgcagagacccccacggcccactcgcccagggccccactcagaggtgtgctcagaaatgtttacccacctgctccaggcagggtgggaagtccgagttatagagttatagagttagttatagagttatagagtcatggagttatagagttagttatagagttagaatcatagagttatagagtcatagagttatagagttagagttatggagttatagagttatagagttgttatagagttatagaattatagagttagttatagagttatagagtcatagatttatagagttatagagttagttatagagttatagagtcatagatttatagagttatagagttagttatagagttatagagtcatagatttatagagttatagagttagttatagagttatagagtcatagagttgtagagttatagagttatagagttatggagccatagagttatagagtcatagagttatagagttagttatagagttatagagtcatagaattatagagttagttatagagttatagagtcatagagttatagagttatagagtcataaaattatagagttagagttacagagtcatagatttatagagttaattatagagttagagtcatagagttatagagttatagagtcatagtgttacagagttatagagttaattatagagttatagagctatagagtcatagagttatagagttagttatagagttatagagctatagagtcatagagttatagaattagagttatagagttataaagtcatagagtcatagagttatagagttagttatagagctatagagttagagtcatagagttatagcacttgctgagtgcagtggtgagaatactgcactccccgacaactgattccagactcccagtgtgagctcccaggacactgagtcgggaggagatggtggtcccaggcctctgtccctggcttgcaggtgacattttctgtcttcctcttctcttctctgcatgtctctgtgcacagatttccccttttagaagggcactgtcacactggattagagcccaccctaatttaattgattgaggtgcatacccttattttaacttatcactctgtaaaaatcctgtttccaaatgagtcacattctaaggcaccaagggtgaggactctaacatgtttttcaagggaggggatacagttcaacccagaagagcctccactgaaacctcgctcatcagctttcaggctgtgcaatttttgtgctgtagggactcccatatttccctgagagcagggcttccagtatcacagggggaaaggcagagtacaggcttttccttccacgagcttcagtgggtcttgagttttctcaaacgaccacaaatgtgaagccccgcccatttctgagctcacagtggtgcagatccaaagcccaggcccacgaggctgcttctctgctgaaggtcttaaagcctgaagtcaaggtctctgctgggctgagttttcattgggagctcaagtctccttccagactcattctgctgttggccaaattcagatccttgcagtgggaggactgaggtctgttccttgctggctgttagctgggggctgctcccagccctagtagaggctgcccacattccttgccatgtggtcccctccatctttgcagccagcaatggagaatgttttgctgaatccttctcacttcacacttctctgacttttttccatgactggctggagataatcactgcttttaatgggctcaccaacttgtcagccccaccttggatcccttcccttctgccataggatgtaattgtcccaggagcaacagatcattctggtcatgggttccacccatacttggaggctgtgcagggtgtgtcacaccagggggtggaaacccggggccctttgaggaccctgcctaccacagggagcacatggctcatctgccatcagaggctagaattatgaaggggcattttctgcctttttcactattttccaggggacgcgctactggacagtggtatcagaatcagctctgtgtttgcctccccagccctccgctgtgtgcagacggccaaactcatcctggaaggtcagtgagaacctcggtgagcctctcctactgccttgaccttggggctattctccaaggggagtgggaagggagtggaggtggaattggatgactggcaatgaatgcccacaccaaagtcatcaggcaagtacgagccagccctccaaggatgctggcaggcatgctgggtccgtgagcgtgtctggaataccaggaccgtcagaccagtaggggctggtgtagctaaatgccagggcctgtcctcataccgtttctctttggcctccgtcagctaggcatttttaaaatacacctggaaagcggcattcgaaaaccttgagagctgggaactgctacggttccttgtaagtctgaattgcatgacccttcccagggcaatgcactgggccagtggagctgtccagcgtcctcaagggctgatgtgtgtcaggaagtcctgggcagacccttctgcagctcccatctacgggaagaagaaagttcctgcccataggagagcagcttgttccagaggcctgggctctgccttcagcctgaaccctgtcctgctcctctttgtctgggaagagggataagatctcggtccccaggcagggactggccgtggccaggagcatgggtgacatgcgagagagcatgtcgcctccatggtgacaagggagagggcagagcacacagacacagatgcagcaggagggcaaatgtgggggacagggcttgcctcgactttctcagagacctaggaagtaaggccaccagcggaaagtgggggcagggactgtgggaagtttggggtgcgccgaaggaatgaatggctgtcaggcagaggggcccaggacatgggctgggagatgcagagtgaccgctgggcagcactcagagcccacccacagttcatgagcatgagtttaaatggagatgcatcagccgggctagggggtctcttccagcttagaccgggagtaggtggagagtgggatgcaggtaagggcagggttgagctgtgagtacggtggagccagaggggacaggaagacttgagggcatagtgagggggtgaccgtgcccatggactttcagctgggtcagcgaggaggccgagcacgggggaggtgagtgcaggagaaaggaggtgatctgagtgaggctcaaggtccacgagggggctgcttggagacagcagagtttggcactgcaccatggcggggctgcagtggctagaatgacaagtcccaggtggaaggaatggatgctcaaggcagggaggaagccacgtcctgcaggaggtgggcaggaatggaggggccatggaggagccatcccgcagatggtggtcttgctgggacttgcacatggggccacatcagagccggggccacgaggggccgggaccttcacaggaggagccgttgggacagcagtggattcaatgcacacatgtgcattgccggttcccatgtcctcagatccccttcgccccgtcagagacgctccctcagagcaccttcaaatccaggtgcccaggaagccccagccaggagcggacctggttccaccccggagcctctcaggctcatcattcctgtcctgtgctctcatgaactttccatcccatagtccagtcctagtttcacgaggcacagaaatccattgtatcagcatggagcatccacgatccaccttccacacacttaaaaatgtcaagacactttctgcccacctcagtcttgcagcttcatcctttcatttcccacccaactgtggcacaggaccccacccctctgcacggcatctcgggtcacaagacagaaatgcagacttacttcactttgccttggaggttcccatgttgattgcatcacggcacctctgggctctcaatgagccagatgaagatcaaagaacaatatcagcttctttgaccaaaccacgaaaggactcgcgaatccccaaaggcctgacggcagtgtagccggaggccagaggcagctccacccgagggcaagcaaggcttccacaatccttgtctctcctcacaacgctggcatgcacatacacagcacacacatccacacacaccacacacacaccacacgccacacacacactacacacacccacacacacaccatgcacacccacacaccacacacacccacacacaccacacacacccacacacactacacatacacaccacacaccacacacacaccacacaccacacacaccacctacacccacacacacccacacacaacacacaacacacacaccacacacataacatacaacacgctgaacacacataccacacacacaccacacacctcacacacaccacacacatacacacaccacacacacgacacacaccacacatccacacacacaccacaccccacacacacccacacaccacacacacaacacacacccacacacacaccacacacaccacatacaccccttggggtttcacttgggggctgagtcacagaccgcagaggaggaggctgtgatctttgagagccatgaccccagcccaggtgacagggtcccgcgatgtccgcctctccctgttcccatgctcacagcagcaggtccagccttcgtgttttcaggaaggcctgagaaacaggacgtggcctttccagctctgcgctttgggagggacgagggtggcaagatcagaaatgtgaaggggcagggtctccgagtatctggggacccttcagtgtgagggtggctcttaataactatgatggaataaagcaaaattgatatatagcaatttcatccctggttgtttaggatcaatgtatttataattaaccaaacacctataatcataagatgtgaaccaagcaagaaatgcacacaaatatatgacaagaggggaacaggcctgtgcctcagtttcccctcttctcccctgtcgctggtctttgcaccccaccactcaatgagcgcattttgttggaaaccacctaagatgctgctgttcttccactaagtttcagaatcactttggtttctgccactggctggccgcccactagcaggccgtgcgagagtccccaggtcgcctgtgcctgccaggccagcaacaacagtctcctctcactggggcttttactgcctcagcctgcaagtttcccttctagtgaaaaccttcgtctttctttccctacccaacctctctcaccacgataacaacaacgaataaaaaaggaatctcttggccagcctttgtaataaaagaatacgactgactgaaaacacttcataattttatcttttttttgtcattgttcgtggttcctcattaacacacttattcccatttttggtggatttttttacttctattatttgggtcacttgcatataaaaagctttcaaaaatgtcttttgccagcaataatgtcaaaatctttaatgtgatctctcagtgacctttaagtgcagatgatgatgatggtgatgatgatggtgatgatgcctgtttaaagggcatgggtttataaatcctctgttaattcagaaaaacaaggacacccagtcttctttacaaggcctcagacatgatcaacctgcttatcagatggtgtctgagatgctaaggtgctcaactttgtttaaattcaatgtcagagaatgtccacatgaaccatttcacagccaagtccacaaaacactggcctgcaagaggtcttcaaaggaaagagacccatggccacacctgtctgggaagctctcacactgttccttcatcttatttgttcacaatggaaatgagctcttcacaggcttgggggagatttcgggggcctggtttatcagggaggacttgggggcccagttgatgggggaggactcggggacctggttgatggaggaggacttgggggcctggttgatgaaggaggactcgggggcctggttgatgggggaggactcaggggcctggttgatggaggaggactcgggggcctggttggatgggggaggactcgggagcctggttgatgggggaggactcgggggcctggttgatgggggaggacttggaggtctggttgatgaaggaggacttgggggcctggttgattggggagaacttgggggcctgattaacttgctttaactctcttttctaagcatgcttgatgaaagagctccttccatggacctaaaacacatttgaggaactgattttatgtccagcatttgagttcaatgacatcttctccattcccagtgaaaacattcaggtctttttttccactcaaaaagagatggccttactttatggctcttcctttaatcaaaatataaaatgcctgggaaatgtgagttgcagggagtcagaatattccagaagatggctccttccattcttcacctcttgccccgtctgtgtaagtgtttatcaggaaagtgcctcatgaggccaacattcttcatgatgggtcacatcttgtccattgatcattggatctgccatgttggaggatgcagccggtgggctggtttcacggtggagctgtgctgggtgatcaggtgagccccagcctaagcctgctgcctgggacactcaccagctcctggaagactctggcccttcctggcacacagggggccatcactcctctgataccttcccactgctcgtcagttttgacttcagaaatagcacagctatgcctaatcacagaacggtatttgccaagaagaaaatcacactgtttaaaaggcatgatttagacgtgtgtgtgacggtctgagatctaaaaggagacttatttatgcaaagtcagggtggatgttgaggatgataaacacttgtattctgttgaatccagaactcaaactggagaaaaaaatcaagatacgagtggaacctggaatctttgaatggacaaaatgggaagctggcaaaaccaccccaaccctcatgagcctggaagagctgaaagaggcaaatttcaacattgacactgattacaggtatgctgttctaaagttctctgccactggggcttttccagttattgttaaagaaaaatttcatgacactgttaaaatggtaagaaagactttattcaagagggaccactgcagtggggttttgcagcaggggagagaggtggggctcaactcctaatacaaggaaaagaggggagttatagccacagagcagggtgggggtcagtggatggaaaattcctgagaaggtgggtcattcttgctaaactgacctaaatggagactcttgctgaaggcaggccaaggtgatcagacatcacctggggggtggtagaggataaggaacttgatcagatgtcgaaggtaggaggttcttgctaaactcactctgcaagaacagacacagaagcccaagggtcaagacctcattgagaagaaggttcagaggagctggactggagtttagtcaaggagagagtctttgtcattctccacccatgtctgactctgccatcacagagccctcctggtgttgagtaagaatgtgtgctggagattgactgtcagtgctttgccagttttcagcacaaaactggagcctgcctgttgaccatgagcctgccttgaggcagagccatcctggaagaacgttctccttccccagctaactgcagctgagccttcctaatccctacgaaagtgccagggcagcagcctctccttctcatccttccaggcccgcgtttcccctgtccgccctcatgccggccgagagctaccaggagtacatggacaggtgcacggcgagcatggtgcaaatcgtcaacacctgtccacaggacagtaagtgcctcaccatcctcagtatgaacagcccctggggcttggggaattatctctgagatggaaattggccaattttctgaacctatgaatgcccctacttctcctgcctgcccccgcccccattctccagcaacaaagttttcatcactgctgctgctgctgcagtaaccgggtgcacagacacacactcccctgccgcccaggccctgggaccccccatcctgggactgagtgctgatgggaggggaatgatctctgagatggaaattggccgattttctgaacctatgaatgcccccacttcccctgcccgccccccaccattctccagcaacaaagttttcatcactgctgctgctggtgcagtaaccgggtgcacagacacacactcccctgccgcccaggccctggaaccccccatcctgggactgaatgctgatgggacccaggccagcagggtcacacaatccacccatgtccaagggatttgagtcagcttcctgggaaacaaaagagacagagagagaaagaacaaccaacttccaggtggcgcccccttccctgacccatcacacgggtctcctaaccctcccgtgttgctttgtcctggatgaagcatgcacagaagcgctgacttcccacgccttcccctgagctggcagggacaagcgtgtctcctgagggagacccactcggcctgtggtctccaggtgttcttatctaaagcaggagtcgtagcaggctcgtgtgacaaaataaccggctgacctttctaaagtgaatcaggtctggcttgggcgtcagccaccgctacatcccagtctgtggctgacggggcccaggcagccagcgaccacagggggtggctcagctcacttcctaggcctccctgaggctggtgggcagctgctgcgtgcagaggaatccatgagcgagggtgggacgcaggcatcactgagcggttaccagccacactacttctagcccgggggtctcgccaggcttcggggcactctgagatagctctgccccccaccactttggggaccccagtctaataaaaggtgctctctggggctgctttgacctggaggtgttcttgttttccacagcgggtgtcatcctaattgtgagtcacggctccactctggactcctgcacgcggccactgctcgggctgccgccccgggaatgtggggattttgcccaactcgtgagaaaggtacgcgcccactcttggctctttgggccacaaaatcaagcatcccgaagacacaggtttatctcatccacttctcggaatgaaaacaagtgtccggctgacccagggccaccaggatccacgtgcccccggagactgtgcccaccggctcttatgcgaagggtgacttcgggctggggctggtggataggtcagtcaacctcatcatcattggccacttgccaactttttaccagtcagctcatgccatgaccccttgcagctctcgtagaaaaacagacggtccaggaaggagtaagcagtttagatgaggagggaagaaacgactgtgggactcgattctggcctcttctggggacctggggcagggcggctgatggatgaaaaggagccccttgatcctcttgcccttggagtcacccagcatggaagaagcttgagctggttgtagctgccagagtgctcaggctctggcaagggccttgtgaatgacaaacagaggataacgcacacgtgacatcttggacaaccttgattatcactcagcaaagccagagggtgatgtccagtccatgggtgaattgaggcaggcaaactcaggagtgcagatcccaccccagtcccagcccttccctgcagatctactcaaggctggactcaccacagtcctgacctttttatgaaattcatcagtccactggtcagtgcccaggcagcacgtgcagcatagacaatgcctgtcatcggaggtgcttgaggccctgacctggtttcttcacatagcactgccacaggaccacactggccacagcttgtttgccataagttgtgggcagcagtgggggttgctgagtccccccaagaggtcaggggcttcagaggagcccaactcccgggcccagcccagtgacaccagccaggtgcctgcaggagggcttagctctctagctacgcctgcctcagcagccagatgagaggttacgcacatgaagagcatgcctgccgtgggtcattgtcactcagcaattaggcatcagacacccgaatctccctttcttgctccattttcctctgcacctgagtagaaacatgcttcccctgcaaaatgtctccagggtggtgtgtcccaattatgatccagacatttccgagcgccctggattcttgagccaccaggtgagcattgtccaaatagggcagctcaacccccctgggccacactggtagaggtctgcatggattttcctggggactgtccggggcagccccggcaccacctgctcccaaaatgttgctcttgcttctgcaaatgggtctcccacacatgcgctctgatgcattcctcctgtccctgccccgcttcccacagtcccatatacacataccaagcctccagccccaggcgctcctgggggcccacgtaaccaagggtggcagcactgcacacaccagctgctgacagttcctcaaacccatgagcctttgtggccaaagctccacccactccttggacccttcacccccttccatagatgccaatcttgaacttccaaactcctggactttcttatgctggtcacgtggcgttcaccctgcccctaccccaaaataagctggacttgctcatgcatatcagaaaatacaaagggggggctctaccaaatgatgggcccccaaatcagggcagctggaaagggagcactcaggaccctccccgaccagcccatcaccgcccctcgcccacagcctctgcaagcgtgaggaaagaatcaccctagggtcaacaccagcctcactcagacccccctgccagttggcatttttgtaaatttcatctgcctgaggaatttctagacattagaaagaggaaggaaagaaagaaaagaaaagacaaaaacaaaaaaggcttcaccacaaagctctgttctcacacatccatttcacagatgaagggatggaggtctaaaggttcactttgtgcttttcttttgggtctgaaaactcaatgtctgtgtctttttgtgatgctgaatatgagaatatgagtcactccttaagtggtggatggcaatctccacctcagcctgcagacctttgtggtgggggctgttctactcattgtaggatgtaccaccttgtaggacctctacctgctaggtgtcggcagcacctccatcctcagttgtgacaatcagaaatgtctccggaattacccagtgtcccctggctaggggacatcccccacggggcaccgccagggcagatgttggtgccattcaatggtggcagtgccagcctgggcagtcgcagaccctccaaagtagaggtgtgcctgacagttggctttggagctagtctgaaattgatggacttgctataagatattaacaagtgatttaaaactctgttccagatcccttccctgggcatgtgcttctgtgaagaaaataaagaggaaggaaaatgggagttggtgaacccaccggtgaagaccctgacccacggggcgaacgcagcatttaactggaggaactggatctcaggcaactgagagccacggtgatgttgtcataacctcagagtggagaggcagaaaccatgtgcagaggctgggagatgctgctgtttccagaggcgtcttagtctcacccaatgtgatttgtagaagcacgagacgcacttttatatcccggaatatttccctccggctttcgcctttgtaactcccatctgtggacccatcgtccaccagcccagctgcggggagcacagggcaggtggctgggtgaggatgccgccctgcagcatgtacaccgagtgtctgcagctggggacacaactgcccgggactctaacttccaggaattaaagactcaccacacacgaaggatctaaccacttcattttccatggtctaatcattaaattcccaatcgttttttctttttctgggtccatcactctttagccatatccacatgggctaaaacaggtgtaatagtcaataaaatggtcccagaaaaccatcgaccaggtcaaaactgggttgctgctccgtgctgtcaacattcatgttactatgtctctgtggttgctgtaaccaatgaccacaaacctgggggtcatggaaagaacacaaactttacacacacacacacacacacacacacacaggcacatacacacatgcacatatgcatacaaagacaggcacacacgagcatgcacacacacaaacacgtgcacatacacatgcgcacacacatgcacacgcacatgcacacacacgcaggtacacaagcatgcaaacacacatacacatacaaacgcgtgcatgcatacatgcacacatgagcacacaaacacatgcacacacttgcacacatgcacacaaaggcatacacatgcaatgcacacacacaaacacacatgcacacacaggcacacacacgctcacatgcacacacacacacgctgactctcctacggttctggaggttggcattttctcagcaggctatgtttcttctggagcctccaggggaggatccttgccttttctcacttttagaggccacctgcatcctccctcctcaagtacagcggcgtagcagcctccaagctctctcagtctctgccttcacagccacatcgccttctgcttctgactctcctgcctccctcctacaagggcccttgtgttgacactgggcccacccaataacccaggatcaattctcatctcaagagccttaaccacacatgcaaagtcccttttgccacataaagttgcatattcccaggtcccggggattaggacatgaacatctttgggggttatcctgtagcctgccataacataccccaatccttccaagcacagcggagctgcccgtacagggcctcggacatagggatttgagacactccccttgcaggccttttttggcttctcctattcttgtttctgatcacgtagaggagagaagaggactttgccagtgggagaagtaggctcccccgatttaatggggccccaaaagaagggccacgagcaaagtggagtctgtccatgatggtgatgctgaggaagctggtccagcaggggatggggtctccccagtggggagtctcatgccccagcccacaggtcacacctgctcccacagcccacacatgtggtgcctcatgctgcaggcagagatcccagcacggtgtagtgacagtccatcggtctttcatctcttctagccccctgatccagtgcaggtgttatttcatgattgcagtttggggctgtggtggtggctctgtgagtgccttttatagtgtgaatgcagagacagggcaggaaggacccatgctgcaccctcagcctcccctgtgagcacccaggcaagtggagggcagaacacaaagggagctcttgtagaaataaagatggtgaacaccccgggctgtgacaaaaacggcccacattgtgtagaatgcacaggaggccagacccaataaaagtttccttgctgttttagtcaatcaaacacgacctcctgagaaaaagacgcatctgtctgtcccttgttttatttcactaatgatgtagtttttctgtgtccaaacataaagaagtttgaagttgacacagccacagagagcagagcatgcaccccactcacaggcctgcttcgagtccaggccataccgaaatgacgtcttcagggagattgttctagacgcatcccagcagataccgactagagaagagatggattcactgggatgtaggtggctgggcagtacgtcctgcaacaaatacaccccaccgctgggcacctgggtggttgttctttctcctcggcaagtgtgtggttgggtccaagtccctcctggataccacagtgccacgctcgctaatcatgatgatgaattaaagtgctgcaagtcaaggtatggcattgaaatcacagtcacgtgttcaggtggtctgtaatgaatctctggattcaccttctcaggggtgaagcttccaggtcctccaccctgggcaaagccagacacaggtaattcccctctcatcctgctgggctgctcacaggttttgcaaggagaatgagatgggtttgaaactcagatctccagatctccagatctagtgtgcaagaaatagcattttctcgatattctatgcttctggttctgtcagaccctcattccacccccaaggcagaggaccccagttcagtggttctgttcctccagaaggaaccattcgctgtatggactgagccttgcggacagagctgggctggaaaagggcagagacggaaatgcctggtgggattatcatgattgggtgtaaactgtctactctatgaaccaataggaaatcccaaaaaaagaaaacaaaagacactcttttttccttcctctccctgggtgggtcgctttggtgtttgtgagccaagtctgacccctgctgacaccgtctggaagtggacgtcctgtcaccaacgccatcccaacccatgccccacccacattctcttgttgacttcctcactgtgtgcttgaaaaaaaaaacaagcctgggccaggcatggtgactcatgcctgtaatcctggcactttgggaggccaaggcgggcagatcacgaggccaggagatcgacaccaccctggccaacatggtgaaaccccgtctctactacaatacaaaaacgtagccaggcgtggtggcgcatacctgtagttccagctactcaggaggctgaggcaggggaatcgcttgaaccagggaggcggaggttggagcaagccgagatcgcgccactgcactccagcctggcgacagagcaagactccgtctcaaaaaaaaaaaaaaagaaaaagaaaaaaacaagcctgaaagggaattctaccagcgttccctgaggctgagcggatgacaatgttgttttgcagcttaatgttcccctccgagacctggttctttggaaagatggaaagtggtgagaagggggcggagccggcctcaagctgggcagccaagggggccaaaggcctaagccagtgcctgtctccaggctgcagcctgtggtgctgaagagcttaaggacaggcctgggaccaccaagccaagcactggccctggcaaacactgctgcactcgtctaagaagaaagagctatcataaccgtccaccaaagtacatcttattttagaaccaaatttgagacttttttaaacgtgattcatattggtgcatattatgggctgagttgaatgctccctcccccacccaaattcaaccagccaacaattctgcaaggatcagaagtcggaagaaaggaaaatggcagcatcgaatgcacagccacaaatcccaagaaggccccaggagcctgggagtggctgcggaggaatttagggctggatggcccacaggacatggtgagaaccactaccatgggctgaattgtgtccccctgaaaagctatgttggagactgatatggtttggttctgtgtccccacccaaatctcatgttgaattgtaatccccagtgttgggggagggaccctaaccctaaccctataaacatggtattttttatatcctcatatcctcataccatatttaaacctatggtaagcacctgctcttccacaggaacagcagataactggaaatcttagaggccttcccagaactggggttcatcagaacatgggtggctcctgacccatcactcccagacccagagcttatgcaccataggggagaggtggttcagaagggatgtgcaggacaactaaagtacagtaacatcgaggtcgcttgacctgagggcaggacctatggtaagtacctgcttttatgtaggtatatacagtaaagggagcagtcatagcagtgggggaaggaaggtgattaaataaatgacactgggacaactggatcacatttggggaaaagaaggttggaatcactcctcattcctcataccaaaaaaaaacatcaaagatttaaatatttaaaaaaaaagaaatcatgggccgggcgcagtggctcacgcctataatcccagcacttgggaggccaaggcaggtggatcacttgaggtcaggagttcgagaccagcctggccaatgtggtgaaaccctatctctactaaaaatacaaaaattagccaggcatggtggcaggcacctgtaatcccagctactcaggaggctgaggcaggagaatcacttgaacctgggaggcggaggttgcagtgggccgagatcacaccactgcactccagtctgggcggcagagtgagactccatctcaaaataaataaataaataaaaataaaaactatcatagagttaaaaagtaaaaggtaagctgggaaagctctgtgcttctcatgccgcccagttccagcccaccccctccaggaagccctcctggccgccagcccaccttgctgcccctgaatcccagctcaggcgtcctctgcacaattcatgtcagtcgtgtctgccttgtcctgttgttgcggtctctcatcgtcttgtctgtcactccttcccaggggttgcaatagtgaccgtgtgccgggcttccaggcagccccaagtccagtgggaccagtgacccccctgcaaagcttctctgctcctataggccaggatttcccagccttggcactattgacatttggggccagatacatctttgtcagaggacgccctgtgcattgtgggatgtccagcagcatccctggccctcccctactgaagcagcagtacgtccctcaccccagcccaccagttgtgataaacaaagatgtctccacatgctgccaaatgtccctgggggagcaggatcatccccagctgagaagtaccgatgtattcccttcacaggtctgcatggaaccctggcctcagggctcccaccagggcactcaggcatagcgcgaatgggcacaggtgtgttaggagtctggagtcgcacatgtgcactcctgctgagcagacagacctttatggagacgaaggttggaaaggaatcggtgcacatctcgagctgaacacttgtgtgatgctgctacggaggaagtccgagcagaactggaactttgcggacactgcccctggacgtaggtgtgggcctgggcagggggagccacgcggaggtgcgaccaagtcctgcacggacctcactgcctccgtgtgatgtggtggctgtgctgtgagggcagctgagccctgtgtccagcctcgtagtcctcttggctggccccacactcaaattctagaacatttaagtgcagtgcaccgtggacaccacgaggctccacactgttggactccagtcctttagcccagctgggagcagccctgacacaataattcttcaacagaggcttctccttaaccctgtctcatgcttctcctctcccctcatccccaaggccgacagatggtggctgcacacacattcaggagattgcaggaaataatttccaacagcaaatgagacattaattattcaatgcagataaacatcaacaacagcgcttcatccaaaggaattccactgggatccaggggctctgagttggagcccagttcggtcctctactcatggtgacctcagacacagtctctgtgtctcgggctcactgctgtaaaatcatgcggcctgtcgatgggtccatgtcacttgcagcatcttagtcctcattctggaggacacgtgccctcttagcagtgagccctggaggggctgactcgcagtgtctgctgtgttttccagtttccatgatgtaaatgcaccagggctgattctgggctgccagtgttttgacaattgatttgcagactgcgtgaaaatttaaaactcagctctcttgagctgatatgagccaccccagcccacccctgcagcaggcacgaacgttagtttgcagggagaggccagctgagctgctgcacagacctgctgggatcatcacagctgtgcgcttcaggccagtgcctcttcctgtaaaaggaaacaacattctctctacagaggatggaaggacagaagggctgaggcccatgtgcaggcggggtcaggagagagaggaggccaagtccctgggtctaggaaagacgggtgggtggagccaggccaggggcactaagtggaacgctgtctgctccctgcggagcactggacagacttttggttccagggattcatcccgagctgtgtctcttccgggatccttggccagcagcgactctggcacctggagcacacctgaagagagcccccaagctctcgcctctctccagccctgctatccaaccagatgttcccactcctgctcctccctgcctcatcgcctcagccgcccggggtgagccacctactctcccaaggcaagacacagccggcatgcttcacacactcaccttgaagttcagggttggaaggtcagtccatccagctgaagttcactgctagagatgtaattgaatcagccctggcaggagcatttggaccacaggaataggtaaacacggctgcgagtcagcccctccagggctcactgctaagagggcacatcgtgtcctccagaatgaggactaagatgctgcaagtgacgtggacccatcgacaggccacatgattttacaacggtgggcccgaggcacagagactctgtccgaggtcaccatgagtagaggacggaactgagctttaactcagatcccagtggaattccttcggatgaagcgctgctgttgtttatcagcattgaataactaatgtctcatttgctgttggaaattatttcctgcaatctcctgaatgtgtgtgcagccgctgtctgccggcgcgtggggggttcttcatgaaaagtgagaggggtccagctgtgtgaaaggcctttgcaaattgccacagcaaactcccagaattatgatgtacttcttcctgtgtggttccaagtaaatgccacttccggctgtccagtaccattttttcctaggacttaaggccacaaaaatggattaagaaacacacatgtatacatgcaatcttcctggtgaagtcttcaaacaaagttctccaagaagtcattaaaaaattaatcatctggaaatgtcatgtttctccttctctctccaaaatgtatttctttcaaccattaactcattctctttcattgtgtcccatagtgagacaaaactgtgttaggacaataaaccaagcaattttccaaagaagctatagcacgaaagcaacgtaaatcccgaaggagaaacgcctgcgaatgagctcaccgaaggcacactctcctcccaggagcctccccggagaggcagcccgtttatttgagttagtgattttggaagacacactgcactttctttgcctccagctatccttgagccattttgttctccttgcgaggtactgatagcacttattatctagaaaatataaccagactttgaggagaggcaaggggccctataaattatttatttttttgcttctcaaactctggaccgaggaccaggattacaggcattgcctggaagcttgttacaaatgcagggcctcaggcacccccgtctccgtgtcagcagctgtgtcttagcaggatccccagggcattgcctcacagtcagggtggtgcaaaagtcccgcctggcatcctggtgagtggaccaggagggggcaggtgaaggcgatattattggtccttcgactccagacaagaacttgcagcttagcctgaggaaagaaattagcccatatgatgaaacacaatctgatgacgtaaggatttttgtacttatgcccacatgtttagacatggcagcccgcatcctcttaaacctgaactttaacataccgtgacttagagccacaaacaacaaaacagagggcaggaaccagagttctccagagaaacagccagtgggaaacaggacccacatccatacggatacaaacatacagatacaggctgggagagggaaggagagaggggcattggctcacactcttacagaagctgagaagccccacgatctgcgggagctgttggcctcccgtctggaggccagtaggctcgagacccagagagaatcgatgttttcattcaagtccaatggcaggaaaaagccaatgcctcagttcaaaggccgtcagacatgaggagtttcctcttagccttttgttccattcagaccttcaactgattggatgaggcccacccaccctggggagggccgtttgcttgacagtctcctgattcgaatgttcgtctcattcagaaacctcctcacacacccccagagtgacactgggtcaaaacgtctttgcaccctgcagtccagtcaaattcacatgtgcagttgagcttcacattgggcatttctgccctggtaatgtcctcccattaccaaaaacctggtatttgtccttcttttcagtgggtttcacagcccagcagcagctggccctcttgtagagcagcagttcccagccttttggcaccagggacaagtgtcgtggaagaaaatttttccacaaaccagggtggggtgggggtggggaatggttttgagatgattcaagtgcaattacatttattgtgcacactttatttctattatcacgttgtaatatataataaaataattatacaactcaccataatgtagaatcagtgggagccctgagcttgttttcctgcaactagacagtcccatctgggggtgatgggagacagtgacagataatcaagcattagattctcataaggagctcacaacccagatccctcacatgcacagttcacagtagcgttcacagtcctatgagactaatgccaccactcatctgacaggaagcggagctcaggcagtaatgagagcaatggggagtggctgtagatacagacgaagcttcacttactcatccacccactgctcatctcctgttgtgcagcctggttcccaacaggggttggaggcctctgttacagaggaccctctcctgaccgccaatgagacccatgagctcaccgtcttgtctgcccttccacagcccacgctccctcctcagcccacgccccctcctcagcccacactccctcctcaggctcagcactgggaagagttcgtccttcctcacctcagccctcaagtgtggagtccggcgcctcagtcatccactcaacagacatttatgagggaatgtttgggtgccattaacactgctgggaaagcagcagtggatcagatacaagctcactctcaaagagcttatatttcagtggaaggtggtgagcaatggactaataagccagtgaacacgtaacacctcctctgccaatacgtgaggtgaagagaagacagcagagagggggacagaggcggaatacaaatgttatgttagcagtgaacaatcagtaagtaaaataaaaacatcacttatagtagcataaagaaaccagaagcaaaagaggatgtactgcatgattcaatttatatacaactatttagagacaaatccaatctgtggtgacagaaagcagcacatcagacgcttaatgctgggagtaggggaatggattgcaaatgggcacgaagatattttcaggctgacgggaatctgtgtgctgattgtagggtggtatattagtctgttctcacgctgctaataaagacatacctgagactggacaatttataaaggaaagaggtttaatggactcacagttccacatggctggggaggccttataattatggcagaagacgaaaggcacatcatacatggcagcaggcaagacagagaatgagagccaagcgaaagcagaagccccttataaaaatcatcagatcttgcaagcctcattcactaccacgagaacagtatggggaaaactgcccccacaattcacttatctcccaccaggtccctccccaacatgtgggaattatgggagctacaattcaagatgagatttgggtggggacacagccaaaccatattaggtggtcacatggttgcctacatttgtccaaactcattgaactgttcacttaaaatggatgttttactgtctacaaaatatacttcaagaaagctgatataacatgtttttaattttttaattagattgggatattaggctactggtaccaatgcccaagggcttcccgtgggccccacggagggccagctcttgtcacacccaccgggtgaggcacagagaggccagtgttccctgaacccatagccaatggcaactgatagagcactttacatatatctttatgatggttagggtatttggatgattctgttaatttctgagttgtctacattttggggcgttggttgaaagcgacactcttaccatgttcgcacaacacaggagccagatttcgaagtggcacaggcagtctagggttgtaattacatgagctcaggttggttcctccgtcccttagccaccaacccccttccagtccctcttccacatacctctcttcattctgcgctgtattattattattattattattattattattattaaagatggagtctcactctgttgcccaggctggagtgcagtggcatgatctccgcttactgcaagctccgcctcccaggttcacaccattctcctgcctcagcctcccgagtagctgggactacaggcacccaccaccacacccggctaattttttgtatttttagtagagacggggtttcaccatgttagccaggatggtctcaatctcctgacctcctgatccacccaacttggcctcccaaagtgctgggattacaggcatgagccaccacacctggctgctgtattattatttactcacatacatatcttgccatgacgttgcagggatgcaacatgagtttactactccatgctccttccacatagccacccccactcctgcccaagcctgactccatacgcagtgtttgatcatagtccccattccataaactgtggtcatattaaaagtgaataaaataatccccagagtttagttgtgtatcattctatttcaatagttgtttttattgtggtggtaaaactaatataacctagttataacactctttatgatattaatatagcctctaatctgtcaaagtttctaattttgtgggcactcctttttattgtatttgcaaaaagcagtaaaatccgggaatgcagtgtactcttgttcccggaccaggctgagtgtcgggcagctatttcttgtggcccaataatgagatgcagatgaactggggaggaggagagtttttatttctgaaaccagttacagggagaaggcctggaaattatcactagaccaactcaaaattacaaagttttccagagcttgtataccttctaagctctatgtctacatgtaagtgtgcattcatctgaagacttaagtgattaacttattttaatctgtaactaatgtctgagtcctgaagaccttcctctgcagcctcagtaaatttacttatctaaatgagtccaggtgctggggtgattacccttatcttgacttctgctaaatcttggaggtctggggagttccttcagacttccaataaacttgtttgtggaagcctggggagttttttaaccccagtaaaacttgtttaatcctaaatgggtcctgttaagaattctttcattattttgtcatgcgttaaggcccaggaaaggcctgggcaaaacccttggtgggcttttgttacatttcagcctttgtataggggcactggcttttcttagcttttaatatttaacttaactactcggtcagtactgaagcagttgttatggaggcctgcgttagtgaaacctggccttccacactctgttttacatactcttacaaatccaagttctagaaaattgttttcaaataaatttatcttacgcagcagctgtgttctggattgcaagtggataaaatgaaactgagtggatttaaccatgcagcaccaataactaccaggtaggggcttcccacgtggaggtgtcaaacgaagttcgttccctgcactccctcatgcaatcctcaaggcaacatgtgagatttgcaatgaagaaattatacaacacgcagagatcacagagctagctaactgtgacgctgatgtaacctggaagttaccagtctttgaactggacgactgttacactgagccgtgaaagctgatggttctcaaaatgtggcccctggactagcagcacctgtccccactggaaacttgctgcaaatgcacatgctcaggcgtggatccgaaatttgggatggggcccagccatctgtgattggacaggttctccaggtgattctgatgcagctcaacctgagaatcatttctcttggggaagtggctttgtggaggaatgccactacagatccaatacaaagaatggccctgggaggttggcagtcaggtgttcaggtcaggtttcctcaaaggcaagactcctatatgacaggaagatgatcctgcgacttcataactacagatgtgtgtgtgtatatgtatctatgtgtgtgtgtctatgccatttgtatacacgtgttttttttttttcttcctacaatgtgatgaagaatcaaattgcaggctcttcatccacagaaattcccccttgtgatctgaggctctgccgagcagtggcccctccccaaagcagccccagttctccacttccctcctggcccccacccttgatcatggctcctgagcattttgggttttgtccaggggctcactaagagctctgagtaggaagttctcgctacaaagattcagctgtgggcgaaaaccgtatcatttccccaggtgacgtggggtgtgagggcagggctggagtgccccgggttcactggggagctgcagagactatcacttgccttccaggaacccttaccgtgtgccagcttccacaggactgtggtggaaatgtggtcaaggtcttaggagcaggccacacagggatggttcatgcactgagggaggggtgtggagcctctgattctgatgggactcccaggggtgctcacaatggcaaatgggctgctgttacctcctagcactggactctgggtcacccgcaagtgtaggtcacttccttgctggtcagtaatggggcacaagtcaccacagcaggcgccgctcctgaaactctcttcagggatagcacgggcggaagtgcaggcagcaggcagagcgtggaggtccgtgtggtgctcagtcactatggcaactagagatcacagagccacagtcaccatccccctagggcacctgcccagggaaaaggagaaatgtaaaaccacaagcatacaattaagaacaggtgcagagacccagcggcttccagggcagctttgaagggatccctcatctctctggtcccaggacatctgtgccaagggccaagcatgggcctgattataaggagcagcactgaggttccgattaaatgctcaaccctgcctgatctcttaccaggaaagggtgtgatatgtccccacccaaatctcatgttcaattgtaatcccaagtattggaggtggggcctggtgggaggtgactggatcatgggggtggatttccaccttgctcttctcgtgatagaattctcacgagatctggtttcaaagtgtgtggcacctcctccttctctctcttcctcctgccctgatcttgtaagaggtgcctgcttccctgtcgccttgcgccatgattgtaagtttcctgaggccttcccagccatgcttcctatacagcctgcagatccctgagtcaattaaacctcttttctttataaattacccagtctcaggtagttctttacagcagtacaagaacagactaatacaaggtgtccatggggaaagacacatggagagatttgggcagagaagaaagagaggctggaaatttggagctgccaattcccctgaacccctgttgtctacagaggcagctcccctttgctctcccttctctttctcccctcctctctcctcctttcacctcccatcccccatggaacccaacactcctctattaaaaagccttgcaatgactgcacctggggaagttgcctcctgagctgatgccacttccccaggacccacatcacacctctcattgcctccagtcccagaaaacagttgagaccatcagaggcagggtgaggagggcccaagacccccctgggaggagattgcctcaacatggagctgcaggtccactctagcaggtagcagctagagcctgggagcaagtgtggggtggagtctgacagtgcctgccccacatggaagagagcgagcctggattaggctgggtttcagggtttaatatgttggctcaacccctgagaaagtggttaataatcctccaggttggctaattggacaaagttaatgagattgaaaagcttgaaatcctggcacgctctagagaacagagctcaaagactcaaggaaatagaaatgtagaaaggtgcctactatttgcaactgactcagaccttccctaatatgcttcttccccaaggggcccggaggaagagaggaaatgcattggtgagtccttcaccagctctgtgggccgtcctctgtgggctggaggcagcgccactctaagcaccagagtaggggcggctcttaaccatcagagacaaggcaggtctcaatgccccaaggagcgagggatcgcaggtaacagtattttgacccataattgtctatggcaatgggtccttggtcacaggcaccccagacatgagacagagacctactaagtgctgcttgacatatttaggtggggaaagcccaggtctgctaggaagaatcctgcctcatggctaaatcccaggtaccagacttaaggcggtttgccacctttatcacagggttccaacatgagggcccttgaactctcctatggcgagaggccatctgtttcctgctgggatcctgactgagaggatggtgccttcacagacctcacatttcagtgagggggagggtcagcacaaaggtaattatgcaaattaacacagcaggaagttctccttatcaggagataaacagtacaaagtcatgcacagcatatcctgttaaaccaaaatacaaagtaaatagtgagaagtagggtttgatttagagtctatcttgatcaattaaaaattatgaacattggtccattttaccttgtattttgaaaaggtaaattaggcaaaattgcaactatgcccaaattcttaaaataatagtaagtcaacattaatggtggcagtagagttcttatacattttctgactatgttttatgatagcagaacgcaacatttttaacttcatgtttgacttaatacatcatgtgttcagcaaaagagtcatttttacaaaaatatgtatggcctttaattttcccaagagctcttcatcatcctttgaattaaattatttgttttgtcagggctggtttgtttctgtttgtttgttttttcttttatccccctaagtaaggaaacaaaggactagttgttgacagtctcataccctattgttacttagtctcatttttccagaacctcctttgtcagtagctttgtgtataatttgagtagtcccccacataatgttaatcaattccatgaaaccttacagcgtttccaagattgaaaatttccctttgccatccattggtgttatatttgtattgtgttgtggaaaatttgacaatcagaaaaactgattgccaagggcgtggacacaatggttagaggcagagagatgctcaggctaaacagggcaggtgttcagtgagggtgcagcctttaaatggtgcgtttgtggcaaatattttcaaggcagtctgaccacttttgcttctctaccaactttctaatacggggtccgaataacgaatgcttggagggcatccctggcctaccccagccccaggcacagtgcctggcacacccttagctttccagaaatagttattgactggatgaattgctaattatggtaaatggcattggtaaaaaaaaaaaaaaaaacttcagccaaattaaatttaaaggagtttaattgagcaatgaatgatttgcgatgcgaatcaggcagccttctgagccagggtaggcttagagactccagctacgtgatggaagcatatttatggacagaaaaaggagagtgaagtacggaaaacagaagtgaggtagggatgcagctgcattgtttacagctcggcatttgcctatttggatacagttcgaacagttggctgcatttgattggccaaaactcagtgattggcacaggtgtaggccaatctgcttacacctccacttgttagtgttcacgacttacagagaaccctttaggctgaacttaagtatgtacggaggctaaacctggtttaacagcataaagaaaaacaaaagagccaggaaagaggacaccagagaggccttaaagagtctagaggcagggaaggcctctgtgcggggtgaagtgggaggaagtggctgaggaaaagaggagcatggggcaggaagtacgggtcaggtcgggcgagggtaccacgtgtgagtgtgaggcaggagcgcagcaaggtggagatggggaaggcgcgatgacgtgggccctgcaatgacgcttgtctctgtaaaccacagagcagcagcggtggacagggacagaggcagtaaacacagggcatggtcccctccccaccccagggccagcagccctaaggaagagtgacttaggagagtagtggctgaccagctccagcagggcctggggtctgtaatcctgcttgagggcttccagaattccagtgctgcatgctactttaggtttagaaataaaagtattcagctgggtttggtggctcatggctgtaatcccagcgctttgggaggccaaggcgggaggatcgcttgagcccaggagtttaagaccaccctgggcaacatagcaagaccctgtctttacaaaaaataaaaaaaatgagactggcttggtggtattcacctatagtcccactactcaggagactaaggtagcaggatctcttgaattaagaggttgagggtatagtgggctgtgattgcaccactgcactccagcctggggaacagagtgagaccccatctcttaaaaaaaaaaaaaaaaaagaaaagaaaagaaagaaaagcattctcatagtgtgattcccttgtacctgtaataggtccattgcctgatgcactctgcaaatcaatatgctaagaccctgggctgcagcagagaaagaggcttaatcatggggctaccagaagaggaaatggcaggaaacctcaactgtatctccccaaggagtgtggggctagggtttttaagggttttggcgtaggctgcagtgtggagatggttgataggttggagagtggaatgaagccgtggacagggagatggaaaaatggtgttctcatgctgactcggttcctgttgtggggatcttcaaaccggttggcaacagctgttctgctggaattcaggatctgcttaagcaattcttaaacagaagccttacgattctaacagcagggaagttcctgtctagaggaacagtggggtgcagatggttggtatctcatgctatgggactttcccttacaaggaagtgggtcaaagtgtagcctgattaatgtttaattgtaacgatatttctgtccagaactattcttaaccctgaaccatggctccaccatgatttcagatagcagcagcagcagctcccttcaccctccgcctttctttctttctgcacccttttctaccttctgtcccttccctgcctccctctattaatggtgccctgaccacagttcctcccctttctccactatctacttgcccactcaaaaccaccaccataaccacaaaatgctgtgtgcagtcccaacaagagtgtcctctgaggctgcgatctcagggcaggagaacagagaagtcatccagggtcagggccagccctcataccagctgggggaagagcaggtggagttgaagggtttctccaaggtggaggtcccaaaaccccctctcaggaaggcattgatgcagggcggtgctagacatcccctagacaggctccggtgaaactgcctttgcagtatattatgacagtaagagaagtctgacatcattgactctatcttgcttctgactaccacgccatccttggtcattcctgggcacaggccaagctaactttggggagaatttatagtttaacttgaaagcaaggatgataacagtcccttcctaaaactaaccccatccatgctcaggaactgaaaaccaccttgtaagactaatgaaaggccacaagaataggattgtaggagggacctgaattctgctaaaatgtaggcatagtggccgggcgcggtggctcacgcctgtaatcccagcactttgggaggccgaggtgggtggatcatgaggtcaggagatcgagaccatcctggctaacaaggtgaaaccccgtctctactaaaaatacaaaaaagccgggcgcggtggcgggctcctgtagtcccagctactcgggaggctgaggcaggagaatggcgtgaatccgggaagcggagcttgcagtgagccgagattgcgccactccagtccgcagtccggcctaggcgacagagcgagactccgtctcaaaaaaaaaaaaaaaaaaaaaaaaaatgtaggcatagtttctataatcccttctttccaggggccatatggggatttgtgatttttcccaattgcttctataaataacatcactattgtaaaacctaagtgtttttttttttaattattattatttttccagactgaccctttggggatctgggactcatgactcaaccggtcttgtggccccacccagatgcagactcagtacatgtggaccattttctgcacccctgtgatttcatgcctaaccaataagcagcacccattccctagcctcctgcccaccaaactgtccataaaaaccctagtgtccaaggctttggggagaatgatttgagtagtaactccagttcttctgcgtgggccagcctcgtgtcagtgacacctcttctctactgcaatgccgtggcctcggtaaattgattttgtctgtgcagtggacaggaagagcccatcggacgattacactggccgggggcctgctctgaggatgctgacgccaaggagactcaagagagctggcaaaggccgggaacagcccaaggtggtaaagatacctgaaataagaatcacgcacatcttgagatcaagatgaatatcttaatatttcagcttatgataaagacatttggtgatcgaaacttttctctacccagagtcagtcacatgctgcagtcagtctccatatctggtcagctcctgccagagccaacccttctgcagacagcagctgtccacgctggagaaattacaaaaaataactgcctgatgccagcggagagtgaataagatgaaaccaattctggaagggcgttgacacttggaagaaaggagggcagcagggagcttctgtcatgaaggctgtggtggtggcggtcgtagccatgacaaatgaccaaaggaaaacagaaaaccgcaggctttctggtctgcagagccagcagactaagctcatggcagccgcagctgataaaaagcaagtgagcacccaggacagaaaaggccacaaggaggagcctcaaatcctgtgggtaaactctgcccaaattagatcatcagagcttcagcctttggtgacagaagccctcatctgcacgtcttcccagcaaaatggaaagcgagcattccccatacaaaaaccaagtgcactagacttccagccactgggctgagctcttcccccaactccgactctccaccgctcccagctgtcctaattgaaactcagagtggaataccaaggtctttttaaaacaaacaaacaatattcaaacttctcatcaaggacgcagttgagaaaacagcaacagtttgttgttgagccacaaattaagcaaaaccttgcttctgacaaaggacagaaaatgtagaggatttctacaatccaaagaacaaaacagcccaatacaaacttgaaacatatttgaacaggcatttcccaaaggaagatatacaaatattcaataagtacatgaatgaatgcccagtgtcattaatattagctaaaaaggacatgatgggggcaactggtacaatgtgaatatgcactatggattacaaaaattatatcaatgtgaaatttcttaatttgataattatactctatataatatcttgtttttacaaaatagatactgaaataggcctatcatactcaaaaggttgtgaagaaatggtgtatgtctaccgtgtatttataccttctctacatgctattctccctctgtctctctctctctctctcagcaagatgataaagcaaatggggcaaaacgcaaataattgctgagtctagttaaggagtatagaggagtttcattctctattcttgcaagttttctttaagtttaaaattatacaaaaataaattacaaaacatcaaaaacactaaaaagtactgaagttttcaaggaccaatggggtcttgtcaaccggacaaaacagtggcatgaagaagctaccactggccaaagttgtgtctgtctctgcatcataaagaaaagtgattggagtggattgaaatgcattgactcagtgacatccacaagcccatggtgactatgcaaaaaagatccagaacaaagggacttgtcacctttgaagcatctgctaaactaacacctcgcttataaaattggtcatacaagggaaagaatgaaaggttttattctgtttttctaggaggagctgcatttcatgggaaccaaataaatccatgatttacagcctaataaattcagaaggaacagtggagttggaaaaacaccatctcgcaaaccatacttgtagtgggctgaatcatgaccgcaaagatatcaggccctaatcgttatctggggttaactaacagtggatcaaccagataggctatgccttaggctgtaatgaaggaggaagtctgtaacaccacaaatgtgaattccagctaagaacattaccgtgaatccaccaaacctttagctccagcttctttggcagtaagaagtgcccagagcttaaagaacaagagagcccagacaagcccagaagatgagatattctgccaggcagcccgcccagtcccttcaaagccagcaacatgaaagggactgcactgaatgaaaagaatggggtgcagggatttccatgaagctgacagcctccagcttcagactctgcacaggcacaggccccttgcaaggtccagacagggtgtccacctggccctgtgtttcatctattttgcattagtgaaggattttaaccataatcgtgcctctgccactttcccctctaatttcaatcagacatgtgtcccctcaggtggaagggcattgaagtggccacaggcacttttagaatctgtttcaggggcactaattgaattgaatcaagggtggatgtggtggtttgggttccagagagtatttgtgtatgccactggtttgcagtaattttcatatgtagtacagtttctgccacctgtcctggagtagtatcacttccagaaatacttctaacactcattttgctacttacctagaattgagacacgtaagtgcagggtcaaacttcaaatcccagtatgaacctgtcctccagctccagcaccattgcgtgtgggagtgcagaagaaattaggttcaaagtgcactgagtcagaagctgggctatggagatcatttcaatcatcagaagtggaaaactgtaagagtgcgctgatgcctgcttctaaccagaatatctcctgtcaggggcgtaatgatatatcatatatatttttttctttttttgagactgggtctcaactctattgcccaggctggagtgcagtggtgcgatcacagctcactacagcctcaacctcctgggctcaagtgatcatcctgcctcagcctcctgagtagccagaataccaggctaatctttgtattttttgtagagatggggtcttgctatgttgcccagctggtcttgaactcctggtgctcaagtaatcctccactcagccttccaaagtgctaggattacagaagtaaaccaccatgaccagcccatcatatataatttttttttttttttgagattgagtctcgctctgtcacccaggctagagtgcagtggcacgatctcagctcactgcaacctccgcctcccagattcaagcgattctcctgcctcagcctcccgagtacctgggattataggcgcatgccgcaactcctggctaatttttgtacttttagtagagacagggtttcaccatgttggccaggctggtctggaactcctgacctcaagtgatccatccacctcggcctcccaaagtggtgggattacagaagtaagccacagtgccctgcccctgtcatatctaattttggataagaatccatgcaattggattcatcagcacacctgtttgtcatttgcaatcctgtagcagtttcgtgcacggtgttatgtttgtatgtgaagatgaatgttttatgcccctcaattatcagtaatgaacaaaccacactaaagaaagagtgtaattatcttgctaatatccctatagaaaatattacaaaatagttgtaaaaagaggcaatcaaagagtatgctggaaaaaaatgcaggaaaagacgtattacagagttgtattaagcagtgaattcataacaatattctgatagttttctagattttgtgctgcttatccacttttcatttgtaattttattataatttattttcctattctaaataaacatttgttttaatctaattttatattcataatgctgtatgtgctttcttttttagattttttttaaatgtatttctttaggctgggcacagtggctcacgcctataatcccagcactttgggaggccgaggcgggcagatcacctgaggtcaggagttcgagaccagcctgaccaacatggagaaaccctgcctctactaaaattataaaaattagccaggcgtggtggcaggcgcctgtaatcccagctactcgggaggctgaggcaggagaaacatttgaaactgggaggcggaggttgcagtgagccaagatcacgccactgcactccagcctgggcaacaagagtaaaactccatctcaaaaaaaaatgtatttctttagagatgggtatcactattttgcccaggctagactcaaactcctgggctcaaatggtcctccggctgcagcctctcacgtagctgggactacaggctcgcgccactatactcggcttgtgtgctttgtcttaaagaggccctgctccatgaaagggccgtgtatgcaaagtagaccccaaatgccaaaggagccaagaaaccaaaggagaaggcagacaaatccagtttgtggatattggttgatgtattggggaacttacacatggaagcgtggccctgggcggccacaggacaggtggctctctgcactgttactccccagacctggggcttatatactgcagggaaagggcgtacacgctccagcaagacaaaggcaactctccaggacagcaagaatgccatgtgcactgtggcctctaatttgtgcggcaacgtcaaggttgacaggttcttacactagagacagtagataaagcggacaccaggaggcattcaagggactggggccgatcagacgtgaacatggtgggttagcatccaagaaggagccacttttgtctccaggggccccctgtttagagacatagcccccagattatgtctctagaggacattttggggtgaactgatagtgtctggggtgaactgtttcggggtgaactgaagatgtctgggatgaactgaaaatgtccttgacatttgttaaactaactctaaaggacattttggggtgaactgaagacacttgccctctgagtaacccaggggaggggaggatacatgaagcagagccatgagagccatgcacgatggggagtcgggctcccctgggaggtcctcgcttatctgcccaggaacaagggggtggcctggcattggggagagaaaggagaggcagagtctgagacagtcctcaagaaataagaatgaggtgcaggtggcagcctccagtacactaagaaacggaagcgtgtgcaaaacaggccaaagcctggcctgtgggcagcccttctccccagccacctgcagggcccccacagtgggcctgggctccacatggagaagcgaaggagtgggagggaaccctgcggggcagcgggcggtctcctacccaagccggccgtgtacccatcacactgcattcgaggagcattgcacacagcaatcctcatgttctaagtgcttcctacctcccttgtgggaaatctgagagaggggtttgggtacagaactactctcccagctcagccagaagccaaacttccattcaccgtctcccgcagatttacagttttctctatccaaggagaagacaccactgaaaaaccatggcaaaaccacgtggtaaccttcagtttacagaacttgaagcagaggctatttcagaaagaaaggataataaagacgtttatttgcatttgtcaatcaacttaacatacagctgagaaagaaagactaaaaaccctctaataaagattgttaactgacagaagcattttgtttttgtttattttttgagacagggtctcgctctgccacccaggctggagagcagtggcgcgatctccactcactgcaactgccactttctggactcaagcaatcctcctgcctcagcctctcaagtagctggaactagatacacacagcactgcacccggctaacgacagaagcattcttatgatacgatctcctctcggctcacttcatcttagtcctggaggtctgactgtctagtttcttcttcttcagaattaatgtttcctgaaaagaaaagagaaacatgagtatatctcatatttactttgttctatttttaaagcctttattcactaacagatcttttgccgaaaaaaattattgtaactattaagcattcatcagtcaaaaattgaatgttaaattttatctcatatgcacttcaacagttttttcttttggtacccgacataaaataagcaaaatacgtactcaaagtaaatgctaagacaagactatccatgtaacatcagtaattctcttatgcctgcacacctgtccaaaacagccagctttgtggctaaaacatgtaattgcttggctattaatttaaaagaaaagcaggccgggcgcagtggctcatgcctgtaatcccagcactttgggaggccaaggcaggcggatcacttgaggtcaggagttcgagaccagcccggccaacatggtgaaaccccgtctcaactaaaaatacaaaaattagctgggcatggtggtacatgcctgtcaacccagttacttgggaggctgaggcaagagaatcgcttgaaccccgtggcagaggtttcagtgagccgaggtcacgccattgcacttcagcctgagcaacagagcaagattccatcttaaaaaaaaaaaaaaaaaaagcagaaatttgccacattcttataagacgctatatttaaatgttttgtgaaaggtagagctattttttattattaattaaactctataactttcactgttgggtatattaaagaagaaattagcagggtaaatctccaatgtaatgtgggattcatgatgaatacatgctgaacttgcattattttgataaatgttctgccgactaagcctattttgtattactcccttttcacttagggccctcctgacactgtggcctgggtgaccctttgctgggggctgttctgtgccctgcagggtattcagcaccgtccccggcctccacccaggaagatgccagcagcacctccctcaccagcctcccaagtctccagacattgccaaatgtcccctggagccccaaaaccactgagttaagggggtgttccctctgtccaaggctggtgcatgaacccacagtctcagacgcccgctggtactgggcatcgtccactcggccccatctctcccagtccggttttcaggattcctcctgctccatcccctccgttatctcccccaccaagtttctggggcctcctgccttgcctggctccagggcacccatcctcattgccccagagaagctcagagagcaagcctgatacaggcaatccccacagctcccagaggtcccgcctactgggctcaggatcaagttcaaaggccatctggttccaagggaaaggggccacctccccacccccacactcttctgctgtcagactctgctctctgcctggaatttccttcctggtttcacccattccttgccacctccctcccagctaacccggagtttcctggtcctgccccaggtgagtcatcacctctcctgggtacatggtaacacgtccctgtcactgcagggaactcactgattcctttattccagcttcccattaggtgctagagggcgagagcccagcccctcactcccacactgcctatcaaacccagtgtctccccctccagctgtgctccacagtgactaaggactgacatctgtgggcacagctagatgctgctgtaacactgtgcatactctagccactcagtcctaacagaatcctgtggactccctacctaccagggctcactctatccaccctccctgtgcaagtcagagaagcagagacgatgctcacttgtaaagccaggtttccacctgaccccacgtcccacctcagcactgcgtcactgggtgcattgctacagcgctcaggggaattaccgatcacgaaagtctatgccagcgctcaggggaattaccgatcacgaaagtctatgtgtgcttcaagcatctaagagaaaactgctttatgtgatttcattatttcaggtattattttcaaaggaatgggaagtatattcttaatttacaacagagacaaactaagtggaatgggactgcagaccccgtgcctgaggccgccgtgcccaggctgttcccagatggccctttccctcacaagcacgacaccctctttcagtcagatgtgaaaagtgcgttaagggaagcgagtcctctctccagactttctgcaagtgcccacaagcacttggggaaagatttttaaagattccaggagcctgaggcttcagtcagtcagaactgaggtcaaatccctgccctatgagctggcagaggcagaagtttctagattaatcttacatccaaacccattgaaaaagagctagttcccgacaccactagtctgaaaccatactcctgttagtcagccctgctaaaaatcatgcaaatcccagcactttgggaggccgaggcgggcctcctgtgtgaggtcaggagtttgagaccagtctgtccaacacggtgaaacccacctctactaaaaatacaaaaaaattagccgggcatggtggcatgcacctgtaatcccagctacttgggatgctgaggcaggggaattgcttgaaccagtgaggtggaggttgcagtgagccaagatcgcaccactgtactccagcctgggtgacatagcaagactccatctcaaaaaaaaaaaaaaaatcatgcaacagaagaaagccaggctctgcatgtctgacagggctctccagcctggggtcggtcctcctgtgacaacgcgcatgggcaccgctgcacacccaggcctctcccactgcagccaggcttgcaggagggcctgccagggagcaacgttctgagatggctccagtgagcgctcacagggggccccctaagccttcctcgagtccctggggcccagctgaaggcaggccttggtgaagggaaggggaatcccactgttcgtggcccctaagtgcgggccctcgccccacttccctgcgcagggacctcaccctcatccatgtcatagcggaactcctcctggtcatactcccggctctcttcccggaggacgtctgcatcttcatctccaggcctcatgtccatctcaccctcgaagccctccagcagagcctgggcctcctccccgggttctcctgcacctgagataaaacacaagtcagaagcctgagttcctgggaaaaatggagcctgcagacctgtgcagggcagctgtcccctgggctgccgtgcccccaccctccccctcccactggcagcacctcatgttccccatctcaacatccacccagcccagcctaggcctggccaggggagcagcccagtccccactgtagtcagtggcttggggatgggagcaggtagtctgataactttcattcctgagggtgttgatgagactcttgagaaagagaagtcccctggggttcctgagagtgccagccaggggagccagcagagaggagagctgggacagagggcagaggctgcccggccattctgggggctgtcccggagcttcccagtcacatgagccaagaaattcttagcagcatgagtattctttcacggaggccaatcggagttggctttcctccgcttgccatggaagggatctcacccggggtagccaccttcaactttccccagcacattaaggacttccagaaagaccactgggttggacatggaggtgccacacggacccttcttcagggaagggctgtcccctcagctgctgtcagtgccagcccggggtcacacccacattcactcactgacctaggtgaggggataagggtccccgagacgccacagtgctccccatggaatgaagcaaggttgtggaggccacacctccgcctctgtccaatcaactctgtttctttcctctcccctccgctctccgggagtgtcctccaatcccaaaggctctccctaataacatcccgcacactcaactgacccagcatctgattttcagagagtccaaccacacctggcctgaaaacaggatgtccacaactcccacagcccaaaggcgcccacaccctccatcccacagcctggggatgccccacaccctctgtcccacagcccgggggatgccccacaccctctgtcccacagcccgggggtgccccacaccctctgccccctccaccccacagcccggggatgccccacaccctctgccccctccactccacagcccggggatgccccacaccctctgccccctccaccccacagcccggggatgccccacaccctctgacccctccaccccacagcccggggatgccccacaccctctgtcccacagcccgggggtgccccacaccctctgccccctccaccccacagcccgggggtgccccacactctcagctcctggagcgtcttggccaggtccatccgtagaggtcggctttttggggagagttggtgtccacagggccaattcagtgatttgggtagctttccattttggaacaacagttactaattcttcctcctcttcctcttctcctctttcctattttaagtgcaaaaatgtacatttaccaacatttgtgtcatcttggtctggaatattaaaagtgagggaggaaggacaagttttgaaagacaggttttggcttgtgtttcagcctttttaggacgtcactcaggaatcagaccagttgctgactatccatggtataatctcagggttgagaatggatcttgaaagagccagggtgaggaataaagtctccagagcaatgctgggccagcgagctttataatgggtgccacaaaaggctttcagatgagcatgtcgcagtcgcctgcaatagctaagacatggccaggactaagtggccagaactgagtgaccaggagtaagtggtcttttcaattgttcggccacattttgcaactctaatataaaaaatcgtgtattatataattatatgtctattgagcttagtagaaacataattatttatattattctttatataaataataaaagaaacagccatttgttttaggcttaggcctaagaagttcctaagatgtccatatgatatggatttgcataaacgcaaaagctcaagtgtcaaggattatggggaaaaataaaattcaaggaaagcagaatgagagttcatcaagtctgaacatggaacactttgtaataaaaaatgtacaattccgacaatggtgagcagccaacatgtgccaattttgccaagcatatttgcctacttctcagttttgtgactatcacaaaattccaaagatctgagcatcagcactatgactatggaacacttcgctgccacataggtgataataccgatgacagagaggggcagacacctgcctcttccactgagtcactgggaaatcaattactctctattttggtctcagagtgtttgaatatggccacccatgaagggtgacaccaatgctgcaggacagggtcctcaaacttgacttagatcagaatcacccagaaagcattaaaagacagattgctagccccacccccagagtttcagattcggcaggtctgggatagcgtccaataagctgcattcctaacagattcccaggtgaagctgacagcactagtttgggaactgcacgccactttatgtataaaaccaagaggtggaaccctttcacattgctggtgggaacgtaaaatgctgcagctactgtagaaaacatttgacagttcttcaaaaagcgaaacagcatcaccatatgacccagcaattccactcctcggtatataaccaaaggaactgaaaacagagattcgaccagatgcttgcacaccaatgttcactgcagcattattcataatagctaaaatgtggaagcaactcaattgtccatcaacagacaaatggataagcaagaaccttgaaaacgtcgtgctaaatgaaagaagccagacacaaaaggacaaatacagaatgaattcatctatatgcgacatctagaataggcaaattcatagagaaagaaagtagattaaaagctatcaggggctgggggaggtcgaatggggagttgttgcttaataggtacagagtttctgtctgggataacggacaagctccagaaatgcatcattctcacagctgcacaacactgaacgtactgaatgccactgaaagcatgctttaaaatggcaaatttcaaactctataaacgtacatataaaaccataatttaaaaagaaacagggagtgagccgtgggctgcagcttggcaagccctactctagaagggatacattccccttactagggagagagaacacggaggcccttctgttccaccaccatcctaatccatccccacagcacagtgggaggccttccacaaagccctcaggttgttgctgcattatttcatgggtggtttttcctaaacagcaacaggacttggggcttatatcagtaattctctcttagatgttactgatgctccttctaccttcttctcatcatcctgaaatactgacttctaggaactttttccagtagagtctaaagctgcaaagcacttaataagatgggctttatttttatcactacacaaatgtaaaaacttgctcaatcaccagtaaccctaaacagttattaccagtgctgacaagatatcaatttaaccaataggttccttcagggaacagatgagaggtgtccaaccccatggaaatcccagcaaaatactaaatacctccctgtcacaatcaaatcctaaagccgactgtctttcttaggcttctgactatgtgtgtaggaggttacacacacacacacacacacacacacacacacacataaatgaagtggaacctcgggggaggacagtatgtcaaattcctctacgttttgttagatgcaggtgacttacaggaagctgccttccacccagactagagcaccctgcggtccatgaagaattcgtgctcagaggaggtagggcctcttacttagcaacaaaatcaagcattttggccatttcattttctggttttctagggacctgcccctagccagtggttccttttagctggagcaaagcaggagaagaggcaaggaagacagatcactgtgaggccacacaggattctggtcagccaagaaggtggaccatgagcaaccatgggctgtttggggaaactaaataaccatggccagagtgatgtgcagaaagtagaatatcacaggagcgggaatcaggaaaagagggtggctgaggtcagggccgagagccccggggatgtccagactgtggccacttgggaagcagcaacggagcacggacagtcacttgatcatgggaggttaagggataaagattcaaagactccctttggttttagaatctaacaaactctaggaagaaaaatgagaaaagttaaaaaactgtctggagggctgggcgcagtggcttacgcctatagtcccaccactttgggaggctgaggcagtggatcatctgaggtcgaaagtttgagaccagcctgaccaatatggagaaaccccgtctctactaaaaatacaaaattagctgggcgtggtggcacatgcctgtaatcccagctactcgggaggctgagacaggagaatcgcttgaacccgggaggtggagtttgcgttgagccgagatcacgccattgcactccagcctgggcaacaagagcgaaactccatctcaaaaaaaaaaaaaaaaaaaaaaaaaacctgtctggagagcattgaagagcattgaattgaaaaattagtgatgagtttagacttaggattcaaggccagggcccttggggtgaaaggatggagcattaggtagagacagcagtgggcggcacagagcaggtgcgggacaggccctcatgcacaggatctcccgcagccttccaagctccccacagtgtggcttctacctcctgtgaccaaggatagctttccacagcctcacacctgagcccaaggtgacgaggagtcggtttaaagcagggcctctgggtgatgccaagggcttgacgagggacacagcaacaaaaaaacaaaacgaggtgacttggctcaggttgtgacatagtttgggtgtttgtccccttcaaatcgcatgttgaaatgtgacccccggggttggaggtggggcctggtgggaggtgtttgggtcacgggggcagatccctcatgaatggtttggtgccttccctgtggtgatgagtgagttcttgctctattagttcacacaagaactggttgttaaaaatatatatatatatacctggcacctcctcccctcttttcctcctcttttgagctatggtaccagctccccttcaccttccatcatgagtggaagcttcctgagacctcaccagaggccaggcagttgcgggtgccatgcttcttgtacagcctgcagaactgtgaaccaaataaacctctcttctttataatctacccagcttcaggaattcctttatagcagcacaaaaaggactaacccaggttgaaagggcattgatgtgatggtagacccaaacaagccgttccccggctttcttcagaaagaaagtatgcagacatgggagagtttgtgtacgataatatattcttaactcactaggaggggacacctcaacaacttcagagaccaaaaaacaaacaaaagcgtgattccacactcctccttaaaactcaaaacttcttacagtgagaatgacctcatctaaacaaataagtcaaaaggatcaaaaccagtaccagggtcaggaaatgttgctgaattgctaattatctagagggattgatcagacattaataatgagaggaataggaacacatatattcccacctcaacacacatacgcatctcgatgccttataacggcaatattagctgactagctttactattaaccagggaatgtcaatgtagtgttaatattaatgttagatattggaaaggaaaaaacaagagaaagacttaccaacggcacgttcagaggagcatgctgcacaacggacaagctaacagtcactggacaaactgtggcaacaccagttacagattcagttttcacttgcaggacctaacactgtctagaaccctcccactcaggattagttttttatttattggttgtttgtttgtttgtttttgagacagagtctcactctgtcgcccaggctggagtgcagtggcgtgatcttggctcactgcaaactccgccgcccaggtttaagcgattctcctgcctcagcctcctgagtagctgggattacaggcatgcgccaccatgcccagctaatttttgtatttttagcggagacagggattcatcacgttggccagtctggtctcaaactcctgacctaaagcaatccaccgcttcggcctcccaaagtgctgggattacaggcgtgagccattgtgccctgccaggattagtttctatcaacaaaaacggtatctatcaacaaagtctagagttctgcaataaatgggaaatgatattgtttgcttctggcaatttagttctgtactaacacatgcagataaggaaaatgaaaatgtgaaagtgcctaagagttggcataacttttaggcgaatcacctccaaccttgcaggatcaatatttttgagcagctacttccctgttaatgtaacaaaaccctacatgctccgcaacttaccatatctgttaaacgatattcaccatgttgttcacacccaacatcaaatacatactttccagggccaacaggctacgagcaaagagaaaccattcttaagtgtcaacacccagcagaaaatacaaaatacaaatgtcaccaccacaatacccacctcaaatcaccaaattgggtaaagtgtaacatggattaaggaatgcttttgtgaattcgtggctgatgggattggaacttatatgccctgttttgtttacttttggaaactttaaccacattttacttttttataaaagtgatgtattcattttcagaaaacctcagtgaatcagtatccataggcaaactagctaccgatggaactactactaatattttgatgcattctttgtaactttgcttctagtatacatggttaaataaaaatctgatcataattatacatactaactcatactctatttttactgagaaatatggcatgaactacttcccgtatttacaaatattctttcctaataacagttgccacctggtactttatttcatctatggattgcaacctattttactcagttactattgttggtatttgggatactgattttttttttttttttacaaagaacgctccagcaaacgtactctgagttaaaactttatgtacgcttttgataccatccttaaattctcagaatttctggacaaaagcatacatgtgctttgattagatgaggctctaatcgtttcattcccataactgcacttaagagtcccagatcctcaaactcttgattttaggagtgtaaaaatggtctatttttacatgtttttttatataaaacaacagggtctcacaattttaattcacttcatttcagttgttagtaagcctgcatttttttcaagatttttagccatttaaatcacattgattgataaaacactttatatattaaatgttgcaaatattctctccccatttaacagtcatctcttagattttctttacagcattttctaatctataagaagttatttttataaagctaaacctattggtttttcctttctatttctgtttagaaagttctctttcctcatttcaaggttaatattcatctacattttttttctatatttcctagggtacatttaaatctttacttcttctagaaagtatcttcatctgtgtgaaggcaaaactattattttcctcccaaataattgtcaagtgttcctagcactatgtcttgactcctcccatcatccctttgttaatttgacacgcttattgtgtgtgaaattattttatatactgggaactgtctctggacttcctaatttgcttcattggtgtgtgtgtgtgtgtgtatcctggtatcacactgttttaattattgaagttttgtggtattgataacttgtccacaaggacatgtacagggaattttctgaggaagaaacacaaaccagcaataaacatgtgacaagatgtttgacctcactagtaatcagggaagtacacattaaaacaatgagatgacattttttacccataagattggaaaagaacaaaaacaacattaaagactgagaatatccaacatcgatgagaatatatgataaacagactcatattctattggcaagagtataaactgacaccactttttaggaaaatgggcactaccgattgtgattctaaatgccaatcctcaaaggtttcacaattccattatctaacctacacaatagtcccaaatgtgcaaaatgacaaatatgtatctttatgtatatttttgtatcctgacacagtatgatcctaattatgtaattaaaacccccaaacaataattctgtgtcagatgactgtattagaatgtgcttacatgacacacagaaatagtgtggaaggattgggcccagggtggtggggcaggatcctagtgtttaaatgctttacaattggaatgtacttgtgtattatttgtataatttaaagttttttactaactagcaaaacaaagcctccatttttaccccgatttttcagactggtttaggctggacaagctgattgattcttccagattcattttcatcaaattctcttcctctgcaaccaccttcccatctcctccaaaaagacccacagaaagtttgctgggaattatataaacaatgtatgggtttgaggggaatgtgctgttttgatgaaaactaaaagtaaaatctgtggttagggcatgaattatacgtaaatgaaaactgggttctaagagagtctgaagagacttcgttgtatcagctaaacattccctctgtcaacttctaacaccatcaatttgctccgcaaattctctcttcagggaaagtttctgctcaacccctgatcaaagctaccacgatggcctgagtattagcttctgaattattcaaggtttctctgtacaataagggcaagaggaaccaccgagtcttccaaacagaaacggcccaccatgggtgctagaagctggcaagcctccagacgcagggccaggcccttggcagccttaattcccaccacaactaggagcacgcaggctggcctgtagcatgaggagggagctgggggtcttcctccccagggatgtcgcacctccccttccagggaaacaaaacccaaacacctctatgctcaattgcaggaaatagatatttggtatctgatttacccatgagaaggaatacacacaagaggttcagatgccctctcgtgttatataacaatgcaacaggtccccgctgaaagacagtgggaatttgtactgagatccagagaaacgggccaatccctcccttcccccaattctgtgctctgtgggtaccagaggctcagagaatggcacagctgtcctgttctccacatttgaataggccggactcagttttctctgagtttttggtattctctggtcacacatttgcacaggctgccagagggggttattttgtacttcattggcaaatgtcacttcccatggacttacatttttgttcaagaacttgccctggtacctgtggttcaggtgaatgagctcggccgtgccctcctgctgtccgttcacccaggtgccaacatacttactgcccgtctccgcgtataaataggtgccttgcccatgcctggttaagacaaggggaacatggtatttcgttccagcacagtgaaaaatctcccaggtttaaaacacagacattgacattgagggaggcccaggctgttgcaggctcacaagcgatgtagcttctatatctgtgtccagtcagaaggtgccccttgctcagtgtgccccaagcacaggacattgccagaggcacagaggacaggccagctggacagaggcaagcctcctgtgtgtcagctgctttccccagggaagaggcagagctagtgggagctgtggctcaggtcccccagtggctcttctgtgccctccactccctgggactcttgggtgaaagactcacgtgctctgccccaactgaggtgcagatgtcagatacttgagtctacacttgcacagaaaggcatccttgcctcaaagccatagaaagattggacctgcctggcagagttggtaactgggcttttgttatgattctgttcctcagtaagtgtaaacaatctgcagacatcatgttctcattacataagcaaatcccgttaagacccaagatagaaaccgaacctttgatgagcaaaccactctccagtgtaggtgtcattattgatgtagtagtatacgccatggccgtgccgcaggtcatttgcccactctcctgaaaggaacaacacaaaggcaagcccaggtgagaagaagggatcgatgccctgtaccatgtcttcaaattgttaaccatggcaaaggcagatgtgttgtgaagcaaatgaagcccatgcacacacaggccccttctgctcaggaaatcctgcagaagagagatttttaacagcaccgaccaaggctgctatctgtttccactctgacatccctccaccccttccttttgtgccagatggcataggtgctgagccacggtggacagtgggctaagagagggctgagtcaggagttcacggggtacagagtgaggtgtatggatgtgggccacagccacctgcatgtactgacaagcacatttcacaggttagtcagaggcaccacgaagatgcaacgaggagggagacaaaccaaggttgtctgacccattgccagtgatcctaacaccacacttcatttaccttgcaaatgtttagagatccagcaacaactccagggcttgaccatctatcctcagccacctggcagcatttcagtctatctcccacccaatcatctgactccaacatgccactctaaccccagctgcacaccagctccatccgctggtgccatgcctctgtttgaactcttccctcacctcctcacctccatacggcttctgctaagtccttataggcttggtaggcagtactgaaattggcaaggatatcataaaattcataataccactccatgatgtggacaactgcaaactacttttgtcaaccacagtatgaatccctgcactagaaaactcaaaacgtcctcaaatcttacagctcacttaggaaagaaacttaatagaggtctcccaaaggtgactgctcttaaaaacgtgcatattacaccaagtcattaagctaaatgatatgttttgagactatgaataataaaaagcaaatgttgatcaatttgttgatcaaagagaaaagaaggaattatatttctattctctctatagaaaacattacaaaatggttgccatatggagaagcattcaaagagtattagctaacaaaggtagagaaaagctattctagaagtatgtcagacattaaaactcaggctacttagattctgtgatgtttgtggtatttttaaatttttaacttattttgatttatcattgcaaatgaaaattcacttttataccaactttatattttcttttttttaaagaggttctcaaaacttacataagcttctggcttacacaaaaactggacccacttccacatgaagataaagaatacccaataggctaagaaaatgctaattattcaagtaatatttgtttatgtgaataaccccaaaatttatctgcagaaggaacttctacatatttatttcctcaatcatcccattatttactcagcacctacaatgtcctgggcactttgtgagatgaacgaagagctgtacaaaggacagtgcatgtccccagggcgcgagcaccagcctgaggatggaaggttggcacctgagcagcagctgaggacagggaaggcagcacgaaaagctgcatggcacaatttcaaaaagtgggtaagtcattcagaaaagagcaggcttaccaaaaattcatggagagagggaaggtggcaactgctaacaattaaggaagaggactaggtcccatgatgtgatgtgtgacaggaacaatgtgaacaagagagatgaagatccccaaattgagataattcagtaaaaaatacttcaggtccctgaacctaaattaaccatgaggatgtgcaaatacctagagggatttgtctgggtcttaaggggcagtgatgtgcctggatttgtaacatttgccaggttctgtggtgtaaatactcacaccgcggccaatttcaagctacacatggagctgggaagagatgcacagaatgggtttttgtgagctactatgagggggttccagcacagccctggggcatagagacctcagctgaaacaggtacatcatttggtttcttcccaacaaaacttcatgacaaaattattacatccctcctctcttggccatgtcagaggatctccagggtgtcatggtgagaaaaatatattacatattttgcagaaaaatttcaaaaataaaagagaacagttaagttgcaaaagacactaaattttgcaccaagaggacggtgagcaaaattttttaaagtcccaatctacttaaaaaacctgttaagaggctcggcccagcattttgtaatgccaccacagggaccctgcacaaatagagaaggtaattcagagaaaagtcacctgctgaggcacatctctaacagctataagtcaagtttccttttttgaggtgagtgacatttgtaaactttattattgtggctttaaatttgcacttaattttttttttaaagtctttctaccccaatcctatactttctgatcattcttgaacttgtcaactgaggttttttccaactatatttcttctcaggagtaactcccagttggttggttggttggttggttggttgatttgttggttaactggttggttggttggttggctggttggctggttggttagttggctaaccgattggttggttggttggttggctggctggttggttggttaactggttggctgggtggttggctagtcagttggctggttggttgattggttggctgtttggttggctggttcgttggttgtttggttggttggctagtcagttgactggtttgttgattggttagctgtttggttggctggttggctggttggttggttggttggttggttggctggttggctaattggttggttggttagacagttggttggttaattggttggttgattggttgcttggttggctagtcagttggctggttggttgattggttggctgtttgattggctggttgtgggtcagttggctggtgtggagcaggtgctccttgggtagagcagtttgtctggcacttgggattgaagacaatttaaaatgagaagctctccaagatgctcctcccccctcaaatgctggttggtcactggtttgccatgctggcccatggtcttgccaagttggctccctaaactgctgggtcagccaaacacaggagagaaggagcccacacttatggggaaacactcggtgtcagaccctgggcagggttccgtgcacttgccacagcatttggtatgtgtaatcgctgaaatatggttttacagatgcagaacctgaaaagcagagagactgcatgcattccccaaggtcccacagctggtgggtagcaagactgaaatgaaaattggagtctgtctaacaccatgctctcttctccacaagcatcccaacagtcaagtgctcattttttccagctcctgccattcgggggcttccaaaaaacccaggttcaagttatcatgtcattcttctttctccacaatgtcattcttaaacttctttgttttgatgagttctgtttgacaggcaacaaggccagcagggaatagggatgctctttctcccccttaacctcagagtcctcagttggccctacacccccaaccctcagcatcagtacatggggtctaggcctcccccacatctggcacccaccctcccctccatctcatcccccactacccctaaaaacctcggccttcctgcctgtatccaagtcacccgccacccaggaccgtctccccactcctctcctgcagcactatagcctctgctggctcctggactccctaattggacttgtgtgaccatctgggagacaggtagggtactggactttatgccacagggtcctgacgttgaacacactgccctgcacaaaaccattctggcccattgtgatggcagccagccaagatacactgttatgaataactcagccatacattaactgagattttgtgattggaagagtattggcttactatgttataattaatattataacttctgacctcagtttccattgctgccttcatgaagtaagacacttatttaagcttttgtcagagaagaaatctctgggtagtggctaaatcttgcaccctttaagatacaaagccatctggagaatcaaaaatcccaactgttaccagaagagctttatatgttagtgtggcataataagaaatattggtctttattcatggttcccagcacagagctcctaaaacccttgacatttcctgactgatagaaatgtttttgttattcaaaatgagactcttttgaccacacctgaacttatgcaaatgaggcccaggatggcctcaagatgggactgaacaccagaaagaccaagtgataagaaggatagaacctccagccccacccaccaacttttggtaaagaagaaggaaggggccagagattaagctctgtaaaaactcttgagcaagatttgttgagcttctggggtgataaacatatcatgtgccaggagggtggtgcactccacctccacaaggacagaagctcctgtgcttgggaaccttccaggccttgccctctgtacctctgaatctggctgttcatccatattctttataatatcctttacagtaaacatgagtaaagtgctttcctgagtcctatgagccgctatggcacattatcaaacctgagtagggtgttgtaggaacccccaatttgtagccgagtcaggtagaactgtgggtaccctccggatccacaacttgaggttgacatctgaagtggggcagtcttggaaactgagcccttaacctgtggggtctgtgctaactctgggtggtgtcagaatggagttgcatcattggaaactcagttggtgttcacagaagactggagaagtacatagcatggaaaatccatgcatttggtgtcagagaaacagttacccatttttaaccttcatattcaaaattccttaaatcccttatcctaaatatcttcgtgtgtgtgtgtgttgttcaaattgtatcaacatctacactaaaatcaaaagtgacaagaatgagattaggtgcataaggatttggaaagaattaaattaagccccaaattaaattgtttaaagttgatttaaaaagcagatggtgcttcttatagagcaagccttctgggatttatgaaacaaaacaaaacaatttctatctaacagggatggtattaaaaccctccatcttggtctcagaattggacagaatcatcactgacatctattaaaataagaaccacctactggttcttattttatctaggagcaaagcaagcaactatagctcgcactttgtaagaatatgtcctcctcactaagaagtgatgctgtcacaagtggtacatcacagtcctagccccagttactgagtgctcactatggatcaggcaaggttgcaggtgtctccctgtgtttatccattgaatcttcatgctacagatgagaaactgaggcaaggagatgtgaagtcacctatgcaagctcacacctattgtcaccagagtccaaggttagggtcacagatctttttggaaatctgaagaaaactagacaatttctttcttcctagggaaaaaacaaaaagcccagaacacagaattttatatacactttctgaagactcacaacacgctccctgccggtccccctgcccaggtttgggatatcactaatgtggtcacaccaggtgacaacggcacaaggggcggcagggaggttcttggaaataaaggaaaaagaatcctcctcaaacataacattggcctgtaaggacttatggcacaggtaggaaaagtcagtttaacaaggcaggaagactcccagacaggaagccctgatgtaaggaaacactcgatctgaagaaataacacatccgtcagatggcggggttggtcagaaatggaaaatgcaaagacaggttcaggaagatgaatgccgcagagcagctgaagccgtgggtccaccagctgcgaggcctgcgtccactcaggagcctcccttttgtctgctcccaggacatggacatgctggccacagggacagatttcccactacagattcattagtgagttaattaattacaaggctttcctatttctgcatcaacactgtgaatatagtaacacgatctgtgttcgttgaatgagtaactggagaactttaagctttctcatacatgtcagtattcacagacaagttcagtcataaagaaagaaaaacttctgtaacacgaaaatctgcttagtgataacattttaccttcatatctggatccatctggatatataaaagtgccttgaccgtgctttttatttctaacatattctccgatatatcgagcaccatttttaaatttgtagatcccctgaaacacattgattatatcattcatatcattgctgaatgtagcatttgctaacagagtattaaatagagaaaaccatccagtcaagtcaacggttctgacctggccatgtcttttaccgaattcgtagctcccttcgtaggtgtccccgttgggtagccgtgccctcccacgtccgtgcctttcgcctgcctcattccgacccccctcatattcctgggtaatgaaaattgacacaattacagctaccattcattaagcgctaaccaggtgctaagcattttgtaaatatcatacccttgagtcatcccactatgctaaacccccggcactatactcaattgtcccacctttcccaccttaaagttgaggtaggtaacaacgcctgggctagatgaggcactagaccaaggccacaccccagcacatgtccagggcggaagcctcgttccctccctccaacacagagcttgcaattcattgtgataatcctttaccctgtaagcaaggttaaccaatttgtgaaaaatgctagatactctaagctgtgttcttagtaggaacatgcttgaaatagtacatgcgggtagaacagttcaagtccacacaaatacctccccgtttgcttccttcagtaatccaggatttcaaaggcaaatgcccagagagaagcaactcttccctcaaatgatccctggggcggggtgtggcctgaagagacctttgccctgcaaggaatttccgatggaagggacaggttggagggcactgaggagtacacagggctcccttgctgattaagtttatcttatttttaagacccctagcaagagacttaaggttcgaacactcatgacccaatgctgcaataattatgtatctatctgtggtttgtttttgtttttgagacagggcctcactctgttgccaaggctagagtgcagtggcacaatctcagctcactgcaacctccgcctcccaggctccagtgatccttccacctcagactcctgagtagctgagactataggcatgcgccaccattcccagctaatttcaaaatttttttgtagagacaaggtctcactatattgccctggctggtctcaaagtcctggactcaagcgatccttggcctcccaaagtgctggaattacaggtatgagccaccatgcctgctcaattatgtgtctatcttaaaagtaaataaataaaaaatgtgatcaaagcttgcaattttcctatccttcagaaaataaatgttccttagcacctaatacatgggtatagagtgaatatagtaaataataaaatgctgaaagcatccagtaatgatttaacatgggtatctcataacatcacactgtatttcttaaatatacataataaaatttattaaaaattaaaattaagaaattgaattggatgtatatagacttattataacacaagtactgacacactacattgaggacttcagaaataaacgtctgtgcaattcttgcccttttctagcactgtttggaccactaattcctgcctagaatataaggtaaaaatctgcgacctcacagatttgtttcagggttagtttacatcaaaatgtacaaaagtcccctccttctatccaagaggcttcccaatacacccaacactgagccgctggggtggctgaataagacagaaatcctttaaaatgaccccaaatgtgatctgaacctaaaaattataggcactaaaaagttacaaatcagtggggccatttgaggagacaaactagaaatcttgctggtcaagtgttgcaggttgggttcacctagaaacagaccctgaacaagtgatttttttttttttttgagacagagtcgctctgttgcccaggctggagtgcagtggcgtgatctcggctcactgcaacctctgcctcccgggttcaagccattctcctgcctcagcctcccgagtagctgggattacaggtgcccgccaccatgcccggctaattttttgtattttagtagagacagggtttcaccgtgttgcccaggctggtctcaaactcctgagctcaggcaatctgcccacctcggcctcccaaagtgctgggattacaggtgtgagccaccgcgcctggcctgatttttttaagtgctctcctgggagaaagtagtaaagagggcagggaagtagacatgaaagggcaggcagctaaggaaggatgcctttgcaggtgaagtcccagacttggcctaatccaacagggactctgggggcatcaatcgcactgcagactttgtcctgcttcttgcactagctactggctgtctggccggatgtgaatttcaggcacttctggctctccatactgggcaggtagttccagcgcacagaggtgatagcttgagtagcaaatcaggcggaagctgggagatgagtgcccagagctagcaaaaaggtctgggcaggcactgacagcaccactgcagagtcgctagatttttcagttaattctgaaagtacctcaactctgtactgtgcatgcagaccatagtggctgaggttccctatctgtcagccatggagaggtcactctctggagtagggaggaactactctctgggtgatagaaatattcccacacagaacccagctcacaggctggatgtgccctctttctcctctctgctgcctaactcaggaaataactccaaagacctgggtcagttcagatggggactgaagaaagcacatgtgaggatacgcctataaggtaatatcttcaggaaccctctcctgagcccagggcctcctcagcatttcttggaggctgccaggaagcaactatcctccatgcatctaaatgccgggggagcaaatctcagctacagaaatgacttattcaagggcagtatggcagcgtgggatgatctgctcatccgagaaaactgcctcgatgggaattaacacagggaggaggaaacttccaaagccttccgctgggaaatctttgcctttaatgggaggcaggatgggggtgggggaagaacgaggcggcatgtggtaaccagacgtcacagcgtttcacttttcaccatcaacttccaggacgcacgcaggtgtgtctggcgtggccttcgtccctgccggggatcctggggagctgtggctcagacctctggtttctgcgcctcctcactctccaaacccaacctcgaggttcccccgccgctgcgcaccctgggaagccctttctcaccaggagctctcaccccaatatcattctctccctcctcctccaactcctccgagcccaggtccgacatggtctcgccccagcctggatcacagccgcagcgcctctagcaggtgggtagcaaccgcctccaccgccgcgtcccgcgtcgccatggagacgcggccggtcccgcctccctcccagcccggaagatggggagcggggacaggcgacgcggacgaagcgggaggagccactggcagcctttgcgtactgtcatagcaacgggaagggcacctcgaccaatcaccgcccgggaatacggaggggcggggcggaagggacgaggtggagccagtggcagcactctggtgccgtcatagcaacgaggggccgcttcggccaatcactgctcgggaagcgagggggcggggactgggcagggcctgagcgggttctgtgcctggctgcccaccggctctctgacctggacctcgccgtcgctggcccctgaaatccatcacttttgtcggctgttctgtgacgccacaacgaggagccacctgggtactgggccctcaagaggaaggacgcgggaaacgcgtccgggccaactctcgagagggtttcacccctgcccagtgcgggcactgcccgctcccttccgcccccaggcctcgcaggcccctccggggatgctgcccacccccacttacctttctaggctctgctgacccttcgggattcgcggctagctgtgatgtgtccgccaagatctcttctcttgtctgtaaacaacttcactctcaaggaggcagctctggcctctcagcaggtgcggcctacagtgatgtccgtccgggttttacatccttccccgacctcgacatgagtcccagccccctcgggcctctgactctcaggtgtcccctacgatcgccgtcctctcctctcgctcctggctcccctacactgtcacacacccacacaatcacagacgcacacgcatgtacacgtgcaggcttggaaatctgctttacctgacgcactccgcctgccgaaggcccctcacatctcccatttcctctgccatcatcccagactgcaaagctgtgttatttgttgttgctgcaggagctggggaggagtgactgaataactataggatttggtcttgatgggagaatcccagaagccaaatccacgcggtgaataagctgctgatcttccagagcacacatcccctagagattcttcccaatgctaatatgaaaggttacaaccataacccatcatcaggcccaaatatattacttactgaataaatacacaagttacaacaacacacgagattccaaaattatgtcgttttttagatgcaaagataaaaatgttgtaaacaccaaaatttaacagcttttcttatggggaaaagtggggagttagggataacagatgattattattttcttctctacatattggcagttacccagttactacaattaagcatgtcctatttttataataaaatgccagaagcattttaaatgttagaaatctagaatggtaacataagtatatgcaaataaatactcgttttttacatttaaaatgtcagaaatttagctttcaaatttgtcctaacaatgacagtaaccagtgtttactaagttctgacactgtgtgtgggcactgttttaagaattttatgagttatcttattaaatcctcactatcattcctccattgaacatctaaggaaagggagttatagggggttataaactaaaaataacctcctaagccccaccacagccaactgaatggacccctcttggccaagagggccccagaaaccttaaaaactgcgttctcagccatgatgggaagggaggtcgaacatgcctcactaatacccttgtgcagtttagacacaacaactaacaagcattaatgttaaaatagagatcataagactgacagaatggacgctgtggcagtaagataccaacttacaaacaggacctaaggccatgccaggcatgagttaagtcatgcatccctacacttaaaagaataaactatattttaactacctggagaaggtcttatgactcgtgttttacatcctgtacttgagcaaacaatcttactgtgaatctctcaaatcgtatcatgagttcctcagactgttgatgtactaattaatacgtaaactactgacactgaaaaggatactgatttgtttctgaatcatgacgtttcactgattgtcttgtgcatatgcagaaaacattttagcctgtatgttgtcatctgtagccaatgactgtaacctctatattgtccctccaatgaaaaaagacaactgcaatatgaggagtccccttcccattcctcaactttcttataaaagcactgcaacttgtaacagactttggaacacacccaactttgttggtgtgtcttccccattcaatcttcaaatttggctttcaataagcctttatcaatttccgcctcaacagccttaactttggtcgacagcagttaagatccttacccaagatcatacagctagtgggattcaaatcaagccagctgacccaagagcaactgttgcccatcactatactgcctcccagatctgtgatataaagaaataactatagttttctggcagtgactaaaccatctaccaagcagaggaccactagttcaaatgccttggattgcaaacaccagagagtggcttaagcaaaccacatggttaagcaaaccctgttctggatcacatcattagcagctagacgtctagctatagctattaaatcctaaggtttacaatttgatttctatcccatacgaattagccagggtcttccctcccaaatctttcagtcaatctatagtaatttcaccacactgtgggtttggcaattatccaaataattgacaccaaaggcaagaaggggtgaacaacaggatgggcctcccggcatctcctgcagcagcacctggactggattctaaattcctccttccagaaagaagctgcatcccagcccagatccagctgagagccacagctgccaagaggcagtcggagctctgggcacctctctgtgcacccaggaagccccaggaggacttcatcaagccaagtcgatgcctcactcagagccccaggatccctgactcctaaccccacagtgacctggaaatgcctggtgatgccagaagcagcgctttccaattctgaaggccctcaaaatgcttgttcagcccaccttcctcctttcctggggcgtgggagtggtggggagatgagaggcagaaagatgaggacatcatcaggaggtttttccttactggaaaatgagaggaaatcctctttcactacttaaaaatcaaaaggggctgtccatattcctctggcaggggtctcccatcatcccccgcgaggcattcccattatcccctgcggagctttcccatcatccacagaggcccttcccataacccccaagtgggaagttcgcgcaagtgcggctctgcagggaggagggagggccgaggggaaggccctcgagagagtggagggcaacagtggccacggttcctctgtacttcgtttcttccgtaagaaatgatcttcttgtccttcttaagtataaatggagcgatccatttccttttacccattaaccccttcaaaaagaagaaaaacagtcccaggctggccatggttgatctctgcaggggcgctggtcagggtgccttctgcttcctggtgggatggcctaggccggggaaactgttgaaaccaccctggggctgccttctgtattttccacaaccttccaggcccacctcccagctggaggccctgcagcttggcagttgccatggcgactgagtccctaagtgtgtctcttctgagctctcctggacagtgtggagaaaaggccttaagaactgaggggcttcagtaaaatgcaaacagattttttttttgtaggcactgttcagataaaaagcagggactttcaacaaaatgagttcaggtccatcttaactatagaactatgaggttgtttattagaataattgtactctggtaaatttaccaatttcatatatatgcatatttataaacaaacatattagagtatatagatagaaaaagttctatctacatgtagaatcgaaaactttttaaaatagtgttggtagtatcacacattgccatttagtggatagagacagacccgagattggagccctagctccgtatacttctttctgaagtcagtctactcatctgtaaaatgggctgttgtgaggtcaaaattagatattcataatgagagtagcatagtgcctagcacaaagtaaagcacttagtaaatgggagctattactattaattgtactgctgttaatcttacaataggttaagcaccttttgtctatcagtatgtttgggggggaattttaactcaagtttatcttaatcgttttcagtcgtgtttttttcttgaaaagaatcaaactgccaaagatgattctgtcagttgtttgtgacaatcagaagttagtctgtgacgaacagattagttttaatgctcatattcattagcactaatatacataagggtggggagagactgaagcttctggaaatatatagacaggtagattcttaagcgtaagtaggtatttgaactgtttgtggattatgtctcataaaattggcacccagcaaggaggaaaatgccagatacacacacgcccatacctgaggtatgtaggtcaatggaaggctattgaaacacagttgtcaagagagaaatgtaaagtatttttcacccaggaagtgagattattcagtgatgcatcaaaaccagtagggaaaacagtttagtggacaccagtgtggagacgagatgtcagaaaattggatagactcgaatttcacgttgggtagcaactcaaggacatagctcagtgcttggcacatagtaagtgctcaaccaacacaggtttatcaaattaaatgttagatattattttgcaacagagctgtgctttatgcagcagtaggaaaagagaaaaattgacgtgaaattttttctttttcttgtttttttattcttaaatcacactccattttccgagggctctctcaggatatcagttgcttaactacgtctgagtgtcttctaggtcgagtactaggggattacaaggaaatgagaaagaaattacagacccattggggggcaaattctacattaatctacactgttaaaaaaatttaccagggccgggagcggtggctcacgcctgtaatcccagcactttgggaggccaaggtgggtggattgcctgagctcaggagttcaagaccagcttggccaacatggtgaaaccctgtctctactaaaaatacaaaaaattagctgggcatggtggcgggcgcctgtaatcccagccactcaggaggttgaggcaggagaatcgcttgaacccgggaggcagaggttgcagtgagccgagattgcaccattgcactctggcctgggcgacaagagacaagagtgaaactctatctcaaaaaacaaaaacaaaaacaaaactattatgccttctggctacatgttaatccttcattccaaagtggaggtcactctttcctactggtggatatgtaaggctggttctagttttgatgctgcagatagcctcactctaaccagcagttgtggtgggagatcctgtgctacatggggctgtacttttcaaggtctaagggtggatcagattttctagaaaagggacagggaaaaaggtggcatgctgaaccacgtgtccatgattttcccagaataaggctccccctacccaacttacaggaaggtcatgatcaaataagataacgaggatgaaatgatttggaagtgctatagaaatgtaacgtgtatatttagctcaggttttaaaatcttttaattatgtaacatttgatgcatgcaaaagaacacatattcacgtatgccagcaaagtaatacagtgaacacctgtgaacccctgcccaaagtaaatagatgaatgagtaaatgaaataaatattaacatctgaatgcatagatctttgtccacatctcaaattcagctctttggattgcagctttatagaattgagagattgctgagcctaaatacatgttgctgcattgcctccgagaatggccggacctatccccactctcaccaaaacagagtgtgggactcactgctccctcgcctactgtaagtcctatttttcttctttgctaatctgatggacaggcagtgtctcatagtgactttagtttgtattcatattttctcgattatttgagaagataagcatttttccccaaatgtttattcttcacctatgataacccttgttaattatttagattagttttttgcaggccactttcatatatctgtatatgttgttttctctttctgaaatgtgatgcccatgtttctctacctggtgaacaatttgtcaactttaatatcttaccagatgtaaccttcctagggatgctgtttctaactgctgccggccccttcttaccatctctctggttgtgcttctgacgcattccctacacaactggaacgtgtttccaggtcagcctccctaagcacctcccaaggcctccaccccacagtgtcgcacagaacttgacacataccagatgctccaattattaaatattactgagtacttttagaaaattgggaacatacaataaagtataatgaagaaaataaagaaaaccaataatctcacttcccaaagataataactactgccattttggtgtgaatcctttcatgcttttaaaatgcatatatatgtctatttaattgaaatcattctatttgtcacttacattatcacatgtcattatatggtgcacatgtcaaaaaaaatttccaaagtgttttaaagacaatagtatttcaccttaaggatataccaaaattattatgtcacaaatgttggataagagaatgaatgaaaatctttaatatgaagttgaacaaggtaaggggtattacttaaggaaattatactcctttttttttttttttttttgagacaaggtctggctctgtcatccaggctggagtgcagtggcatgatcacagctcactgcagcctagacctcccaggttcacgtgatcctcctgcctcagcctcccgagtacctgggaatacaggtgcctaccaccacacctggctgattttttgtattttttttgtagagacagggttttgccatgtcgcccaggctcaacaacatgtggatcaagagatccactcacctcagcctcccaaagtgctggaattacaggtgtgagccaccacacccagcctccattttgtttttaagaaaacaatgtgtcgggtgtcttttctcagtatgtcattcactcatgtttcttgggtgactaccagaagttcctcagctctgggtactgttgctgtcctcctctcgtggcgctggcatacctgcttgtttgaattgcctttctcctctcctcaagcccatttttaattatctagttactaggacaagcatctaaatagttgtggagcaaatacagttatcggaagagctaaatgaaccatttccctctccctctacaaacaggaaagccagaaaggttttaaactggactggtaattttaggttccccagagctggctttgtgctatctgaccactgaggccctgcactgggaggaaccagacggggcccctggcaaccacatccgggtggtactagaacatctcagtgctgttatctatgaccccagaacagagtctcagttcaggggccctaaaagagtttccccactgaacaagcatggaaatgtgaaaatacgtatttattaaacaagataagtgaagattgtttcatttagaatgtgattcactaatgcatttctttgattacttagttatcttggtatgttcaaaatattgtggctttctttttagcagttctttatattaatacatttaaagagggtcccagaagggcaccaggctttaggatggctagaaatggggacatggcctggtcattttgggtcatcttggccctggtctcagttccaaggatgtgttggagagagtataggggtgatagcttaggaaaactctccggagtgaagaggcagcttggctttattaggttgttttcttcaccttaatcctgaaaaccttttcaagctaactggcagcaagttggacatcgaggtatgtgtttagttctagaaacttctctatgtgtgtcatgatattttcttttgttactatcttaagtcatgcacatatatgatatgtattacaatgtagtagaaaaagtaaaatttatacagtaaagggagaaaaaggacccagaaagcaagaactcattagcctgcctgtgcccagcatgaccctgcaagacaggcgtcttactcccaagttcactaccagaataaatgaattaattgactctaaaagggttttgagaacagtttcaagttattattgcttatgcttcctcccctacattccagatcccacaaagaagccacttcttgggctgacctttttatcatccacctcaaactcaacaagggcaaaactgaacttcttctctccgctttatttccttatcttaatgaagggcccacttgctaccggtttactaagccagaatctgaacatcatcaatgtcagggaccagttctttccttcccccttccccaaccaatctccaaatcctggagagtcttccttccaaattattccaaatccatctacttttttccattcccactgcttcttccttagtcaggacaccatcattttctgccaagaagacgccaacagcccaggtggtctccctgcccttagtctcactgtcttctaatctatttgccacactgaccagaataatcttttaaaaccacacatctaatcacgttgttcttcagtttaaaatctttcagtagtgaagtccagactccctcattcgattattaggctctgaatgatgtggccactaagtccctccccagcctcttctcttgccttatgttcacacaccacactctctgctgtggccataatgactttcagttccccaaacccaactttctgtaggattgctgggcctttgcctatgctgtttgttctctgcttggaacaccttccactcttcttttgggtaactcgatgccttctccaggtctcagctcagctgtcacttacacaaccccataggcaggctttatccccaacccttgtccacagtatcctccaggtgactgtgtctcccaggtgggtagcccctgaagtaaccctctacactccatcactgtcagagagttggaaggctggagaggcatgacccctcagagtcaacctagatccttgtggcttcagcccccagcaggtagggagcccaccaagcttcaactctacagcagagacacagccaaggctactggtatgtgcaaaacattggcttgtgaaaattacagtatccaaaacatgattttttttctaaaagagctttttaaattttgttttctaaaagttaaaaccagaaaatttctgatttctgacaggttaaggatttaggggaatttttaagttatgtgatgtgaggttctctgtagttttgtaccaactagattgttcatttcctaagaatgaggacctctcctattcatctttgtaatagggacagtgtcttacagatgaaaacattcaatgaccctacattagaggagaagaaactggagcacaaattggttgaatgttcccccatgtgacacatttaataaggctaatgttgttgaagtggaggctgggcaggcagtaagaggattcccttgtatacttgcacggtgaacatgagtactggcatcgcaggcctcgttcaatgttgatactcttgaatttaaagtggcatttccatgtactcttacagatgttccttcatttgccatcagaaggatagctgtgaagtgatatataggaactttgtaggcatatttgatttttaaacctctattaactttgtgtcaaataatcaaagcttaacaggatttatattaaggatggtgagagggaatcaaacttcatttttagagaaaaatagcaaatcaaaataagctgatgaaagggactttgtggttctctccttccttcagctcctgatatgaatcctagactttttacatattcatactaattagctgtgctttccaataattagagtagccataagcatttgtacactaattcacagttcctaaagcattcttaggaatattagcataaatgtttattgaatgtctcctgtgtgccaggcatgattctatacatgataaggattcactgatgaataaaaccggttaaaaaatctctgctttcatggtgcctacattctaacaccttactttccccattcatccatacatcaaccccacagaatcacactaggaaaactggagttcaggagagtaaagtgactttcacagggtcccaaaaatagtaagtttggggtcacaatttgaacttgtcactccagattccaagtcccatgcctttttttttgctaggtcagtattcactgtggaatcataactgatactcaaaaacatgatcttgagtaatattcaggaaagaatatcatattcaataagttgctttttttttctttttgagacagactctcactctgtcaccaaggctggagtgcagtggtgcgatctcagctcactgccacctctgcctcctgggttcaaacaattctcctgtctcagcctcccaagtagctgggattacaggcacatgccaccacacccagctaattttttgtatttcagtagagacgggatttcatcgtgttgcccaggctggtcttgaactcgtgagctcaggcaatccacttgccttggcctccgaaagtgctgggattacagtcatgagccaccacacccagcccaataagttgcttttattattgagttacataagtcttttttagaaaagatttaagatacaagagttaaatactaatggtcttaaccataagagttaaaactataaattaactggaaaggagcagctgcctagaggaacccagggcatgcgccttctgatggccacagtgagtgctgaggtcttcagtgtaggctgtgagggggactggctgcctaaactgtcagcctgtggtaagtagggtagattaagctgatggagcagaaagcctcaccatccaaagccatcctttcccagactccatgtctggtgggaatagataggcaacccgggaaagagtactaaagtgtgtgtcttagtccttttgggttgctataaaggaatcctcgaggctgggtaatttataaagaaaagaggtttatttagttcatggttctgcatgctgaacaagaagcatggcaccagcacgtacttcttacgaaggcctcaggaagcttccattcctgatgaaaggtgaagtggagcaggcctcacatagtgagaggggaaggaagagagagagcatggagggaggtgccaggctccttctaatcagtgctcacagggactgatacagtgagaactcacttactactgagaggatagcaccaaaccattcctgagagatctcccccgatgacccagacacctcccactaggtcccacctccaacagtgggggtcaagtttcaacatgagatttggaggggacaaatacccaaacaatatcagtttgataaagaggatatgagtaatttcattctcccatcagacagtgtttgtttagaagaaaagtaccatgtccataaatcatcaaatgctggcccagagggaactttaaagaacagccccttgatttaagccacacagtttaccaaactataactggactgaagagtacgctcttttttttttttttttttttttttgaggcggagtctcgctctgttgcccaggctggagtgcaatggcgcaatctcagctcactgcaaactctgcctcccgggttcaagcaattcttctgccgcagcctcccccgtagctatgattacaggtgcccgccaccatgcctggctaatttttgtatttttagtagagacagggtttcaccatgttggccaagctggtctcgaattcctgacctcaggtgatccacctgcctcagcctcccagagtgctgggattacaggcatgagccaccgtgcctggcctaagagtatgtctttttgcagaccccataaaaattttccaacttgcttatctcatgtatttgcactagctcaactgcaagaatgactccttagttgatgggtcagtttcctatttccacatacctgacctcattctacctataggcataaactcaagaggaatttacaacagatgggctcaggcaacaagttagccccagagtggagctcagctacagaggaatgcttcactgaaagaaatgtgagtccctgaatctgattcaagcctttatcaagtcctacttcagttagaatccagtttactccccaaatacccgtgagcactctctcagttactatttcccttgctacacatatagaagaaaagcaagaaagttactctgctgggaaacactgccaaggggtcttagaagcaagaaaatttgcctattttatacaggtagtttaaagagaaccacccttataaatgggtgtttgtccccttattatttcaggacacttgaaagctcctctcctccaatatgtctctaattcaagtatcacagtgtctaaaattctaccactaaaatgccattacctaaattaagcacagccttctgtctttatgttgatatttctttaaatatcatgccaatagttttaaaatcaaatgatactaaaggtatataacaacaaacagtcgggcctggctttatcccttcaactcctctgtctcattcccctaccattttctactcttttacccatttcttctggtagttccctatatttctaaataatatgagtaaactatgatttttatgtccaattttaaagcttttctatggacctctggttttagagacaacatctagttctcttacatcccttgccacttcccctgatgctgtaggacagacaggtctgtcccacccacggtgactcagtcattgttgttcatggccgctgcccgttcttcacgatcaaggaggagaattctttggaggaaacagagctttcatacgtgaatcgactgggaagcgagtcaaaagtactgcaactggaagtgtggcatggggagggggccgtggccagtctcctcactgggctcctgtaggactgggaacgcctactccttcacacctaattatgtttgctggattgggttatagttcttcagtgtgtggactcttgtcagttttatatccgtaggccgagcacaatgcctggaatacagagcatgcttaataatcagaggcttttcattgtatttcttatcaacaacactagtaactgaatataaatcacccttcctcgccagtcagtgcaccataccattagaattcttgctttttgatcagtggagataaaatgagtttcttttctccatgttaagtaatcaggttctgattttcccttttctttctctctaatagtgtttaatgctctaatgctttctaagcatgaggtattttcttgagctctgaagcccagtatcttcaaagcccccttcagggaaacctcagttccctgtcagtcaaggcctgtcactggctttgccttggccttctctgggagaatgtctgctccttaagttgatggcatacaagttgaggtggggaaaaattaaagtgtaggatttctgtaggcagctaatgttttattactggagtgcagtgatgcgatctcagctcactgcaacctctgcctcctgggttcaagcaattcccctgcctcagcctcctgagtagctgggactacaggcacacactaccacgcccagctaattttttgtattttagtagagatggggtttcaccatgttggccaggatagtctcgatctcctgactgcatgatctgcccgtctcagcctcccaaagtgctgggattacaggcgagagccatagcgcctggcctaaaatgtattatataagcatcatagtgaccacaaaacaaaaacctgcagcagatatacaaaatgtaaagagaaaggaatcaaagcataccattacaaaaatcatcacattagaaaggaagatagtaagggagtaacaaagcaacaaaggaactacaaaccgccagaaagcaattttttaaatggcagtagtaagtccttatcaataattaatgtaaatggattaaattctgcaatcaaaagatagaagtggctgaatggatattaaaaaaaaaaaatctaggtgctgcctgcaggagactcagctttaaggatacacataggctgaaagtaaaggcatgggaaaagatattccatgcaaatggttaccaaatagagagcaaaaaagatacttatatcagacaaaacagactttaagtcaaaaacttcataagagacaaagtcactatatcatgataaagagataaattcatcaagaggatataacaattataaatgtatatgcacccaacatcagagtacctaaatatatattaacggaactcaagagagaaatagcaatacagtaatagcagggtacttcagtaccccattttcaacaatgaatagatgatccagacagaagatgaataaggaaacagtgaacctgaataacattctagagcaaatggacctaacagacatacagaacactccttcccccagcagctgaatgcacatttaaatgtacacagaacattctctaggatagatcatatgttaggccacaaaacaagttttaacaaatttaagaagattaaaatcatatcaagtatcttttctgaccacaataacatgaactagaaatcagtaacaggaggaaaattggaaaattcacaaatatgcagaaattaaatacacacctgaacaaccagtggggtcaaagaagatatcaaaagggaaatcagaaaattccttaagacaaattaaaatggaaacaacataccaaaacgtatgggatgcagcaaaagcagtactagagggaagtttataaagaaaatgtggtgtatagctgtatctacacaatggaatactatttagccttaaaaaagaaggatttcctgtcatttgcaacaacatggatgaacccggagtacattacactaggtgaaataagccaggtacagaaaaacaaatataggccaggcatggtagctcacttctctaatcccagcactttgggaggctaaggcaggaagactgcttgaacctgggagttcaagaccagctttggcaacatatcaagaccctgtgtctacaaaatttaaaaaattagctgggcatggtggcatgggcctgtattctcagatactcaggaggctgagggggaggatcacttgggcctgggaaatcaaggctgcagtgagccttgaccattgcactcacgccactgccctccaacttgggcaacagaacaagaccctgtctcaaaacaaaccaacaaacaaacaaaaaagaaaaatatgcatgacctcacttatttttggaatctgaaaaacttgaactcagagaagcagagcatataataatggtggttaccaggggcagtaggtgggagaaatggggagtcgctggccaaagagtacaaagtttcacttaggaaagatgagtaagttctggagggctaatgtacagctctaatgtatagttagtaataatacattgtatacttgaaatttgcaagaagaatagatcttaaatattctcaccaccaaaaaaaaaaaaataatgtgaggtgattggatatactagcttgactgtggcaataattttacaatgtattcatatatcaaaacatcacatcctatactacaaattatgtaatttttatttgtcagttatacgtcagtacaactgggtgggggggagggggggtgggaagaagctgtctccatatgaggccgaggtgtcctatatatcctgagcttgtattatcgcctttcaagtgtaaaacctgtaggtgatgggatgcccgaaaggtttgaaaatcaggaatgacaagatcagattttgctttaggagggcaacttgaggcagcttaaagagtggattgcaggaggtagaacttggaagtgagaacgctgttgcacaagtgcagtgagagaggggtagcctcgagccgaaccaatggcaagggccagggctggggagaccattggagagaggggtgggagccacactgggctatcaccgggaatggagagctagaaaagagaggagaaagcactggcacagggggcctgcggagagaaagaaggtctgaagaaaacctggccaaaaggagaagactggagccctgggccatcccgcttgcggaatgaggggccggcgggcttcctggggctgaaccctgcgtggcaaagaagtgggcaggttttctttctgcctgcagaaggcttctcaaatgcctaacaaagtgatggatttcacgcagcccagctcagcaaagagagacacagacatcagagtgttctagaaacaaagcagggccccagggggaaactgcgaggcctagcagggcaggggagccaaacacagggaagaatgccttctccattctccagagggaagctcaacgtgcctggggaagggtgcgaggggcactggcctgttgggacatttacagccaggcctcgggttggttttatccttaaacattgttttatccgggggcaggctttttccccggaaaatttccgctctgcctcactttgctcttccccgaggagtgggctgggagccccctctgctctgaagccatcctgggggtccactgtgggtgttcggcagtagcttctaggggactggccaggcccctccctggggctgcctaaggagaagagttgtttctggggtgacgtgggagcctgtgtgccagggcactggcccgcaagggtaagaacccggcgggctcccgcagcctaacagggagctgcctctgtcacgtgcctgcgaggtgggacacaagttggcttacaagttggttcgacatagccaaatccgcgtgccgcatttccacgctatggagtgctagtcttcatgattgtgccccttgacatgacacaataggaatagaagccgggaggccaagcaaaggccctctttgggggtgggggcgcggcggcatgtgaccctcgccgcctgtggggaagacctgccttgaggacagagcgccaggggtgcagaggccgcctgggactgcccggaggccggtggggagcgcgccagcgaaagcccgtgcgccctcggagccggggaaggcgcgggccatgacccgggttcgcccgcaaaggccgggcagtgccgcaaggcgtgggggcgcccccgcccggtggccccggggctggtgcgaccctgggcacgccggggccggggccggagccgggggtcgcggcggccggggagggggaggagccgcgcggctccgccggcgccccgcgggccagggaaagtgaaagggcggcggggcctcccgcgcgccgctccaggaagtcgcgagcaggaagcgcccgcggcggccgggccgggctgggctgcggagcgcgggcctcggcggcgcaggtgaggcgcggggccggggccggaccgggaggcggggaccccccgcccccccgcccgcacctgcggggcagccggcgctcaggcgccgcagccgctcagcacctgcggcgccctcagggagccgggcgcggggccctgcgcactcggagctcggctcctctccttccttttcttttttttcggggggaggtgggggctggtttggatgttttccgagagccggggacggtctcaagctattttcgcggagggaagtctttgaaatacgacatctagaagagtggccctcggcgacaatgccgggcgttcccggaccggggcaacgctgggattccggggaagtggaggcagagggagcgggcacggggccggcagccgctccacggagtccccggcaggggcgagcttagctgtccagccgggtcccctgcccaccccggcccgggccgcggtgacagctgagggtccagagagccggcaggaggggaccctgcgcattgtctgccgcgatggggacgtgggcgtgcccgcggaattcacctcctccggggaccagccgcccagggaggagccggcacagaacgctggctcggagcgccggcaccctgggcctttgcgttgtttgtcggctgagcagctggttcccggagcccgtgggcctcctggccaatgcgagtgacagcgaccttctgggtttataataaagggcttgacgcgccggaaagtcccctcgccgctggccaccagccttccagcccttacggcccacgccgtaatcctggtgaccgagaaggtacgttcagtctaaggatttgcatttgaacgaaggatactggccaagccccttaccacccccactccccgctaacaccccagcccgcggccccaggtttgaatttccaaaggaggaattgctaaagcctgccctttccgggtctcccttagctctttgcctggaaggtgcctgcctgcctgcctgccggcccttgaacttaaatcgtctgaagttgtgtaagtggataaatattttagacttcccccgttgtttttttattaatcccctttgagagcaagcttgaaaacacctggccccagacctgtgattcaccaagtcattttggacctgcatttacacgttctgtttcatgcagcccacctgtgatgttctctttgttgggggttggaggcaggtaagggaggtggtgcaaatggaattcaggttccttgtacttcagccaaggggaaagagatagtgaccattttcattcatctttaatatggaaagcgcctttaaaagcaaaaagccatagaaagagcacactctggacaggaagttgtattctatctcgtaatttaaaaaaaagaaaagaaaaaatgcatgaaaacttttggaggagaattgcatttctcacccatctttgcctgtaaagtgagacccagttaaaaaaaaatgtcataaagtagattatttaaaatatctgtggggccgctttgattatgtgtaatgccacctcagccctaaaaagactgaggaaccttactcctgctattgctcacttcctatccccattatttgagtctctgcagattacttggaaccttctaggcagcgcagatcacatgtgggtgggtctgggagtggagcttgtgaatgtttctttcctcagcttattctgttttacagttgcctagggtgggttttttgaagaaataggtataaaaccatgtgtctttcagagtctgtttgtttttttaacttttagtttcaggggtacatgtgcaggttttacaggttgtaataaagatgctctaatgggctgtttcctaagttactatctttttatatttttttaagacagggtctcgctctgtcgcccaggctggagtgtagtggtgcaatctcagctcactgcaacctccgcttcccaggttcaagtgattttcatgcctcagccacccgagtagctggaattacaggtgtgcaccaccacgcccagctcttttgtgtatttttggtagagatgggattttgccatattggccatgctggtctcgaactcctggcctcaagtgatctgcctgcctctgcctcccaaagtgctgggattgcaggcatgagccaccatgcctggcctaagttgctgtgtttgacagtgcaatgaaactggacattctgccgcttttcctccctggaatggtaagttccaggggggcctgtagagagtgactttttaaaaaagtatctcttctttttatgtacttgggcagtgtgccaaaaactgggtttaaaccaagtgatttgctcccattctgctgccctttctctgcaggggatgggcaggaagaagagtggctggagggaggaggtggctcagagaaacaggacaaactggaatctgccccacttatccagctgacccaggcgagccgcctagcctcatttttctcccttgtgaaaagaacgccctgcctcttcagggtggtcacggggctcaaatgagagcatgtcagtcatggttcgtgcttccagaggtcttgacccactcaaaatgaagtggtctttagtggtgctgcacaggctagggaggaagggcctcattagttgagctcttaacatcccaaatgtaaaatcactgtctttgcacatcttaactgcactcactatgagaatttatagcacttttctttcacccattttacagggaaaagaatccatcattgttttaaaaagaaatcaaagaggttttttttcccttcttgatttgtcagtgccttctgggcctttgatgttgttgtcacaggttttatcagagttggaggtttttgatttatttagtagatggcaatggaatgtttccagacacgctggacatggagaagcagcacttgagaggaagacgtttgcttctgaccatccgtttccagacactgttgaaccaaattctttactctgaagttgtcatcacaaagtcatttcccagagtagatccagacccattctggagcccacccattttgagcaaaatattgcttaaatctagaggtttgagcagacgtggttttgaagtatttgtggctgttcattcaacgtgagtttcttgagcacgtggtctgtgctaggttctggacaaggagatggaagtaggaccttgccctgcagtcccgggccttcctcttttgaatttacaatgaggataatatcagctagtgtttgttgcgcatttactacgtaccaggccacttatcaagtgcttcccataggttatctcattgcatgtttataacaacatggatgctatcatccccattgtttagccttgaaggagagggagcagaaaggttaagtgacttgcctcggcttacacagcccagggtcagccttggaaggaggaggtattggagtggggtgaatcccacctattcaggccctgtaggacctaggagaaaggtgtagttctggctggagcagatagaagagatgaggggcggctcctgggacgaaagctcagcagggattttgaatctttttgtaaaaggtggtataagggaaaaatccttggagaatgtgcatttttggaagctcactttcgagggaggcaaaagtgaatgtggggaactgattggctttggaggacgcagtgactcaggaatgtcatgagtttgacattgggatgggagaccaggcctgcctgctgtgctgggccccttctcagttctctggcctccctccccattccttcctatattgctctgccttcagccctgacttcataatcaggtcattttctgtgacctctgaggtgaccacaggagatgaaaaatgaagaggcagacgaggcaaattcattcctcctttggattcaaatggcaaagtcacaattaaatgattggtttgatctgccctcttgtctaggcccacatttctctgtcactacggttcaaaggtggcctggtccataggggtggaactgaggcagtccagtgccctggcatgccttgatatctgggcacatagcgtggctgctggacacatacttggttttgtgaatgggttgatctctagatgcctcccagatagagatgagttccttggttcctttttatccaccatcagaacattatttgaaattcatttccaggttctcagaacaaaccgcctcaagggtagatactccacctcactccccctcttcctagtaacactgctggtgggggcccctgcttgtatcagacgtgcagctttgatcaggactgggtactgctactgtacgtgtgtggttacttctgccagtaacgctgaaggtgtgaatgtcacgacactggactctgaatgcctctcctcctccttgtagagagcagagccactgccagaaggaaggggacaagacccagcaggacaccttctttccacgctttccagcctgtgggagcggcaggggcaacagagagaggatctggagccaggattaatgactcatttatgaagcatcttattctgcgaccgaggctcagtggtcagtggcgacgtaaatggctcgactccccgctggcattcgcttcatcatctcattctccagggatcagtggtgagtcctggtggggcaggcccttggcatggagctgtgtataggtgagggctactgtgcaggtagttgtgttgccccagtttcattataaaacacataaaacttgaatcactgacctcacccataaccgttgaattgctttttggtggtggaagccgtgacccagaacagtgctgaggtgtcctttgtccttggtactggcattgtcagatagtgtttgggctcccgcgtggtctccagtggtttctctaagaaccatggtccctacagaaaaatgaccactgactaccagcagggttagcaaatggctgtggtgaaataagcacataacttatatataagttacacaactctgagatcagatgagtggccttgccggggcagaactttcagagagaaaatgaaatgttctggtgcagcccagaatgctgctttccgttcagagagtgcctcgccttgcatattctgagaatccttctcttaggtggcctcattaattccattctccttgaaggaaacagttgacaagcccagagtctgaagctgggctccctggcctctaacttgtcctgctgacctcttctgggagaggaaaaactttgcttctaccctcgtaggttctgttttgggggacctgggaattaaactgacaaaagacagactagcaagagaaaagacagatttcaccacttatgtacgagaggtcatagaaaagtgtccctcaaaggggcatttagaattctgggcttatgcaccgtccgtccttcacaggggaaggggagtgagagaaaggtacctgtgggcaaacgaatggctttttggaaagacaagtgggccctcaagagaacagagaacagatgggcgatgtggtagttttgtgatcattcctgtttcagtgcagtgtggaggcttctcatctccagtggtaagagtcctgtttccctggcccctcctaagggacaggatttatagcagatggattcttttgacttcttttggggaactctgcttttcagtagctaagagaattcaggaacgcaaatgccttctgctcaaaatgattttgatgccacagcggcagattctgggcccattcatctcctccacgccaaccccctggcagcccccagccctgtgcagcttctcagccctgctggttggtggagcatccacagggtgtctcaggtttgatttgagggcatctgtgttcttcaaccagattgcttctcttcttgacttatttcatgtctgctgtgagtctagccacaagtgcctgaacacttaggttttatttagtgaatgtctagcttcttcattttgtaagtttattttgatataatttcaaactcacgtaacttactaacatctgtaagaatgttcctgtagaaccgctgtatgtcaaagattaacatttagcctcatctgcttctctccctgcccctccacagtgtgtttgtgtgtgtgtgtgtgtgtgcatgtgtgtagatgtatgtttgtacacacacacttttctgaaccacttgagagtaagttgcagacatcataccctcttatttgtaaatacttccgtgtgtatttcctatgaataagacattctcttataaaaccacagcaaaaagatcaaaatcaggaaatttaacaccgataagatactgttatctaacccacagtccatgttaaaaacaatatcaaatgtcaaatatctgtgatagcatttcttcttctgttcaggatctagttcgggttcatacattgcgtttaattatcctatgggtctcgtctcttcatctagcactgttcctcggccttttttcatcttttctgaccttggctttttttccttcttcttctgagacaatggccttgttgtgtttgaagagttcaagccacttattttatagaatgtgccacattttaactttgttatttcctcatcctcatgattagattcagattatgcatttttgacagaaatcccatagaaatgaggcagctttctctttaatggagaaggagctataggcatgggaagagggaggggaactggaaggaactgagtgaggttggattggaatgaaagttctcgggataaactggtgatggtcgatatagaaatagagaagggtgtgtgtgtgcgtgtgtgtgggtgtgtgtgtgtaaaatgcaccccgctaggaggtcctgggaacagtaagagcactaaagtgagcacactttggtccgggatcttggtttctgcatggcatctcccactaaaaggagccaggagtccttggagacctggccaatgccaggactggggcagggcaaggaatagatgagcccagaacatcttgtgccagaaaataaggaagtacttacaaacaaagggactctgacttgtcaaatctaggacaatctgagatttacaataaatgagactcatgaatgatagcccattgaatagcgtaagattcggcgagtcctactgatataactaaagaagtaggagaaatgcacgctcgccgtacagtggaagctggccgctaggtggagcggggatgtggagccgctgcagggtacccagcgcaggcacagaacgccatggatgcaccccgtggggcggcagcttgaggaacaggatatctacattatctcaaagcaggttcccagaaattccatattcattacttagagggaaacgtagtggtttcactgaggaactatgaggcagacagcactttaaccaatgaccaacgtcagtgtcactgccctcctgcaccttctgacgggatactctgaacaggacatggcatcgcttctctgtctcagaaaacatagacagaattacaaaataaaaaaggattttgggagggctgtttggcttctgggggtttgagcccatccatgctgcagagtgaagcagaggatgtctttggactaatttctgcaccaaatcatatcactcagtaattctcaaaagtgtttctttattccttatttgcatgtgattgaggtaataacagtcaaacaaggagacagatattttgcatggagcctctcaccctaagcaggctgccattcacctgagaacacgtggtcttccagaacatctctgaggaggcccagaggggcacccccatctggtgctgtcattgctgagacctgcttttttgctagaaatgtgggatttttcatattggtggaagccaagcatgctataagtagtcataactgcaaaaagtaagcagaacactgaggagcagatagattagatcatttatttttttattgtatttgttttatattcataagtctaaacataacacaaaacaaaaatgaaaggattatattagcctcctggggctgctgtaacatggtaccacaagctgggtgtcttgaaacaacaggaatttaccctctcacatccctggaggtcagaagtccaaagtcaaagtgtcagcagggccacacttcctctgcaggctccggggacagacccttccttgcctcttccagctcctgctgctgccgccgttcttggctggtggctgcatcacaccagtctctgcctgtgtggccacgtggcctcccttcctgtctctgagtctttgcgtggccttctggtgaggacgccagtcattggaatgagggctcactctatctaatatgacctcacctgagctaatcatgtctacatgaccctatttccaaataaggtcacgttctgaggttttgggtggacatgaaattatgggggatgatattcaacccagtacaaaatgaacaaaaggaaacatatcatccaaaacatctgctttataaatgataaagaaaacgtagatagaattacgaaataagaaaggacttcgggagggctgtttggcttctgggggtttgagcccatccatgctgcagagtgaagcgtctgcctacccagaggccaggcgtatcggggtgacaaccagcaaggcagcggcccgagtgtggctgccgcggtttagcaatagtcacgggagctgaagtcagacctttcaaagaggaaagtctagcctccagccactgcgtcccccatccccaagccccaagtcctaagtacagaagatgaagaaatgagagaggaaagacgaatttggaaatagaagtagagttggcctgacaccagctaaataaatacagcgttttcctcttcagtctttaggaacattccagtttgctgtgtaaatggacccttcacccaattctacaggacggcttctgtcagcctggctacaccgtggcagtgactcttcccaaagggtctcattcattaaggtgtctccctccacacaaggctgaactaaaggttccagaggcatgtgctgccccttgtgtgctcctcagtgttctcagggcatctctaggcgtgtgctgtgagcaccagccgggagtcaccccgcagaggaaggcaggagcccagaacgcatcaccagggcctgatcacccaagcagccctgaccattgggaacgcggtgtgtgtcggggcctcagcactcttcagacctcagcccgacaaagggagacagccttccttctgggctgtctgggtggagagtggagatgtgaacccacagcccataggacagagctgctcttctcaaaatccttcctagctgggtgataacacctgtagaactggcactgtggttggagaatcctcctgcatggagcaggagagatggtccatggacttgtctgagactggggaggtgctggaggcaacttggcctgagaactttgttcacctgttttgaggagattggagaaggaaaccctgtactccagtgagggccgatcagggtcacccatcagccttacttgccctagtcagctccagcaggtggggtggaagtgaccagtttgtcaagctgtgggctggacaagtgagcattgagggccggtgaagcccagtggcctggaatcttcctgcaccagcagtcgaaggcgtgagaagcagtggtggcctaacagagagcttcatccaaagcgctgagactttctttccttgccagaaaggatggttttcagaaacacgaggacagaggccggggcttctggagcaaatccactgtacccacatagcctttgttctttgggctttgggataaatgataggctcgccttttagggtttcgcttttttcccatttggcccttgccatgggcttggagaggaagaattggagaaaggccattggaagatagttccctgatgaagaagagagcactggggaatttctgtcttcagtcagcaggtattctgcgagttggtttggtttggttccttccccaaaggcacaggcattccaaaggttgtagttttgtgtcacacggagccaccaacctttctttcccacctgaaatatggcctttttttttttaagaaaaatctggaaatatttatttgacccctactttagctggtgaccagagaagaaggcagctctgggatcctaggattttagttacttgtggaaagcttccctcggagtaaatcacaacattaaaaatgtagatgcgcagctgggagaagcaaccccttatcccagggactctcggaaacgctgcctttctttgtcctgtgtaggacgccgccttaggtaattattgattcaggttgttggtggcgccatttgaagtctcttcccaggccacaagcaggacaggttctccagggtagggagatgtgcctaggacacagaagagctgcccctcgccttccactcctgtcaaatacttctttctcccaacccattttgttgccccaaaaagtatttttctatgcggtggttgagactcttagactggagttgccctttgtcttctttctaaggcaccttcttttcttctttcttcctcacactcatgctgactctttcggctgcttttctcccagccaaactgagcgaggggctttgtaccagtgtttctgtcactggcctattgagagcctgccagcgtcactgcctttttctctttgagggccgtgaaatatttatatgtctgccttgcttgtgtgcttctgaaaagttgcatagaaaccaaagagccaaaaataaatatgatcttaattgcccaggatagcaggctacgccagaaacttgtggttagttttgttgtaaactaaacatttcatcgtgcttgttctgctttgtaaactcaagtgtgcatctcgagtcccaggtttccctttggttacggtttctttaaatagatgaatgcttttgatattgtgacgtaataataagaaacatgcttttggtctctggccctggttctgggcacacagctcctacaacctttagtgctgagtgtctttttgtttgctaatgaggtgactgtggcgggccccaggacaacctcctgggggactggttgccagggcaaccgaccacgtgattagaggttgggactccacccgtggacctctggggaggggagggagcccgcagaggtggagtggatcaccagtggccggtgttctgctcgatcgtgcctgtgtaatgaggcctccacagactccctcaacgacagcgtttgggggcttgcaggctgctgagcacggggaggttcccggagggtggagccctggcgagggcacagcagctccgagctccctgccccatacctcgccctgtgcatctcttcatctgtatgtattctttgtaacatcgtttataataaagcagtaaatgtgtttccctgagttctacgagctgctctggcaaattaatcgaacctgagaaggggttcttgggaaccaccctgagagccagttggtcagaggagcaggtcacaacctggggcttgttgccattggcatgtgaagcggggcagcctcggccggagccccgccctgtgggggctgatgctgactcctggaagacagtgtgagaattgaattcacttagaggacatccagtgtcagctggagaattgcttggtatatggggaaaacccctacacacgtagtgttagaagtatggtatgttgtgtgttgtgcatgagggtaggaaaagcagtctggtttttcctgtctcttacagtgttcagtttccatttggacaaagcaaacgtggcaatattttttaatgttccaatattatagtgacataagtaatattgataatggctgtagaactgaatgaataatacacagcataagaacgtttcagaacacagtgatatgtattcctaacataacttctgttatttcatatcatcctctcccactgttttgtgtttcaggtacagagccttcatttttattttgacatttctgctgtatgcaagttttcacttatctcgaaagcctatcagcatagttaaggtaagaatcatggaaagcactgcctgtcgtctctgtgaggagttcgtcacttgaaaagcttgtggggcagaggatggggatggtagcaggtacatggggaaacagattatgtagaaacaagttattctgctgctttggcttttcggtttccctttgctaaaattaaagtcttttaaatgttttttggatttatactttcagaggtagtagacttttagttttattagttgacatttccagaatttgaaagcttagctaaatatttattttatcttgtgtgactgttccttccaaatgtatccagtcttaagtggttccccaaattccagctcttcgtgcgatccaaccctaggtctggctgcggaggtggctctccattgttcttggaacgctgcatttttgtctgagtgatgggtgggcaggaagttgttaagcaggtgttctactagactttgagaaaagaagattaaagcagacaagcctacataatcaccagttataacctggagaaaagcaggaataattttcttaccctcattgggattacgtcacccggcctgtagaccatcaggggcctgagaggcattagagtctctatcgtagaagaacgaggaaatcatccactgccagagacagtgcattcacagcccagtggcccctcgctcactctccgggagttggcagggacccagctccaggactgcaattctgtgacctttggagctgtgcttcctccactcctgccggtggctgagccctgggtggctgccctctgcagccctggtcggcagaggcaatgcagaggctggctgttttgtgacggtcctaggttccccactctccagcagctttcaggggatgttaaacattcatttacccaaaagattctaaaattcccccttggcccctgataagcaagaaacttccatgcctctcaagttgttgactgtggaaaacgtttgcagacctttgaaaatgtggtttttaagagagaagaatatgaaaagaggtggtgggccttaaacactcatccgcttgacaagaaactctcaaatcagtaccagtaaccagtcattataaatctgaatactactacttcttgtctttctggttagagaaatatacaaacagctcaagaaaatggtaaattataaagatggaagtgactattgaagagacttggtgagcgtgttggagttgaaggatctggtgtagttggggagcttgtgtggggtttcaggattgacctagaaaggttgggtgtggattgtaggggaagaaaaacagctttacaggtgggagaactgccttgagtgctacgtgcagggatgggcatctccatgaaggcaccacctgttgggctggggggctgttggggcagatgtagcgtgtaaggtgggctggcctttgggggaatctttgtcaggccacagctgttggggtccacctgatgactatgagggcccctgtgagccaggagcaagtgggagccctgtcccggtccctctcccggctttcctggtggtccatctcaaagcccccgcccctgactctcgtgtgtagtggtgtccaggccactcaagacttagggcttctgaggaggcggcgtcagggtcagctcttagttcagtgtcataagtaacaatataaataactgccgcttacagagccctggggtatgacaaactgccacatacattacccctgtgatcctcacagcaaccctgcgagtgcccctgtgaggaaattgaggctcgggtcttcgttccccaggcagggctgccacacactcgagaattccctgtgggtcaggctgcctccagggcccctactcatcctctctgtgcctcagggtttgtccgggtttaattacctgagtacagtcccagcatcaccctcagagcctcctaaacgcacagatttcctgacctagcagctgcgatgtgcctgggcatggattggcttgacgctgaatcctgtgggtttctttacctttcaagatagatcagaacatcacaccacatcaaaactaaactttatagtgccttctgaagcgcccgtgtgcttgagctcatgatataaatggcatcaacgaaactgaaagtagtagtgattctgttgacccacaaaacagttgagtgattatttatagcctgcatttcccagaatattgtaagcaaaaccaaagcaaaatgtatttgcttacttgaaattgaaccagaggctgtgaattagaaagtgagtcttattctgttatgtcatttatagaatgacacggcacaccaggtcacatttaagttagttaaatggaatgtttagacttacctttgatcactgctgattaattgtatttttctcgatgatgatgataaaaccagggctgggaggatagtggtgttataagtgcaaccctgtcccttctatctgctgctccagctgtggcctagcctcaggactcaaggcaagcgtctgcccaagctggtagacaggtgagtctgactcccagcagagatcttagtgcgagctcttttcacctggactgggccagaaaagaaacctgaaagcagaggcttcccggagaagcttaaactgcaggggtccctggagccagggggatggcagcattgatttgaatgtgagtgtgcccacccctctctggacacacaggacttaaaaggagaaaactggctaggcgcagtggctcacgcctgtaatcccagcactttgggaggccgaggtgggcggatcacctgaggtcaggagttcaagaccaaactggccaacatagtgaaaccctatctatactaaaaatacaaaaaaaattaaccaggcatggtgacaggcgcctgtaatcccagctactggggaggctgaggcaggagaatagcttgaatccgggaggcgaagtttgcagtgagccgagagcgcaccattgccctccagcctgggcgacaaagtgaaactccatctaaaaaaaaatgaaataaaataatcctcagtggcagacagaaaacaaagtctgaaaagctggaagtatgtactatgggtgggaaacttgttatttggaaagttccaattctcccagtgttaatatttaaataaaatgcaactccagtgaaaatcttagcagggttttttttaattgaataaaataatcttaaagtttgtatgaaagaatgtccaggaattatcaagaaaagtgtaaagataacattttatgatatgaaaatatgcaaaagattaacatattttaataccataatcaaattatgatattacatgagaatagacaaaaaagtcagtagaatagattagaaaatatggaatatttgacagagcttatttaataaatttaataaatggtgtcggcacaactggttattcgtcaggaagaaataaatgttgaatccctattttataaaaacaaatggcccgggcactgtggctcacacctgtaatcccagcactttgggaggccgaggcaggtggattacctgaggtcagcagttcgagaccagcctgaccatctctactaaatgtacaaaagtgagctgggcatggtggcgggcacctgtaatcccagctacttgggagactgacgcatgagaatcgcttgaacctgggaggcgaatgttgcagtgagccgagaccacaccaccgcactccagcctgggtgacatgagtgagactccatctcaaaaaagtaaaataaaataaatggattaaagacatgaatgtaaaatacaaaaagtacaaatccaagaagaaaattatgtttatcgtaggagtgagtgtgaagttaggaaacccaaagaaacaacgggcaagggggatgaacaagcagtttacagacacggaattcagatcgccaggaaatatgtgaatggtgttcgagtctgccggtattccatatgcaaattaaggcaacactgtgctcagtggctggcacagcattgcccagggcagtaagcgctattcactggtcgtgaggggagaggaattttcatgcgttcttgatgggatgtcaagcgttagcgccttttggtgacacccagtgaaataaaaaacactacagccttcagacatacttctgggaatttcaccctaaaaataaaagcaccttacttaggaatatcttcataagcatctttatggcagctttgtagtgaccaaaaaaagcaaaaaggaaaaaaaaacaatgctggatatcaagggaacctaataagtaggtaaaagtttgaataaattatcacaagtccgtattatgaaatgtgcaggtccctaaaagaattcatcacaggcaaaccagttgactcagaaacatttccaggaggtactttgagtaagaagttaacatgtgcataaggatgtatagaatgattccatttttgagaagtaaacaatgaccaagaagctcctccatctatttctgtatccttcatgagtggagcatttgcgtgtctgtccctgagtgtgtataatgcatttcacgtggcacctgtgactcatcgcaggaggctggccgtgggcaggtgctgttgtctgtgggggagagcctggctggtcgctcctacttttggtaccaaaactgtaattgctcttccaggacttagataatgctttggagaattcttgtagccttataaaaggaatgtgaaggactggttagaatcagtgcacccacacagcctaatgagccacgtaaagttgactagacagatcgtcaaatgcagatgatacacacacacacacacacacacacacacacacacacacacacacacacacacacacacaccccctctgtgttggctgaaggtggagtgaaactggcctaaccccactgtcctccagggggattcagtgaggcctgaatcccctgctcctgtcctgtcctctcactgttgcctttcagtggctcctgcaccctccagactgcctgataatctcctctattggaggccacgtacctgctgcagagaatgtgtcgcgtggctgtagtcttaggcaacttaggtggggctgagaacccagggccacttctgtctgcgaagtggctcaaattcagcatggaaagaacggagccttcatggaatgcaggcgaatacagtgaatgtttgtgcctaaatgactgcgtggggctctgcaggtgtaggatgagggaggagtccagtcttttctagtgtcatgaaattcccaccgcagctgcctgctgctccccggacgggatttcctctcgctgccagtgggaggggtggggagggctggatgtggcgagggagtctgtagacagaagacattgccagctcccagccccaccgccttccccgcacactcgtcgcgctgtgactcccggccccgccgccttccccgcacactcgtcgcgctgtgactcctggcggttttctgtgttcttccagaagattggcacctttcttctcccacccccaccctccacccgcgatggcatctgctgtttatttttgttgctgttctgtgtgttgcatggacgctttagcagccgtgacgcccgcgtcttcacagggcccactcagcctcccgcctcacataagtgtggagttcagttgctgcagaggcttttgcctgatcagtttttaatatctacctgatgtcacaggttgattttgtatgtaacttgttgaaaggcacttgtgtaaaaaggtgtaaagaaagctgcttttatgaaagcagacgtttcccaaaggacttgaccccctccccaagtatttccgcagggatggtgtggctatgcagaggtgagggtgcttccctgaagtgctttggtgagaatttgctcacctggcgaggggtttgcttaccagttcatcttaacctaattaagtttgcattgtctctggaacgccacgtttgggggataaaactcatagaaatactgaaatatagcaatgttgttgaaaacctgtggttatgtaaatatcctcagaactctttgtgctggagtaatatgaaatctcgatggctttggcagcagccttccaacaggtctgcggggtgcgggtgaaggtgacctttccaacatcaaggagaagggccagagaggcgcccggactcacagtggccctttcctggacccttcccaggggcggagggccagagaggcacactccgattatggtccatctttatagtaatgctgggacacaggcattgtcatgccaactccataactgatggccagggagtgtaagtgatgtcaccaaggccagaagccacagagaggcaccaagatcccagcttaggcctgtctgctgccgaagcctatatccctaaccaggatgtgagacccccactcattacataacaaaactaggaaaacttttctgcttatttatgaaaaaaagggaacatttctaatcggatatgttttccacaggtggttcctccccagaaatattaaatcacaaaggatataaaattctgttttaagcggcggcctgcagaatctctttttcctttcttctgcaccaggttaatgttagaaacttcagcttctccctgcacatgattctccctcagccggggaatgtcctgtattcctgccctagctgtggctttcttcagtcagaggtgaattgtagtggcgatgcttaggccctttgggcgtggccagattgacttccatgggaggcagcagggaaaggtgggcagaaacacctggcttctgaaggtgccaaggagaagtgttcaacaaggcggcgggtgaacagagaaaggccacagataccagcttgatacagagaggaagggctgcaggcacccgccctgggtctcacgatcacactcccagcccctcacgtccaccttgggtggagaacttaaaacacaagcaggagcagccagggggacccaagcagttggggagcaaatgaaagcactctcttcctgagatgccaggaggtcagcatggcgcctccagggaggaccagctctgccaagggagctgctgggcagatgatgactttgcattgtaaagtagagcccttggctagtttttggggacagtgtttaattatagcagaacagcccagtgatgacggcagagtcacgtgaccgtggagcagctgcatcacgtgtgacatgccgggactcagtgacgtggcccacgtgctgccagctgtaaatcagggtgtctagctccgattcaaaagccctggccttttgaaagtggccagccttgttggccactccctcctgaagagggggggcaggacttccggctgctgcctgcctgggcactggggtggctccctgcccagcgttctgtgccctgacctggagccagctttgtgcactgccctccagacccctggcctctctcaggttccagctcacgaggacacccctctggtatcacgggcactgaatgggcactcgatccccctaagggacacccctctgaccacaaggacttcacttgccgccatcactcacgcttgatggggcaactcctttgaatcttgaatagtgcagaatgatcactacagagacccctgagaagagaagcatgggagcgacagaggccaccagggagggacacacagtcacagagcacattctgtcttcctcagtttcccccgcaacaagacgagcccctgccacatgtggcgctgtcctggaagtgttgttcctcttcccaaggaatgccctgaggaagagcccacttaggcccctctgcctcccaacgagaagcacccactcaggcccctctgcctcccaacaagaagcacccactcaggcccctctgcctcccgacacatgagctttcctctctgcccagggtttgtttcacaagggccgtgtcatcctaagctctgtgcaaaaagcctggtgttcagcgtcacgggtcccagtgacttctgtaactgggcagcagccttgtctgcagagggggagaccgaggcaggggcagcaagtaacatgctcacacagccagtcaccaaactccagggcgatggctttcccctcctcccacctcccagacaagtgtctccaaccctggccctgcttgctggttctgtggacagtttggtgggtgggtggtcccctgccccagggatatttttaaattgaggtatgatttacacttactaagtatacaaatcttcagtgtacagtttggcagatctgtacatgcccataggggtagtcatcctctaggttaagggatggaccctttctggctcccagacagctccccatcccctgtcccacattgtccccctttaggtaaccgtgactctcacctctagccgcatggattcgttgcccatgcttggacttcctatgagtggaatgctgcagtctgtactctttcatgtctgcctccttctgcttcatgttatgtttgtgaggttcatcctcattgttgcctggacctgtaacttgttctttttcacgggtgtgtagcattcagttgtgtgaatctaggaaaatgtaccccttcttccttgtggacaggtggtcaaggatgacaggcagtcggctttcagcttggagctcttagaactaaaactgctcccgaggctcgtcttctggtggcatatgaagatggcttatgttcgtcacgtgctcaggagtggggttgctggagagtcctgctgaaacgtcaccagcaggcattcttgtgggtcctgcagacacaccgccagcagcgccttgtgtccctcttagaatgcagggtgcaggtgccctgggcaggctgctgggagaggaggggtgactgttcctctctgtgccccatgctgagcctcactgagggcacttcctctccctgcttctgccctcccatcacgtcccagggtgagctccacaagtactgcactgcttgggatgaagctgacgtcaggttcagcagccagaacaggaagtctgggtccgctgccccccaccagctccctgacaatgagaccgactgtggctgggcaccgtttggtaagtcgattatcggtccgtccaggagccgaagcggctgtccttccagccttgctattaatcactttagcagcagtaatgctgttcccagatgtaactgcatttccatgacagccctctcctaccaaaaagcacatgacttcaccgccacggtgtccacagtgcctgtgcgcagagctgttcctcctgaaagaaggttctctttatggggaaatgtgctgaagatcatttgcattttgtattttggacttgcagggcatagttctgtgggtgagaagaagagagagacacgaggcgctggtgtgggtgctggcctaggcaggtgtgctgcagaaaagccagtggacacgtaaaagaaaaggcatcaatcaaatgtgcagccaccatgcacaatggggattttatctcatctgaatgacgcctgtattatatttagtgattatttgaaactgcggtgacttcattttcctttgcaagaaactgaacagaaaatgcaccgccttgttttctatgtggaaaaccacgcgtttcactaagtacaccccgatttcgggaacagatgctttgtgttttatagccgtgctctagaacataaactaaacaatactgagcttgtcctgctggttttcaaattcatatagataagaacaactatcagcagctgcttggggccctggactactccttcctgtgcgcctatgccgtggggatgtacctcaggtaggtctccttcagttttccagacccttcctggttacctggcccctccgtgcagagaagacatccgctatgctgaagtgcacaggcgcgcgggattgaggcccccgcttgccactggcttccctgctgttcccttcccaaagacgaggccaagcttaggagagagcaagtgcgtgtgctgtgcccacaacacaggacctcgaggcagaggatttccgtgtcccgggcactgtgccaattgacacaggctgccctcagctttcctggccctgaagtttaggacctaccatgaatcctgccaatcctgggacgtggtcattcaggaacagaggactagtttcctgttcagcagagcccaacctctcctgtggttcagaggttgccatctgtttatatgccccaaataacgaatttcacctgatgatcgaaacagttgacacaggatgtgctgaacagctctacctggatgcccagcttggccccagaactctgagcacagcagaggcagccatgcatggcgggtggggaactccagagagagaccggctcggatctgagtcccagctctgagtacagcagaggcagctctgcgtggtgggcagggaactccagagagacaccagctgggatctgaaccccagctctaccacctgctaggatgtggccttgagcaagttactatacctctttgggcctcagtttcccctttgcaacatggaggaaataatagttcttatgtcataggattggggcaaagattgagttaatgtatgtagaagctcacaacggtgcctggcctgtgctgccagcccagcccattcttgatcccactttgaactgaccaaggcaggtggtgaatattatatgggtcataggacgtgtgattggctgattaaaaactgctattgtgtcagtccagccaggtttttttttaaaggcagtatagggatgttctagcccattttctgttgctattagcacaatatctgagcttgagtaatttataatgaaaaaaggtgtatttagcttttatctaactgggaagttcaagattgggcagctgcatctggcaagagcctcgtgccacattgtaatgtggtggagggcgtcacctagcagaggcccctgtgagatgggttagcagtgagcagggcatacaaaacagacacagcacaggggtgacgttgctttatagcaaccagctctcacctctcacaatagctcatcagtcctgagagcgcggccactcactcctgcggattcattccttcgtcaaggcggatccctcatgacccaaatgcccttcaaagctccctgtacctctcaacacagttatactggggaccaagcctcaacacaagttttgatggagaccaaccatagtcacaccacagccagagactgaggcatgtggtcccaagaggcttttgttcagagacagaggtctttaccgcctggagaaacccagggatccccataaatgtttagctgcttccctgagacctgcccagagtgtaggatcatcaagacctgggcccccctaccccgctcagagccctggtgggtggttggtgcccaggcaggcagtgtctgctgttggaggagagtgcatagctctccctttattgaacgtgtgtatttgcctcctgctgcagaacttgtctaagtgaacaaatgaataataaagatttggaatcccagagtgtgtggtgtgcagcagaccaggagcctagctggagagtgtggtgtgtacctggggcttccttagcgcttgggtctcagccaggctgccagaccttctccactttgaggtcaaatgtttatattccccacactgcagtcttactgaacacaaataatctgtggtataaaaagacccaaagtgggaatgtgtttttctcagttactggaaaactgcatttaaatctggttctcagctgggggcagttttgtctcctaggggacatttagtaatgtctagagacatttgtgggtgtcacagccagggaagggatgttgctggcatctagtggctagaaaccagggtgctgctaaacatcctacaacacacaggacagcccctaacaccacagaattaccggagccaaagtatcaatagtgctggggttcagaaagcctgctttaagtaaataaactggtttcttgttgcttatttacggtaaagataattcttatgcaacttgtcagtaaggttattaaaacaaaatttggtctaatgtgacatctacacagtaaactcatgactgaaaacaagggcacatgctgctgcattgaaggggcctttttgtgtgacagtccctacctgaggtctcagtgatgggtgctgttttgttcgctatgtcagatgaaatcagatctgatagggtacagccattcagcccaggtactgcctggtgggttcaagcaggtgcagcgtggacttgaatccctgtatgagtcccatgtaatgtgaaatggtgtttgttcaattagaccttttctttaaaatttttcagtagagatcaaagtaggcccaaatcatatagcaagattagagaatacttctaagcctagccagcagcacccagctctcaggagcccatctggttgtgccagctgtgctgtgacctgggcaggtcagccagcctctcagggacctatctcctggtctctgaagtgggcaggttgaagtcagtaactctctagctctacaatgctcttgagtctgtgtgtggtgaggttttagctgaaattttcacctggatgttgtctataattttaagttactttcttctgctttagtgtttaaaaggtcatttgcatgatccaaggtagatcttttttacttggtgaattcggaaggaaaatctctctggcgtaggtttttgagatgaaagctgagaacattggagctgactcccggagtggggttcatggcaggcaggtgtcactgtgtgttaggtttcctgtttatctgactcctagaatgaccctacagaagaaagtgagacccatagagtctctaatgcttgtgaagggctcacgtccatccgtgatactctacagcttttctgtttacttaataagtcacaatgttaagttggtccatagtgacatttcccataaaacagtaagggatgttttggatggcattaggtattgtgctgtgatggcggctaaagactgttaagtctgttccctgctgtgaagctggagactttttaccacccccctcgaggctgttttagtgaggcgctaagcatcccttatgccaccaggtccccagacagctctagaagataagacaccaaagagggtagctgtttagtgaatcgcattgctgttcagaaggatcagagagatgccaccccagcatttcagaccttaccatagagcaaatcttctgcctttaaatcaggtcaaagtggtgtggcaggaggcggtagtggcaaagcagctgaaagccacttccccactgagcccagccagccaggtgtattaacacaggtgacttaattacagctcgtggggccgaatgacttgctcagggtcataagtgatctcatgacatttggtgtagtttgacaactggaattttaagacactatatacatttactggatatggtttatgtgaaagcaggattaactagcaagacgagttcctgtttcctttcattggcagctatcatagataagtcctagtgtttgaattttattatttgacagataggacttctactagaaataaaatcttctaagatgttgccagtctctggtttctggtgagtaagcgctccatagggaaataagtgtatgaaatcttcctggaaattgtaaggcttgagagttccccaagctcagagaacagcatgaaagcatccggcaagaaacagccacgaggttgctaacattcgggcgtgtttgttattcctatttgtctttccttctctccacctcagtggcatcattggggagcgcctgccgattaggtattacctaactttcgggatgctcgccagcggagccttcaccgccctgttcggcttagggtatttctacaacatccacagtttcggattctacgtggtaactcaggtaagggtttggatccgtggctcaccatgtacggggtttccttggtgaatagggtggagtgtttatgtcacgtcacctctgtcaaggtgttgggaaggggcagaagtgcgtcctgtcggaagtcagggtcagctgacgtaacaaagtccttccctttctcttctgcttagaaattccagcaaccaggaggttttccttaatttcaggagttgcctcgtaaaaaatgctgtctgtcagtgccccggcagggaaactgacatgcagagcccttgggagtcactctgtcttcatgtggataagtttgaaatgttttatcttgcgaaagatttgaccacttaggggttggagggtgtgtcctccagctgaagccccagctgcagtcaccctaacagcggtggcagggagttcccaccaggggagcgccccaaaccatcccaagatggggctggttgggattccaacgaacaaagcactaaatgctgggtgatcaatttaaagcatgtattaggggaacttacatactgagggctgcagtgtatggtcgcaacacacagcgggacagggcgttccacctaggtctgtccacagtgaggggttggcatatggagtttatttgagggtttaaggaatttggctcagggccagggttagtttctttccatgttttgggtcaacaactgaaacacctttatcagtgcctaggagtgttcagggaccaacttgggtccaagcctacaaaggaaaacctgcagctggttgggtcacagtgagaggaaaaagggggagacctgaggagtctacagagggatgcaagggcggaaggaagggccgactttggagttgggcagcaggagggggtgtgaggcagtcagtggagagaacaggagagatcatgaaggtgctagaaggggagaaggcctgaggacagcgcgcgctggctttgcccttggagctggagcccttccggaatctcctggcttctgcccttcccagcagtcctgtggatcaatattcagcagccgagggaagctgctgaaataatgatgctcatctcgggctttgtgatgcttctggggctccccagataggtcaggggaatgctataaaaccatcaagcagattgtatttaattttgcttttcaagattttgccataacacttgaaaaagtttggctattttaattacaaaagcaattcacacttgtgtagtaatatagaaaattagaagggaggagaaaacaattttccagagtcccagcatgtttctggagtgaaggcccagcccggtcagcccagaggcagcaacagttagaccagcggctcccaggcgtcttctagagcagcagtttccaacctttttggcaccagggaccagttttgtggaagacagtctttccactggggaccagggttggggagaggaggatggtttggggatgaaactgttccccctcaggtcatcaggcattcgattctcataaggagcgcacaacctggatccctcacatgtgcagttcacagtagggttcgcgctcctatgagaatctaacgccccgctgatctgacaggaggtggagctcaggcggcaatgcttgctctcccactactcacctcctgctgtgtggcccggttcctaataggccacggatcaggactagtctgtgcctggggttggggaccctgctctagagagctggcttactgcagtgaggtggtcagagctgccaggctggcccagggttggggaccctgctctagagagctggcttactgcagtgaggtagtcggagctgccaggctggccctggtttcgtgcagtcttgtagagccacccccgagtctcaagacgctagagcgtcctcagcaatacattccccaagtcccttcatgaaactcaagtcagggattcttcaaaagtgcagagatactttgtccaggcgcgaagtcaagttcgtgttcattccagagaatgattaacaacagtaccttctccatggcatggtaagggaaacatgcaattcacaagccatgtttatcatacaattctataaacagttcataaagagaagaaaggttttctctctttaaaaagtttgtatttgtttattttttgagatggggtcttactgtgttgcccaggctggagtgcagtgatgcaatcacagctcactacagccttgacctcccaggctcaagcaatcctcccatctcagcttcttgagtagcttggaccacaggtgtgcaccaccacacctggctaatttttaattttttgtagacaagggggtctctctatattgcccaggctggtctcaaattcctgaactcaagagaccctcctgcattggtctcccaaagtgctagaattacaggcatgagccgctgcacctagcctctttctatgaagtttttggattcaaaagagaccgggaagcttggccccacactgttatgaggtgtgatctgctggtggtggggttctggctgggttttttttcctcgcttttctctgcttattctaaaatttccacaataggcatgcattgcttttattttgaaaaatatatagatacctgtatacatggttttaaaatatatatgtagtttaaactgtatataaatataaaattgacagtccatctctggctgtcgtgccccctgctttgtgtaagtggagcaagctctgtgcacctccctgcagcgctgtcccgggcctgcttcccacaggtcagtctctcctttggcctctcctgcaggtcatcaacgggctggtgcagaccaccggctggcccagcgtcgtcacctgcctcggcaactggtttggaaaaggaaggtgagaaaaagcagccctgtttccaatagcagatgaaaactagaccattttacttttagtttttctgtagactgattacagcaaaaacactttagtatcctctttaaaataagatggctgaaacctctggggcttgaattgctgaaattcagatggcctgtgtcccacgagacaggggagctccgccctcccactgtgggcctggtgaagtccgtgtcactcggcggctcctctgacagctgcatctggcctcccaggtgttgtgggagatgcagagtccaggaccctgccccaggccttttgaagccaaagctacatgttaacatgggagtttgggaagtcccgacctgggtcacccagcgcacagcaccaaagtagcagagctgggacccagcctggcgagtccagatttatttgtaaatggcttttattttatacagataaaatttatttatttgtaaaattcagctcagccaggccaaaggcttatttatggtggacgatcgcaaacaagatgcggaagctaaaacgggaacaccagcgtcatcaggtcttaagtcttagatactgtgcctcattcacctggtgtgtgcatccatgagttttgttcaaatgacagttcatcaagtgactgtatgtattaattgattgtagaggcacaaattttaatttcaggccttccaagactttcagggaaaggcctctttcttcttcttgagtacagaatgcgctcagagcaagaggtagaatgggtgatggcacagcctgaggccacataaacacatcagctctcgtgagcatcgcgagtcctgcatggcacagaagcagggtctgcatggccccccgttgattctgcgccgactccctactttgcaggcactgctgcgccctgcactgctggactcgtttcagcttctcagctccatcttctgtcttctgttttgttgtgctgcaggagaggtttgattatgggggtctggaactcccacacctccgtgggcaacatcttggggtcattgatcgctggctactgggtgtccacatgctggggcctgtccttcgtcgtgcctggagccatcgtggcagccatggggatagtgtgctttctcttcctcattgaacgtaagtgcacgtggccttggagaccacccaccaagggaggcctcggatttccctgcctgggtgggccttgggggcgagtgtgagagctgcgtggcctagcgccctgtttgcccgtggctgcctcagcgctcttcttaccagggagacttccccggggagccggttctctcctggttttgctggatttcctactctcccctgattctggagtgacccatgtccccattccttcctcccgtcctcctgtcctcccttgccccggcatcaggagttcatgcatgggagtcttccatcttcccacaggctgttccttctcatgcccatcttgccaccacagcctgaattggacccagtcagctctttgccttctgataagatatatcttggacagtgttataaaagactgacttaatatcttaactgggtaaaaagtatctcttggaaaatcaaatctcttattccatttcagattcaatagcaaactctttatttaattgaatttgaaattcatttctgaagtagagatccagcaggctctggtgctgagaagattcaggacagttacagcaagaatagagatgcccgggtggccctggcggtcacacgacaggggctcgaatcccgcaagccattctgataagctgtactcaactcttagttctttgactgagtttaaaccatatggcaggagacagctccctcatgctgcctgccaggtagggacactcagagccagctccctccagccacactgggcattgctgatcacttcagctctgcatgcaaaagttcatccatattccatttagtcgctcactttttttgtcttgcaaaagctaaccttttaatttttaaggtaaccatcatctggccacactgtgagtttggagactctcaccccatgcttctgtgttggtgaaaatggaaataaacattcagatgaggaatgtccagacacacccattggtgtgagcaaaaagtgggggccccgggctgcactccgctcccctttccccgcttctgcagaggctgagtaagccttcggccacaccccaaacagcctgagcaggggcctcctgggatgggtgggggtctggatccctcccagtgggccagcatgtggctttcagctctggctggtgtgtcactgcagttctgagaaaggccatttccaccacctgttttcttccgctctggttcctagaacctggagttctgtgcccctgcgctccaagtgtttgagacaccagccacccggagaacaatgtgcctctctttgttagcgcacaggggcccctgggtgtctcctgcctgagggtagagtccatggggtcttctgttctcttccttaactggaaaggggctggctctggggagaaaaggacatgtggaagggaaaggagcttgctcaatggccgggacctcagcacccgctccaggcattcacggccctatgttgatgtttgtctctgtaagcagagagagctcagctcttgtgaataagcctccctgatccaatttgggcagatagcaatgagccagatgccccctgtccctgggtcctctggccacaggcccactcacctacaggaaggctgcatgcttcatctctagccaaacaaaaccaaactaccagaacctcctgcccagggaatctttctgacactctttccccttgtgcctgggaggtgcactgtgtctgaatgatgagacccagctgtgacaacagtggctggatgctgagtctgagaacaggagctctttgcagatagggaggaaacatcaagtgccccttggtttgtttctgcccctccttgtcccgaatcactgatcctgggcaggtactaaaggcatcagatgtgccattcttgcggtcaacagaggatgtggctttctctgctgctccttcactcttgtctcctgcccagggtgagccccaaaggacagggcgtcccctgctcctttctcaggcctctctgagtctcctttctgaagctgttctcaaatgtgtcccagccaagggacgtgtgtgcccaagtccctgaaggtgaaagtccaggaagagccatatcaggggaagcccctggcttacccctgggggcatcacactgtgagtggataccgatggggtgagttggctgatgtcctttaaattggtgaccatacatcacaggtggaccattgggactgcccaacatgccgaccatgtgtccttggtcagtggcctcgccctatgggctgtgcccaggacaggagggcgacgcaccccacagccagccacggacctctgggtgcagacccacctggccctacggcatgttgataataaccttatcaacaaaacccagacaagaggtttgatgctggcctcgaggccagcaggagtgtgctcggcagctgcatgtccctctatgatgtcaccctgtgttgtatgggaatggacttggctgtggggagcctgcagccctgtagctcagtttgggttgcaaggcagtaaccagtttcatccaaggtgataaagagaccaaggtgcttggtagtcagagggggctgcagaggtggagcgagaagcagtagggctggtttcccgcagcacctagaggcctggggtctgactctgggttcccgcattgctcggggcaggttgctggtgtctgtaaaggacacgctgaagcctcacttctggttctgttccttttcaagtttcctcccttccttgcatttacacaaagatgtttgttccatatcaagatagatgttttatctccactcatttttatttctaatgaatttcataacatgaaatacctcattacagacattcttccagcctcgctcccctgatgtgcttttcctggttttgcttttcttctggggcttgtcctctgaatgagagtcgtgggcttgtccacacagcgtccgcatgctctgcttgtgattattggccacgctgggaagtattttccatatttaaagtagcgttcacgttcacagtgttggcactggctggcggtgatctgccataccccccttgcacacaagtgggctgccaggccgagtgactggggacaggccggggcgtgtgcgggagtcactggtgggacagccaagctgtgcccttgccctcacctggcatgctatggcgatggcttttttctgaaacgaatgccaatttagtaaaggtataagatggcatcttgtgttttattaaattttattgtgtatatttaaggtatgcaacatggtgttacagatacatagagatagtaaaaaggttactagtaaagcgaagcaagttaacatagccatcgcaactcacagctgcccgcttttgtttttgtggcaagagcagctcaaatccactcatttaatgtgaatcctgcatacagtccagtttcacacccggtgctcccgtgttgccctgtcctcgggttacgtagcttacttggcattgccatggtggtggacctgctcagcctcactcatgtttgctctttcagatccgaacgacgtcaggtgctcctccaccctggtgacggtaaggaccctgttttcttgtccttttctagaacagtgtgcggttctgaccacttccccagcctgctcctgcctgtgcggtgtcagacagaaacacacagggtagacagaagtcccaccctcaaaacattggcagttctaggaatagagaatattctgttttgggtttcgctgataataaccttatcagcaaaacccagacaagaggttcaatgctgtccagatgaaggacttcatgctaaggggaaccaaaggctgggccctggccaggcctcctcaggagtggagacctcctggtttccccaggggcctcagtgtgacggggaaaaacgcacgtgtcagctgcctgccatcacttaagttggtggctgcacgtctcaggtggccgagaggtctgcccagcacgccattccttctcttctgtacccctgcccagctcagccagcgtaggccctgcaggcaggattgctgaccacgttggctgccatgaatgagccctgccctagctgcctccacccgcagccagtcaccactggccactttcccacctggctaaggccagccctcccgcggtaccggtcccctccctctcatggcccagggcttgactcccgcagacacaccccccgccccaaataccattcctggcacactcatgtagtattggtggctgtcttggaagaaagtccctctggccctcatgcctgctcccagccgccccgctccccatgtccactggcatgacacccctcctgtctgcaggccaccgccacctcacgggaacagcccatcagatcccagcaacgtcacccggacacatagggtggtcagctctctggcctcaccctgctgggcccgtcgcccgcgtctgacccaatgcttccctccctctgggggtcagctctcttccctccctctgggaaaggctcccctacccgggctaacatgttagtcacgtctgtgccgagtgtcagaccccagatgtgggggtgcccccaggctgccctgcggcctcctctctccttgtctgcccgctcactgcaggagagcgcgctcgggcctttcagcggctccaggtgcgttgatgtcgagtcaccatgctgtccccagagtgacccacccctgagctccgcaatctgaggtctcaccaccactcaaccttcccacggagatgtctgagtgtccttcagacttaacacgactggaggagatctcttgattttacccctgcacaagccgatcccccagcatcccccatctcagtcaggaagctgctgtccaccctgtggacaggccagacccgaggagccagcccaacaccccctcccttcagccccgcaccccatccttggccatgttctgtcagttctgctctgttctgtgaggggatgtggaatggaaaccctctcacctcctccgcctctaccaccctggtccccgtcaccaccgtcagctctcctccgagccactgctcatcagcctcctagaacgatccactcttgctccccagaatctcttcttcacaccgcacttgcagagactgtattgatacagacgccagagcacatcagcccttgcacaacacagtccagtggctccatgtcgccccgtgtgaaatcctcaccagtccatctggttggtctctgtcaccctcacagaagggtgcgagcccctcgggcctggatcatcactgggtcccggcacctggggcagcacctggcctcgtgcgggaggggggccagagtcctttttctgtcttttcatacctcgggctcctgggtgtgattcatatggaaagaagggttctgatacttgatgacaaaaacaaagaaacaaaatgaagtttgaaaaccagtgccttcaggaaggtcaaacaccatatgatgttcttaaaactatggttgatattttaaaatgttttaaaaagccgtgttcctgccctgagcatgaatttcagtttccaagcttgtacagtcgtgccgtgaagtagcttaaagctgcccggaccagccgtcttgagactggggagaacttcgcacacaccttccgccctggaacaccttctgtcctctaagaagagcttttctcacccaggggcggccaggcctgaggataggaagcaggcgtgcagggggttttggggaggagcagctcttcctcacacacagcttttaggaatatgagagctcatctaggcgagaggcattgcttctgctcctcgtgtgtatgagtttggggctgaagcctgtgtttcattctccccgttcaaatcctctccgagcagttcactgagatctactggtgcccaggtgtccccgacgtgccctgaggcaggtggtccagagaaacagcttctcgtcctctctcctctccatgttggctggtcgcagagggagagatggctgatatctggggatattttatcagcttctgcaaacagccccaaagttctttttcctgcaggaatgttacctgctctgtgcaggacaccaacgagacccttgtcacgggccttcctgagggagctgagggcagtttggccaatgtcccatcagctgctgtccttctgtagtatcttccctttatcacaaatgggagcttttgggcaaagcaaaatgcatttgtaagagatttcagatgtgctgacttgttctgggaagttcccatgtggaagtgttatttttaggataaaattctaattttttccaatattttaaagttcttgttatggagactttaaacatataaaaaggtaaaaataacagcataacgaacccctgtgtacccattacccaagtttccaacagttggccaatctgactctatcaacgccccttctaatactatcccttcccacctcctgctgatgtattttgcaagcaaatagcaatcatcttaatattttgtctctgactacttcagtatgtttccaaaatataaggactcttttatgtgaaacaaaatgtactataccattatcacacttaaaaaccaatggcaaagaatagaaaaacagtagagaaaatcaatgaaaccaaaagttggttctttggaaagatcaacaaaattgatcatcctgcacctagactgaccaagaataaaggaggactcaaattaccaaaatcaggaccaggaaaggtggcatttctgccacatttactgaaataaaatggattatgagggaactatatgccaaccaattagaaaactttgaataaatggaaaaattcatagaaggacagaaactaccaaaactgactcaagagaggaggaaatctgaatagatctaaaacaagtaaagaaattaaattgttaatttaaaaacttcactcaaagaaaatcccaggaccagatggctttactggtaaattctgccaaacatggaaagaagagctaatactaattactcacaaactcttccaaaaaataaaagtggggggaaacttcctaattcattctatgaggtgttatcgtaataacaaaagactaaaacctcttaagaaaactgtacaacagtatcttttatgagtgtagatgcaaaactcaatagcagcaaccagaattcagccacctacaaaaggattatttaccatgatcaagtgggatttatcccaggaatacacagctggcttaacaggtaatgttaatgtaatacaccatttgaatggataaaggacaaaagctgcatgatcatctcagtagaagcaggcaaagcactggacaaaatccagcaccctttcatgtgaaaacactcaacaaactaggaatagaaagcaacttccttgacctgacaaagggcatctaataaaacccacacctcacagtgtgcttaatggtgaaagaccaggtgctttccgcctgagatcaggaacaagactaggaggcctgctcttgccgtttctatttaccattgtaatgcaggcaggccagttaggcaagaaaaggatataaacggcatgcagattagacaagaagtaagactacttctctttgcagatgacatgatcttttatacagaaaatcataaggagtcctcaaaaaaatggttagagtgaattaataagttagcaaggttgcagaaaacaagaccagtatacaaaaatcaattgtatttctatacactagcagtcaacaatccaaagatgaaattaaggccgtttcatttacaatagcatcaaaaaacattacgcgaagcagaagaaaccagtcacaaaaggtcacatattgtatgatttcattcatatgaaatgtccagaataggcaaacctagagatagaaagaagatgagtggttgtcagggactagggtgggaagaaaggggggatgactgctgacaggtatgaggtttctttttggaggtgatgaaaatgttctcaaattgtagtgatggttgcaaaactgaatttaaaaaccactgaattgtgaacattaaatgagtgaatggtacagtatgtgaattctgtctcaacaatgctattacaaatttttaaaatctataatcctttctattatcatacagctactcaatggtcagatctgctgattgtcttataaatgattttgcactgtgtttgagcaaggcctaggcaaggtccactccttctgattggttaatttaatgtgcctcttaaggctcttctaatttataggacctcaatggttttttttgttttgttttgttttgttttgttttgtttttttggtttggtgttattctcctttgaattgcttttgtcaaaataaaaaatggtcattttttctaccaagtttcccacatttgaggctttgctgaccttgtacctggggtgtgtttcacgtgttcctctatcccctgtatctcctgtaaactggaaaccttcatctgatccagatttgatttttctaattagtttttgtttcaaatgaatcacaattaatatgaaagagagtattcaattctttaccatttgccttgagtctgagggtgctaataagaatgtgtctctttatgcttctgccctgtgctattgaagagccatgggaacttgttcttttgatttgtatttgattcctaggttacttaggtttaggatatctattttgtgccctaatctaggacctcattgggtccaaaaccctgtatcagttgtgtcaaaattaatgtttttattaatatcttcagattagttggggttgtgttcagcagcaagcaatagaaaagcccacaggcagttactaaaacaagatgggaaggtatttctctcttctattcaagaaatctggagagagccagcccaggatgatgtggggtgtgcgtgttgagtgtcagggacacagactcctcttgtcttttcgttcttcccctgtgcatggcttcatgccaaaggtgatatattccaaccaattagaacagtgccaggcacagagttgatgcttaataattatttgttgaatgagtgaatgaatgattggtcagtggctgctggagctccagccattacatctgtattccagccagcaggaaggagggaaaggacattagggacaggccccttccctttcaggagacttcctagcatttcctaacatcatttctgcttagctgaccacatcaagctgaaaaggaattttaagataggctttgcctgagcacccacgttcctggctgaaaagcaggaagaagagggcccgggtgatgctggcagcctctgctcactgcgggggacggggggccgagtgctggggagcaggaacccatctctgcttctgcctggaatggtcggatgataaactggccagataatcacccctagcctggcaggctttgccctccctctgagcacaaaacaaatgtatttttaaaggtgttttgttacattttcaagtaataagatcaatagtttttcttaaccttcagaaaccttttcaggggaaatgcctcgaaatgtaaagggtgggatccaactgtccatctgaacggagtttaacccatgctctgtcttccccgtgtttcccgccttttggaggccccatagatctctacttgcagatctcacagttagcgtgcaagcctggtggtttttcttctcaaatgcatccagcactagtgccagaaatctaaatcatctgggcctctctaagccttagaaattgttttgttatcatttatactagagtgagtgaataacatctttctaagtacagactgattccttattttaaaggaagtttgtttggactatttcatcaacaaacaacaacattttaccactggagaatttcaacaattatttttataccattaattatcttcaaaaggggttctacatagagccctgtagaaataatgattaggaaatggtacctttattctagtgcccaagaaactgccttcatttcttcacttttcacttggtaacaggagataattttgaaatgattttgagttttggagtgcatcagtgcagtccttccacctccctgccctctagcagcaggtccacattctggggctgttgagcaagccacactctccttccctagagacggttttttttttttccttcagaagcattcggctgacctagggagggcaggtgttcctcacatgttaaagggaaagattggtctgtgccttttcatttcaaaaccattgaaacaatctcacggccattcagaaaagttaagttggcttaatgggtatttttacatttgattacacctctgtcttagctctttcttcaagagaggattttatgctcacattctattatctgagagtctggagtgttgagatcaaccattattctgtttaaatcagttgtcttatgtcctcttggtagcttttttgggacgatagtaagtatccttgctacagtaaagccaggtttaatttctagctgttgaatcagtatcgctctaatgaaacttttttttttaccagcactcaaaaggctatgagaatggtacaaacagattgagactccagaagcaaatcttgaagagcgaaaagaacaagcctctggtaagtcacacacaacttccacttcctagaatgtcggagctgcaggaaaactcctttgagccacgtcggctctctgtccctctgcctatgtgacatgtgtcacaaacatccaggtcttaaaaaaattctgtctcattgtatttcttcagtaaaatttgagtttgcccttattggctttctttggattttacacttaaccagttcattcattcagcagctccgcacctttcaatgtcccaggcactattccaggtgttgggggcggtgctggtgtagacggaacgcaggcagagacatcccccaagcggtgccaagcggcaggaagacaggctgagcaggctctattttcagctggccttgggaggcttccctaggcaggcagtgttgaaacagagctgtgagggactggagggagagtctgcaggtgcctgagcacagagggtgtcagggtgaggggcgcacggtgggctggccacgtgaggtgcacacagaaaactgacatcatgggaccaagaaaagggagaagcaggtaacagaaggaggcatctccacctcccctatgtcacagatgaggaattccggacacagaaatgctaagttaatctgccttgtcatccgcggtagcagggaggcctcagtgcaggtctggcccacccctagcacctgagcctcctgtgccctacccttcccatcattgatccttgtagaggctcctcacattgctgctgcttagctgaccacaccaagctgcagcgggcattttaaatttgagtttaatcattgaagttataagctgttctctttctagatcaggtttttgtttgtttggttggttggttgtttttttttttttttttttttgagacaagatcttactctgtcgcccagtctggagtgcagtggcatgatctcggctcactgcaacctccgcctcctgggttcaagtgattctcctgcctcagcctccctattagctgggattacaggcacccaccaccacacctggctgaattttgtatttttttagtagagatggggtttcaccatgttggccaggctagtcttgaactcctgacctcaggtgacccacccgccttagcctcccaaagtgctggaattacaggcttcagccaccgcacccggcctctaaataaggtttaaccttctacagcagacacagggcctctcctctgtcagaaagacccctccagcatgtgtaaggggctgctctccctatctttttaaattaaatagcttaaaggattaatgtactaaacatgcatctcacttttttattgactgcagaaatttatttgtagtggctgaaatattagaaaagggaagaatgatgtctcgtgcatctgggttcttggattttagggagacagtaggcagtgactaattcaaccaaaatgctttaaaatctgtacttacttctgaattcacatttaaacaaatcatgtcccagtgtccaaaaggctgtcacccctctctgatgatactgaagcctgccacttcttctgaatcaagaccacaggccctttcttctggtgtagtaactgacccatagaactagccttggcttctaagtatagtttctctctttccttttccggccctctaagaaaggctgtttacagacttgccatcaaggagccagttatgtaagtaaaggcactggcaggccttatttcaggctgagggtgacgaccacaaccgggcgcatgctgacctcgcttacgtggcatcccctttcggcgggcctgccattgctcttgggtcagggtaggcggggagagtccccatgaggttggctggacaccctggatgtcccctttcccagagtgaccgctgggctcagtggggtgtcacccagcccctgacctccactccttttcagacagagctgctacactatgtcacgtagcaggcagtttctcagtggcctcttgaagagacatgtaaagaaagctggggggcggggagcaaatgtgggaaagagaatgaggcgctgctgtcacttggccacgtggcgagcccgcaggtccccgcgggcgttttagaggattgtcttggggacggtcgcacttgccatccctgtagtcacttgtcacttttcctccttgacgtctctgaggatccttctgattggctgtggctcaagaactgttgggcccaccaaacgcggcgtgagcacggagtgggtatttggaggttgaatgtgactccaccgtgcactttgcacgccaagtggggactccacaaatctctcttgtgatggcctttcccaaagggaagctgcagacagcatcgggtagcggggtgagcttagcatttttagataaagcgatcgttattacgcagtccccccacatgcgtctgtgtgtatttttgttgtgtgtgggggcattttagtagagggaacccttttctctttgaaagtgtaagccctaagcgtggagtgcactggccacagaagcccccacacccaccgggggctccacagatcccatttggggctcttgggacacagactggaaactgcttgtttagaggcagaggtgcctcttggcctccagccttgtcttggtccacccagtggcttcttgtttgctatgtaaggaggaggcagcagcagccccctgtttgttttggaaaaccagccatggccccacactctttcccatctcctccaggagcaaacaactcaggtatggtggctacaagtcctgtttaagatgagtggctgtgagcacagggcccgttctcagcagaaacagagccttctgtctgtctcgggggctccttgctgcttagataaggagcagagggtctgtgtctgtggctttaaaccagcccagcaagtggaccctgaagcactttacaaatcctgcaagggccgtgggcggcctttgggcatctgggtcctacctgaggccaagtaggtcttctgtgttgacctgcggtcacttctctgcgggtcagagggtgcgcttctcctggctaagcggcctcgttccgcttgacttttctccagctggctgcatttcacccactgctgagcctgtttcctgcggaacggcctgtgaagtcctgtagccctcagcttgctatgagtggaactcgcctggggctgccccagggactgcttccgtggggctgggggaattcgaggcttctcaaagccccccgaggagattccagtgcttagccacagtagagcattactgatgtagttttctaaactggacgattagcagaattcatgagagaaaagtttattcagaaactcaagtcgccattctttgctttcacgtgccgtgatgggattatcatcgggagcatgttaggcatctgcactcagccttgtcatcttcattccagagcacctgactatgtggccacatgtgaatatcttcatcagagacccgctctccatgccagagtcctagctgtgaagccgggcttcctggggcacgtagacgctgggctgcccccaaggccacccactgggtgcccacactgggctgcactcggtgccacctgccacccggtttccaaatgtctgttttccactggaagagaattctaaatattctaaatatcaaggggcaggggaatgtggaatacattaccattttcttttttttttttaattaaactacatttttagtccaacttataacaggttatagtgagataagtaccacaaagcctgtttgattttgtgaaaggtctgagatacctagaagcatttctttgtaagaccttgaacctcatagctcactcatgaagaatatttttattttattttcattcttttttgagacagggtcttgcccgggctgaaggacagccgcacaatcacagctcactgcagcctccacctcctgggctcaggtgatcctcctgcctcagcctccagagcagctaggactacaagcgcataccaccacattccactatttttttttaggtcttactgtgtggcccaggctaagattatttttatgttatccttgctctgacttgaaatcccactctaggttggggaatcactcttctttgctttaatgaatgtacactttgtcctttaggaacgtctagacaatcagaattcataaatatcagaataggtgtattttaaaataatgttggtgtattttaaaataatgttatttctggtcatatatggccattgtgaactcctaaaaaatgcaggatcatgtaaagaatttcttattagcatttcgataaaaattacacataattccaccactcgctgacaaccattgttggcttagattttagcttctttctttctagaaatagatcctatagttgcctagttacatacgtagatatttaaacattctttgaggttataatgacatgcagttttgaatgatgtgttatttaatgtgtcataagcattttccgtcattaaaatctcccaaccttttttttacaagatgtcattcgtatggatgtatttgaattttctattttttctcaatgatgatgtgacatccattttactttataagtatctttttacttttcaaattattttttgccaatagattcctagaatttctggatcagaggatctgtgtacctagccgttcatgaaaatgcatgaatgctaatcattctaacacagtggccaggtgggaatgtcacccaggatgtctccaaggcagtggaagagagagccgccaggcaccctcgtcattaggaagcctggccccacttcacccagactgcccggctggtaacacctttcctttttgttcccaatggatttgcctccaggacccagagatgcagtgcctgctgctctcagatgggaagggctccatccacccgaaccacgtcgtcattctccccggggacggtgggagtggcacggccgccatcagcttcacaggggccttgaaaattccagtaagtaaacgtgcccaggaggagtttcagaaagggctgctgtgctggctgtgggaagtctggtcggttgatgattaagcttaaaaagacatctgtggttgtagaacccggggattcgaatccatagccaaagctagacgctgcacagtgctagcttcaggactgaatatggctgcagtgatatttgttcgcctcataccatgtttaaattttttttgaaattcgttttctccatttagaaattcaggttcatagaaaaatggggctccctgccttcactggaaaaacggaaagcctggcaccctgggcctgcccccatgtgacaggttggggaactgaggccctgactactgtgccacctggcccctgtggcccggcccctccccagtgcacttgccctcccacaggccttgagcgtgagcccatgggaggcgctggcactgagtgctgcgccgtggccttcgcgagcccggctggattctctttccctttaaagtgcctttaggctgggcgcagtggctcacgcctataatcccagcactttgggaggccgaggcaggcagatcacctgaggtcaggagttcaaaaccagcctggccaacatggcaaaaaccggtctttactaaaaatacaaaaattagctgggcgtggtggcaggcgcctgtagtcctagctactcaggaggctgaggcgggagaatcgcttgaacccgggaggcagaagttgcagtgagccaagattgtgccactgcactccagcctgggtgacagagcaagactctgtctcaaaaaaaaaaaaaaacccaaaaagtgccttcagtgccacagcccgtggtctgattgcccgtgtgtgtgagcagaggatgccaagagtgagggggaggatgcagggaccaagggaagaacgagtagcacaggcgggagaagccctcagaagctggaccgggctggtcctcggtggtgctgctggccttgcctccagactagaagggcgtgatcagcgggtgatcagtatcgggaacaaggtgacttggagcagatgagcgggaggggcactgtagggagatttcttgctgctttcagtttttattacattgatggactctctcagcagagaatctaaggagctgtgcacagggtgtggagacactgtgttcttccgatgggggcagagggctgagagcaggggcgtgggagggagaccagaccctgctgtgtgggctgggcaggctgtccagggtgggctgtccagggggcgctgtccagggtgggctgtttggcggggctgtccaggccgtgctctccagcactgacagccacagcaccagggagcagacacagctctcgcttgttgacacaacctagagaaaggcagagggccaggggcacaggcccgaggcccctcagcaggtcagggctggaagtataaacaatgcaacccagacctcaaaatcatatcacagaaattaaagactggggagaaccttggcttcagaacagaaagtattccagtgcccaggagaaactgggtctgcagaggtggaccctggagccagtgttcagccagaggagaacgtcccagcccagggtgggcaccagcttatggggaaagggctgtgcatgctggcctgtggaagctgctgggtttaagtaaaaagatttgtttttaattgtgtccttaatgctagtgaccttttctgctgtaccttcctctgtagctacccccaaatacttgtaccaaaagtagggtgcacactagcataaaaatacaggtttttatatagtggaggtatagacagtatgggcttcagaggtcccgctcaagcctccccctgccaccgccaggctgagtgttcaggcaagtgtggcacactctgagcctccatgtcctcatctgtcacacgggttccatccctggggtaataccatatgttgttctgaggatgaagtgaggtcatttaatgacaactaagcacaatgccaggcccatgaaaggcatacggtaaattacacgtacacatcctcatcaactgtgaagacatcaactcgtttcattttagaatgacttggcaaagtagagcgctgggttcccccggcccccattctgattgatttccagtgcacagacggctgggggattcagtgccacaatgttactggatttctcactctgaattttcagatggcatctggaatttttatctcacaagtgccacctctttctaaaagtagacataaaacaaacacaaacaggcattttacagaacccaccactcgatttcctcactcatacctacgtgtctcttttcactgttttccctgatacggactggtctgtagtactcacaaggcgggatgcggtagcctgtacgcctgtgtgctgacacaatggtcggaattgtttcatctgtgtgtttccaggtggcttgataatgtacaatgatttcagttccagggaagaagaaggagccattcgatactcagtccactgcacccggctatacgagaactcttttaatagctaagttttccaggcgatgtagtatgaaaatcaaacccgtccatgtttgcattgactcgactctgatgtaaagacactgggttttgatcctgaactccatttcgaaattcagaaacgccgtagataaacagggcttcctgtcttcacttgaaaagtagaaaatctggccacgctgggcctgcaccccatgtgacagtggccgaggagctgcagctggggccccacccttctcagaggccccgcccctccctggtgcccctgctcggggtgagcgctccactgttcccgcgtcctcactacaccacacagcggtgcagcaccctccccagtacgtgtctggaggtgctaaagccagaccagagacaggatgtctttatgggagcgaagtcatatttaactctgttgcatgtttacacacacctgctgactccacatttggaggagacgcctgactgctctctctttcagggcgtgatagagttctcactgtgtctgctgtttgccaagctggtcagctatactttcctcttctggctgcccctgtacatcacgaatgtgggtgagtatccacgctagaacacattaaattccgcacagtgactggggtccgaagtctcttctgtctgctggtttctagagtattgaaaacacaaggtcatgaagggtgatttgagaggtacacctttgaataaagtactatgatgaaacataggctaaaagaattcagatatgcacattgtattgccataatggtaaactttatggggcttcacggttgacacgttctatcccagctagggctaccagttcatgaggtacttcctgttctggggcagcctgcgtttaaacgtgggctacactgaactttggatcatagcagccagtgagcagaagcagagcctttggggacctgagaaaagaaatctctgatactctgacctggaaatggcttctgggagatagcgtctcatttttggcagggccgacagtttgctttatgtttcagaagccccgcagtggctgcagctatagattatcagaaaacgtgccagtgaaatagtaacatgccccccccatgtcatgtgtgaacacaggacagacaagaggagatgaacagtgcttaagggaaggagccgttgagtggggaaattggaaccctggctgagaggaagcggggatggtccaggagcacgtggagggctcttcgccccgggagccagagagagcgagaggaaggagaagacacacgctgggccgtcagggaggggcagaatccggcaatgtctcaaagaggaggcctttgagaatgggggaggctgaggagcacagaccacctattctggggatgcagatcccaccagaggaggatgctggcagcacgaggctggagactgaataccctgggagggaagttgaggaggcggtctggggactgtcccacagcctagcagggacagggcctgccccaagggccagtgactggggaggcagcaaggagcacccttggatcctgaggttccttccctgccttgtgacccccgcctcactttggccagtgagctgcacacagctgggccttctttctcccttcttcccctgtggttgcaaaaggggtgacgttctcaggacttgagtcttgaactgctgacatttccagtctgtttgaaaaaagcaaaattttctgtccatgccattgatgattcggaacggctgggtttgacccacagccccagatgccgtgcagtttcctctcccacacccggctggctcagtccaccttaaagcccagaacctgtacaaaacctcatggagggcaccctgagctggtgccgggaggcctctgtgtcctcatctgcagttctaaagccgtgtgacaggatgatcgagcatccaggcgccttccacacctccacttctgtcctgtgttaatctaactttatggcggaggggcccctgggggggtctctgaaccaaaggtgggataattagactgagcagaggaaagccacggtttttggttaagagtgttttcatcctttctgtgttacttgttttttaaatctgagttaactactaattgctcctcggtataaatcaagcttatgaagccagagtcccgtgcacgggtcctgttctgccatggtgtgtcgctgcgatgcgtgaaggagatcctcactgtttcacactccgttgtcatttcaatagatcaccttgatgccaaaaaggcgggggagctctccaccctgtttgacgtgggcggaatctttggtgagttcattaagacttgttctgctgcaacaataatttcgcaaggcgcatgatctctgagttgattcactgctcaggggaacagggttccccaaggtctcatatcccctgagtgggcccagcccaagagggtcaggccgtcacctgggggtggttttattgtctcccgtccctccccagggccctgactctgcacttgaacagcttccctcagaaatagcatgccagctggactcaggggctcatgcctgttatccagcactgtgggatgctgagttgggaggatcgcttgaggtcttcttgttatgaagaccaacccaggcaacataacaagacccctctctacaaaaaaaaaaaaaaaagcatagctgggtgtggtggctcgagcctgtggttccagccttgggaggctaggatgggagaatggcttgagtctgggaggttgaggctgcagtgagccatgatcatgccattgtgctccagcctgggtgacagagtgagaccccatctcaaaactaaaacaaaaaaagcagcagcatgtctcctgggcaggtgacagactggccaccttagtaccttgataggtaaaggggcttcgaggctggcctaaaacctgaacctgcagatgtctccaagactctcacatctgaccacaaccaatggaggcctgtggggaggtcagggctgtgagaaggctgcctgcccgtgatgcatggagagaggggcttgggaaaggaggaggccgttctccgagctcctgcagttctgcttcctccccgtgggctcatgccctgggacgtcagtgcctgaagcccgcctctccgttgcaggtgggatcctggcaggtgtgatctcagaccgactggagaaaagggcctccacctgcggcctgatgctgctgctcgcggcccccacggtcagccgtgctgccttccctgggccccaaagcctgcagacagtcccccactgtcctcctcgccagccagcatccttccatctggcccgtgctccactttcctgacaagcccgcttcattccctctcatgcctcctgtcccccgacccctcccttggcacctgcaggcctccaccaggctccctctgccacgtgcacagctgctgctggtttagcatgggccgcgcgcaagctgctcctctctttggggtgcccccttgccccagacaagctcctgcccatcctttgggatccgcaacacctccccaacctcttaggcatcgttgacacctcccgtcatgatgcatggtgcatagtgcttttcaggcatttcgtagctcctgaccttgggctgtgacacccccctctatgccccagttccctcatctggaaaatgggacgtcagtatcaccaccttgcagtgggttagaaacaatgcacatggttactgtttttatcatcgtaacattagaggtaacaggcttgtcagtggacgctgtagctctgcgcgtctgcccctccgctagccccagaacaaggcctggctttcagccatcttggggttctggacatggcccaacacagaacatgaaagaatgctgagtgaagaaatgcttgggtgggccccttgctgccactggggggtgggcagcctgaggacttggcagtcagactcgcaaatcaggagctcaagaaggcagccccttggctgggtaggagctcaggaaggctgcccttggctgggggtgtaaggtgggagcaccctgcagacttccccaggtcgcctggggtgcttggtccaaagccctcgtggtggggacaaggctcagtacctgagacgggagggggcgtggccgtcacgcttttttaggggtttccactcttgggatggctgcctgagaatcacccgccgggtttttgagaagtagatttccagcaatctcgcactgcttgcagccagccatggctttgaccttgtgtcttgatgtccacagctctacatcttctccaccgtcagcaagatggggcttgaggccaccatcggtgagtatggaggccttcctgcttttcttccacacacgtttttaaagttcacacagctggcaagatgaaatactaaaatcaacaggcgcattgagctggtttaactggagcacatggtgtggctaaaattgtccgtgtcctcctttgggcaagaccatctggagaggccggggtctcctctccccagtgcgaggcttgccattctgtgggtttcactgtgagctggaagtgtgcaagcctggtctggggcagtggccctgggcactcagtggagaagccagatgtgaccttgagggcagcccctcctggggccttggtggggctggcggggctgcagcagcctgcgacctgccacctgcaccctgcacccctggtggtgagagcagctcaggctggctcttgggccacgtcaggtagccaggaacctggcggtgtgacctgaacagggtccggccaggagccagggcaggtggccccccagccacctcctcccagctttgtcagctgcccctccaggagcggttgcgtaaccttggaggactattttgaacaccctgcaggcagcgctatcaaactatgcctccagcacttagaagtatgctttctgtcctaatgagccagcagtggggatgtgtggtccccttaaatgttatccagaaggcagcttgcccacaggagaggaagcggaatttcctgtgaccccccctcaggccagaagcttcctcacctgagtgtgagcctagaggagagtttaggaaatgacctggtccggagagagggtgggggtctgccctcagcgagcaccacagcagctgtgggtgaggagaggaaggcctttctgctgcagatgaagcaggggtcagcccaggcccagggtccggcctgtgatcgctccctcatggtggcagctgctgcccttcgagggtggatgagcctgagtcttagggagggtatgatttgctttagctcctcactagacaagtttagaggaagctgtttctgctgcatcccctccctgtgctccccaggcgcccacctcaggctgctcctatgcatgcggggctctctggagggcacatttccattctttgcccctctgcctcccacagccatgctgctgctcagcggagccctggtcagtgggccctacacactcatcaccaccgccgtctccgccgacctggtgagtagaaccgggagagacaccagccctgtgggcaccctgccatgtgccattcatgacaaaagtggcctccattactgttagtaaaactgcatttgcagaagcacgtttttggcagctcacctacacctgtggtctccagccttcccgcacctgccccgctgctcacccttctcctaaaatcatgggcaggttggtgcaaaactcaccgttcagcacaacaaaaggctcttgggcgccatcctcatgactcaggcgccttttcaatccaagggggcaggggagaggtcctgtcctggacgcctctgcagagagagaggggccacgaagaggcgctgggggattcggcccttctcatccaggtaccatgccctgccttggtcacctttgtattggacgtgtcctgaaactgcctgagtgtgcgtgagcatgcagacttgtgtctacatgggcatggaaaattctggaaggatccacatcagaccattagcaatggtcagccttcacggggtagaggcagaggagagactttcacttattttttagacttcaaaatacgtaggttctggatgattttcatattgtgtgttctttattttatatacatattacgtgcatatacaagcatttatttttttgaacgctggttcatttttatagttttaggcttctaggcactgtttcccctgatctttttcccctcctattgtcctcattttggcttttttcccattgtctatgcaacattttcaaaaccagagctcctggcggctgctcaccgaggacctgcgccagccttggtttctcagctctcccctcctcccttcttcccctggcgtttgctattgatcaggttgaattttaggtcctgcagagacatctgacaggggtcccaggaaggccctggctgtcgaggaatccagcagacacgtggatgtgtctgggaaggaaggccggcgcagctcagggcaggggcgcgcgttgcgcaccttcacgcctctcacgctggctgctctggggcctcagggaggagcaggactgtgcggaacaaacgttttttatttgaagagaatcctaagagttcttgtaactagaaccaagcatttctgatgacttttgactcttaaaaacccttgaagttttaactctccaaggcaagcttggggtggagtttaaataatgggaaacaccctcacgatgagttgttttgcagagcagtttgagtaaatggtcatacagaggcttaggtttacttctcatgctgtggcgataactgcacgtctgtttttcctctcttctaggggactcataaaagtctgaaaggcaacgcgcacgccctctccaccgtgacggccatcattgacgggacgggctctgtaggtgcgcagagagttttagctctgggaggtttggtgtcttaggggaaatcacattgtcacatgctcgtgaacaggtacccagggttccaactgcatctataacattgggtgggccggcttcttactatacgagcagatgagcaggggacatcggcacacagagatggtcacgcatgcctgggtggcttcagagagacgggcgtgtgactagctgtgcgtgtccaggttttcacccgaggcagtggttggcaaactacagcccgtgggctaactcaggtccactcattatttatcgccttcatctcaagaaaggcagaatcttatttaaattacagaaaaaccaattggtccaaaatcatacagggttctgagtgttaccagcatcgtcgaagctcttgaagagaattcagtggcatattctggaatttaaaaaggtggcagaataagcaagccatccccttagggagcaggcaggtggagctggcagagtgccagtctcctcgcccatgtgcagcctgacggcacggctgtggccttccctgagcccttgtatggggagcacgcacagtggctgcacctgccaggcgaaaatcaggagttgccacacctgccaggtgaagatcaggagggtccttcctacatgggggacgttatggggggctgcctggtgtggctgtcacagctaataaggaggacctggggtgccaacctgtgtgtcacttgctgcgtgggggtctccagtaaagccgagtgtttggtagatgaaggtggctcggtagacccaggtcagccagaacctggtgctggagccttcccactggctcgtgcagggagctgatgttgttcttggctgcccctggccttggtgccagcaggctggaaacatcacagcacgtttctgggtgcccactgctgtctcagtgatgcagaatgcaaagccctcccgccacatggcctccctgctgctcctccgaaggccaggctggcccccgtgcgggctctttgctctggtcacaccccgtgcctgggaaggtccccacaggtgacctcgtgccgcactccctcgtgccgcactccctcgtgccgcactccctcgtgccgcactccctcgtgccgcactccctcgtgccttgagtctttgcccagatatcatcctctcagcaagacttcctgggaccaccctgctgagaacgcgtgaacccttccgactcggcctccaggcccctctcccgggtctgttctctggagcgctctccccatccgcagtgggattcggtgcactcctctgttttgtctcctctgtctcctgccactggaacggaagctccaggaggacgggatttgcctgattctttgctgtatcccagtgaactgaatgagctgctcccagacagttagaatcgcagccggggcccaggcggctgactgcacagtgaggagccaggccggacaggccccaggcgcccccgcccagccctgggtggcgggaaccccagctccacgctgctgctgctgcgtttccttgttctgcgtttccttgttctggccttgttctgagaagcggcgggcagggtggccgttgccatgtgacacacggcctgattctgagaagcggcgggcagggtggccgttgccatgtcatgcgacacacggcctggttctgagaagtggtgggcagggtggctgttgccatgtgacacacggcctggttctgagaagcggcgggcagggtggccattgccatgtgacacatggcctggttctgagaagcggcaggcagggtggccgttgccatgtcatgtgacacacggcctggttctgagaagcggcaggcagggtggccgttgtcatgcgacacacggcctggttctgagaagtggtgggcagggtggctgttgctcagaaagccacactttggcttttgctgttcaccaaagtgagaccagaccagcctcgtctctgcccttcatgttggttccttcctttcactggatccagaggggctttgagtgtattgggtggcggcagtagtcacccctctgatcttctgtcttgggcatctcagtaggaagtcgggggactgcggggctgagctcagttctggttgacgttgtgactgcgtggccttctcttggccttgtgcctcagtggactgcagtctgcaattcggtctgactctgctgtgaaaccctgttcttaaagctaacttggcgctctactggcaaccccgattgctgttttaaaagcagaggatcagcataaaaaaagagaaggaaatcatgaactaggtgaaaaaacacatttttcttcatattctcaaaatgagagggaagcagaagtctgtggctaagggtggagaccctgcgtctgtgaacagaggccactgcccaccactgcccccaagcaggtggagggaggcacagttctgaatgcctttggcccctcacaaggaaggtggcacacacaccggaccccctctggccttctgttaacctgcaccaagtcctgactgtccgcggagctgccgcgcccaccttgatggctgctgcgttacaccagaggcaggaccaggacctgactcctccaggctccactgcccatcagtgcctgctgcctgctcagtgaatggtcaccatggaaacggcgctcaggcctacccacccccaccaccacgccttggtcattgttccttccatgagtgagtgctgcccagcaagacaaagtacaggctccagtgggaaggccaccatgtcagccaagtcccttcccgaaggaggtgcccgcatgcttattcagtgtcactgtccactccttggcagtgactcgggtggaggcgaaacatgactaatcgtaaatcacccctgccttctcccaagtgccacacggtttgttgacacggtgtgcgcctggggcgttcacagtgcttagaatcgcagaggttgccgtttctgtacatttcatgcagagcaattaaatagggcactgcatttttcttcaagttaatttttatttattaaagtaaaacataatgtaccttagaagctagacagtcctacaagcttattatgttgtacagcggcgttccgtccccctccccagccctctctttctagaggcagccaatttcagctgcctctctctgcttacctacgtatttccatgtttcttggttcatcatctgaacgtcatcagctgtgctcctcttacggaagaggggacctggctcccttccaccccgacattgcccacccctcctcctcctcagttataccagccatgcttctgcccttcactttccagccaagaaacaaactttaattatgcaccctcaatagatacatcttgttttttcccgggtaagtaaacatctcttttcctctttttcacatttccgacaaagttcttccttccctgcaccgtggtcgccatcctgccctgccccacccctttcacgccatcagcctcactccgcccactgcgcggcttggccccagagcacctgtcaccacggtgctgggagtccccctcctctcttgcctgcgacacagccctagcagtctagacccctgtttaccactcctgtggtggaaactggctcctagcagcttcctgagttaggggaggtgggttctgcaagcttacaagtgcgtgatggctggattctgctctcgcctgaggcaatgtggacgtggaaacaccttctcttcagaacccccgtcttccagcctccattgctgtcactgacacgttcacagacattctgaccccagcccttgctttctgaccttctcttttttctcttagatctccaggttcccttccttaccccgggagcctttcttcatccaccgtcctggggcacctggtggcaccttcagtctggaaacacctgcccttcactttaggggaattgggcccctgttcgtttgataagttttcctaccattttctgatttgttttttctttctggaaaatgtattagtcagatgtaggcttttctggattaatccttcaactttcctttctttctttcccttcctgcctgtctccctgttctttcttacactttctcagggagattcttgactgtattttccaactttgtatcgaccattttacttttcctgccatattttcaatgtttactgatgtttctctgccctttcagtgcatcctgttttatttcatgttagactgaatcatgtgaaattgataacaggttttcagccacacacacacaaaaaaaaaaaaaagagtgtgtcctgaggttcagcttagtcttctgttggctctctggggggaggttcaacttagtcttctgttggctctctgtgggtgctgtgagctctgggaatgttcttctcctccaggctccctcctgccagcttgcttgctttcacgttggggtgttccccagacacagggcagacctaggttgccccttcatcacttcccatggaagaaggggccctgcatagtggtttgaagtctctctgtggggacagtgtgctggctgctggtctccaggcagtgggaccctgcggaacctgcaggaggagactccttcagtgcccaggggagcctgggtccagctgccaacatccttgccatggcatggaagcttggtggaagctggtgtctttccccagatcccctgtcgcctgttaggtgagcatccctgtcctgcactgggcttagtgtccccacgggttaagctgcgctgtcctgcacgggggcatcaggaggagtctctttatcagtgaggatgagaaaagagacctgggatccgaggtgcggcagagggaatgtagctaacagtttgtgataaaagactcaacccatgcaccttttttctcttgctgacccccttccgttcccactgcgttcctccttccttgccttcccctcccctgtctcttgggctccgctgggcctcgctctgctccaggtgtccctgtgctgtctccctctgaggatgctcagtggagcagggaacactggaggctgtgttagctgtcagcccttctgtgtccatcttccaaaactacgtgcccttcggtgggaggatttatcatctttagaagtcagtgatggcgcagttcatgttgcttgggggtgtggagataacacatgagtagccgaccatgtttacctggaagttctgagaattaaaaaaaaaaacatacaattgctcctgggattataaaatagtaagtgcactttgtgaacacttgaaaaaaacaagtgcctagggcatgaaagaccctggttatcttacctctcagagttgaatatgtcagttcataggttggtggaaattcttcatgctttttcccatgcatctaccaaaacaggccatcctacatgtgtatcagaattcatttcagtccctcttggtaaaatgcaccagatgctacaaaacacattcttaaacagcagtccttgggcatttagggggatacgttatttgttttcatcatttaaaaacacatcttgacataatttcagactttgagaaagttgcagaaatagtacaaagaattcagacattttagtacatgtggttcatcatgcacccgtgtttttacacacacacatgcacacacacatatatgcacacacacatgcataatttttctgaaccacttaagagtaagatgcacacatgctgcccctttcctcgtaactattcagcatgtacttcctaaaaacaaggagttccatgacagaccacagtgcatgatcagaatcagaaagtgagcattgaaagaatattagtatctacaattcttattcaaattttacccagttacatttttatagcataagaatatctaagattgtgcattgaattcagatttccttacgtgtactcaagaaaataatgggagtgttggatgaaaagaatgaacattgcaatgtcaacacacatttttaggatggttctgggaaaaggctgtgccagctctgccttcccagtacggaggcgtacaggtggagtatccttatctgaagtacttgggaccagaagtggttatgtctttttattttttcagattgtgggatatttgcattacactggttgagcatctcaaatcccaattctgaaatgccccagtgagcatttcctttgagtgtcagcactcaaaaagttacaaattctggagattttggatttcaggttttcagatttggaaggctcaacctatactaggccttgtacccgctcccaatctgataggccaggatgaggtagtgtagttccatatgtgttcctttcattgtgagtgaggtgttgagccccattctctgtggctgctagttatgtgctgggattttctctaaacagcaccatgtgtgtccatttgcctgatttcaggagcagccctgggccccctgctggctgggctcctctccccgtccggctggagcaatgtgttttacatgctgatgtttgcagatgcctgtgccttactggtaagtcggcctatttttagtccaatccaccttgaatgcagatctctgtggttgtgtccaaacactggtggaactttctcccatgcattcctgagttatcagagaggtttgggtcttcccatcttttctaaatatgcgtggtctaaagctccttctctctctgattagaaaaagtcagaaacagaagcaggacagtcttgctctgcagccttgggcgggatagcacaaaggccaggagcgtggagctccgtggctctagatcctgcctgtcacctgtcatgtgtgtgacttgggcaggtttcgtaacctctgctccacagtttccacagctttaaaatgggcatgataatggcacccagtgacaagattgttgtgggaattaaagcagatgatacacagagcctggcctcccagtggtcatcagtgtcctggtgtccctcctgcagccatgctgtcagacggcgggagcggccccaacttctttcacctgaagggatgggagagaataaaggagcaaagaggttgccagtgcagacactgagtcgccttctggcttctgcccccttttctctgggctcctgcttctgtgccctcctgtgttgagaaagtttgaggttttcccctgggtaaggaagaccagtgatgatgtcacagtcacatagatgtgcagctgtgaggggtgcatacacatctttacaagtcacctggccacaaagtccccagacccacagccatgcctctcctctcacttcaccagacaaaaccttaggctgatcccaataaaaatgagttgagaatttcagaaatatcaactcactcaattaaatgaaagtcttatattttaattccaggaaattctaaaactcaacttccccaccacatacaaaatcaaataccgactctcaacctatgaacttactaggtttaaatggctgttctttggatcatctgtgggttcttttaatgcctgaatgttctaatgaagcctccagatggatttccactaagtagcagtaaaattcctgtcattacaactgttcagagaatctgaaatatcttctttagaactatctggtaatatatattgaaaattgttttgatgcttagccaaactcataagaaagtaaaggaactccccaggagccagaattgtaaaggcaatataaatacacaagctcaggaatcaacgggttggggtggttgtgcccacactgggtaagagacaaggcgttaggctggcacaagatgaagatttggaactggagacttcgtcatagagccaggaccctcgaagagccatgcttgcagtgaaagagtatactagatgatatctgcacactggcacaggaagacaatgggaatctgcccatcttagccagattagggggaagaaatctcccttgaaaatttttagccatagacctccccacagtcagctttaatctttgagcttatataaatatattttaaatgagcaaagttggtccttaggcagtaatacagaagcaaatagggacaaatctcaaccctgcagcataggatttctgtagctaacaccctacaaaagatgagctcacaatccaaaataatgaaacataaggaagcaatccacattgaatgacagtaacagacataaaaaatggtggaattggactcccccaaaactgcagataaaagagttatgtaaactaaaaataaatatatgcaatgttactaatgacataagaaaaaggaactgacctcatgaaaaaaagaacaagacactattgaaaagacagagcaggcttcaaaaacaaccaaacaggagttatagaaatgaaaaatgtgatctttagcctggaaaaagactcaatggatgggttagaaaagcaaattagataccgctgaagagaagattactgaagtgaaatatagatatgaagaaattatccagaattcagcacaaaaagagagatggaaaatattagagagaaattaaatataaaatggaggaccaaatgagatggcctaaagttatctgaaagtaattccagaggaagatgatagactggatttgaagcaatattttaagacaaaatagctgagaattttccagatacatgaaagacaaacattcttagattcaggaatcaaatgacttagaattctgtacctagataaacttgcacacaagagtaagggtgaagtgaaaacatttttaaccaaagatgctcccagcaaaaattgctaaacaatgtatttagagaaggaagatagatccagaaggaaagtctgagatgcaaggagaaatgcaagcaaaaaaaaagtgatattcctaaggatgaatctaaaggagtattgaccatataaaataggggccagctaactgtggcctatttttgtgtgatcctccagctgggaatggtttatatttttaaatatgtctttaaaaaatcaacaaaagaatgtgcaacagaaaccatatggctgcaaagcctgaaatatttactatctagacctttacagaaaaagctttctgactctcagtttaaaacaacagcaataatgactaatttgggcaatataaaaaagaactgaaatactgaaaatgtaaggtacaagtgggacaatgagagttccagtacactgcagttcttatgttgtcaagccaatagcaatagaatgtgtaaccttcaaggcaatacagggaaatgaagacttaatctaagagaacctagggtcaggggaagcatagaaaaaaacagggtaaatacagaaatacagagcaacatggatgaaaatgatcccagcatgccagcaacacagtgacaataaatggacttaaactcatcagttaggagcagagattgtcaggttgcttttaaaaatacaggcactggttatttacaagaaacacacctgctacactggaattccgaaaagacaaaagtaaaagaatgggaaactacacgacaggtaaataataaccagaggaagccggatttgctgcgttggaagaaagagacctaaagctgaagcacttgggagacgggggcttgtcgcagtggagaaggaactataccaggatgtgcagcaggtccgtgagcttgagttgggcttttcaaacctaagaactagacatacctttttctcttcactgatcaacatgctttttggtatcttttcaccaaaatagacaagtgtttcctcccgagtctggagctgagaacctccatgatctgagcaggtgtcctggggggccagagggcaccatgcttcctgcctcacaacacacactgatggccagctccagggcctgcaggactgcctggcgcacgaccgaaggcctcaggtctccagtgcgtgtcgcctgggctcctggagttggtagggcccctccttgttggtcattcttgcatgcgtgagccaaacacgtgggcatgttttgaaattggatctctgttcttcagaactgtcaccatttacagttcatcccgtacccacagataacacttgctactatattcttcatctttttctctcttaatgatcagcttttcataatcataggcctcttcgggctagcacttttcatacatcacacttggcaggatgtagatgtgggtaaggtaccagctcaaacacaataagcctgtgccggtagttggagctagaggttcagattcacacagatggatttatttaacaaaaatcttgctattgtcaccagcactattgttcgtacctgccgtgttcccacgacctttaccacctaattgtcgcaaacacctttcatgcaccaagcagagcagctggatgcatcttatctgtaggaggggcccctgttctctccagcttgaactcacctcatacaagggactcctaagctcctacttgaaccacaagcacctaagaaaatagaagagtttctgccttctagagctctggcctgaggcttggtggtggggccatgtgtttggtttttaagtagcccctcgagaccctccagcaccccttccctgcctcccctggaccagtgatccaccctgggtctgagggcatctgctgccctctaagaacgaggggccacgtccagggagagccctcctgtgggctgatgtcccacttggggagagactggatccacactggaaaatgcactagttaaattggaggtagcacaatcatttgtctggatttgtaggctggcgttgagccctcaaacatgtgaagggcacggagttaaagctctgggtccggcgaggagccaaggctgaggcagtgatgttggtggaaagccctgggccccggccaggcctggcctccaaggggctcccagtggggtgcggctgtcctgtgacagcctcttcagaccccagggctggcgccagaggaagtgctcacctggctttagagtcacctgagaagctcgcaggtccacccactgggccacccgcattatggtcctcttgtctttatttcctttttcccactgtggacatttcatgattggattaattttagtctaaacgtgacttgaacccagaagtagttcaggctgcatctctcccaaaagccttgttttcagggcagctcctggttcttcgtgggccttcatcagacagccctgccctcatcagacagccctgcccacaggagcccaggcctccggctgagcatgcaagccccgctgctcttgcagggaggccaccccagggaaggtgctgtggggagagagccacccgcccaggccttgcgggccaggtcctcatggtgcccacggcgcgggccgccctgtgcctgctccagtaacaggtgggctcacctttgttttggtgcagttcctgatccgcctcatacacaaggagctgagctgcccagggtcagctacgggggaccaagttccgtaagtcccactcgggccctgtctccgtgcgtgaaagccggctccaaagtgccttctgtcctatctgccttctgcacctggctttcctgaaagaaagaaaacgcgtggcttatcttttcacggcacgccaccttcactctcactttttcttttctaataaatacctctggatgggttagtggtaatctctcctcaaaccctgagtggaaaatgtgagggaattgccgtctttggcattctgttggagctgcagccccccgagctctccttgccttcctgctcgcccccttctccctccctcctcttttccctccccccttggtcctccctcgctcccttctcacttcttcctggcccccagaaggctgcgggaaaggtgcaagggtttatccagcatccagcacccctgcaggagaggaatccctgctgggccgggagggcagctggctccccataggatttgcacatggtgtgtgaagttcagcatctcttgctgagccactgctggctgttagagcagctcttctttcaacctttctttcagatttaaggaacagtgacaccccaccccagtcccgtggagggggtctgggcccacccttcacaactgcctttcaaggacagttcagacaaagggccctgcatggaaagagtgacctccctttgccttttgcacacgcacctggaaaagacacagaagccaacctgagaacccctggtgctattttaaaggagacatattgctgaacagcagtgagaaaagtctgcaggaactgctgcctgagccaagccagagaaccgaagacccggccggccctggcctcacaggcgtgtgcccatgcagccacccaaatgcacgcgtgacaacaaggccgggagggtggggggggtgcacaggtagccccgaccctctcaggcattccagccacagaacatcaaagtgagcgagtactgcgctggctgtggcttcagagaacctgtatgtgccacatggaaaaacaggacaccagagcccaccagacagtgccggccagcagagaagcagagagccagcgccacacaacatcaagaaggccgacaaccaggttggaaaccaagacggagctcagacccaccacatcgccccagaggcttttccagcacccatgatgtttcggactgacctaaaaactaattgtcgagaagccaagggtgaggaggcaggaagcacctccggttggaggcacccaggcttgccagccacagagcgccccaaagtcaccgtcatcccagcccctggccttcctgctgccctccggggccatggcactgctgttcagctcaggcacaggggcacagcagaggtttgggaagcggtctccccaccggcactgggattggcgggtccaagcccagcaaccggcttcgctccacaacacacaccacacctgggactgtttttaatacatagcaacagactgggttatttatttaagatgtgtattgtgtcatatgaagtttaagagacataaatggcattttgttatttattaagacaaactccaattgttctctggctgtttttttcagttgtgtctagcaaaatacttatctgccctttgaaataaaatgtttttgtttaaaaaatctcagaacactcagagaatgttgatgatttctgcttacatttccattacgctaaaaaagggaacttccaaatcgtgttgtgtgttttgggttttctcaggcttggacacattgaggtttctcgggtttggacacatactgggaaaagaccatttccagcagaaaaggggcctacctctcggtcccttgtttgcacagaaggccaagctgaagtaaacagccatctgggtattttataaatcacgcagtttaaagaatatcctaagatttgtccttgacgaggaggtgtcacaccccgtggtggtggggaaaggtgctgaccttgggaactacatggtggggtccaggctttcaaacgtcctcagaatgctgaccgtccagatgtgcatggtgcgggctttctctggatggagtgctgtggaagttcacttggggacctctcacagcagcagggcaaaggtcagaaacaacacactgtgtgtcccgcagttctcaggggcctcctgcttgagctctgcggagaagcccacaggaggaacagacctggctgtggcggcttctgtgtgccagctgccccactagattggctcactctctttttaatggcaagttatttatacatttaaaagatttctgctaaaaaagaacttccctaaacaccaaatggatggagtgtgtttcccacacacgcagcgcactcagcttgtgctggcctttcccggtcctccacccaatgcttcccgctcctgggagcctcccactttccctctctccctgacctggctccaggcaccagtccagccctctcccgctggtgtcacagtggcctgggctgccctgagcccctgccggctgccatccctgaggacgggcaccagccccgtgctcaccacagggcacctcttccctctgggtgtgcagcactcgtatccatggggtgaacaagcgagggatgacgcagatggcacagtatcattacaggatgcacagagggctttttccataaacaaaattctttgcattcactgccccctgcctctccagaactgtcccctctgaggcctcatctagtcagaggcccagggctggtgggccggagcggaccttcctcaccccatagccaccagccagcattcagcacagcagctttgaggtggcgatcgctatttccccaactcaatgaactaaagtactagaagaaaatctcccacaactcacaaaggaagagcaacttcccatttctgaaccctctgagctaaaccctgagaacttttggaaatggagagtcgatcctttttttaaaatgaagagtatacacacagctatttttttaaagcaatttagcggaaattcaccttgattcatggatggaagatttcattatgacttttaaggaaaaaagtacatgatttcaatataaaaatacatcttcatttgagcatagctgaggtattttccatctgcaaacagccagctctgagacacacacacttgccgtcctgtggaagcgtggctctgcctgtcacgcacgtctgcgcttgccgtcctgtggaagcgtggctctgcctgtcacgcacgtctgcgcttgccgtcctgtggaagcgtggctctgcctgtcacgcacgtgtgcgcttagtgcacatcactaagactctcctattcatgttgacaaaaaaatgccggatcatggaaacacaagctggtgacagggccaacaaaagagctcaaggtgggactccagctctccagcctgtctgtaggtaggaaaaactactcctggaagctcacctcagtgaatgcacctcagagtccaagagctgccgcgaatacagggcctggtggctgctatactgtgcgtctcagagcagagccagctctcccatcgccagcttgtaaaatccaagaaaacgaaattgcttgataaactacgagctgaaaaaaaatgagccctgatttattattattcaattcaacagacataaaaaccactctgctaaatggccacaggaccactccagtcttgactcagcagagcacagctgggccaggtgagaagcaggtgtgagggcactgtgtcccttgcaggctgtgcccacaaggcacccaggctgtcccccacagggctccgatgcgccaggtcacctccattcccaaggctccgcattgacccacagtctctgcacaggacaccccaggtccctggagggcagtagaagaggctgtagcactggctgccaaggcaggggcagctgccaggcccaccagagaccacgggcagtaggcaggtcacttcccagggtggggggggggctgaggtgggagcacaacctaggcccctcctggggaggtggtggagtcagaatcacgtaagagccaaagttccagtccctcagtgccggctccattgtcccctggacttcccttacaaaccacagatgcaaagagagcacttctcagaatctccacacagccacggtggagcactcaacccacgcgaccctcgggcgcaggtgctgggtgactgccctggccatgtgccctgtggcccgcagaatgacacctcatccaggatggaagcgggaaccaaaagcctggctgagagaccccaggggcctgagtcgggaggagcgatggttcatttggaacccagtggtgcccttcactgagtttgggttaactgtcatcacttccctgtcccgtgcgttccaacgtgccctgcccctgagaacagatccaagggactctgaagaacgcagtcctgagctgcttgctcattctgaagccagctcttgttgctggccccctccaagggggcctgtgagctccagacatggggataatgtggggtctgggccacccgtagtggtggccaagtgcagcatgttccccgccacaccccttgggagctggaatttaactccagctgctgaacacaggcagtgtttctggcacccagggcctcaccctcccaggagagtccatcattgctgagccagtcgcaggtcaccatgaagcatcgccctgggcagcaagtgggatgcaggggcacagcagggcacgtcccaggcggctgagaaagtccacggagggcaagggcaggggcgtgcgccatcgtcggagacagtcggggtgggcagcaccctggactgctgggaaggacagtggggggagggtggaaggcaggggagcccttgccagttgagaatttcttgatccttggaattggtccccaacatcctctgggacacgcttaacaatggtcaggtctggtaactgaaagaagcaattgaggtaaatatctcaatcaaccgaggtttattctgccagcgttagggcatgtccaggaaaacacaagccacagacacatctgtggctgtttttctaaagaggcttacaagaggtttggtatttagacattgaggtgaggtgaatggtgacattcttgtgagacttcagttagcacccagtaaatctgcatttcacataaggtaaatatttgaagaagaaaagggagcaaaggaggaatccattttgcagacttctctgggtaggtggaggaacacttgatctcgtcttgtctttggcctgcccctgggaggacaagcttgtaaaggacattatcagcatagaatggaacagactctcattttaggagctggacttacattgcacacctaaatttatgattggcatgtccttgtttatgggaggccagcaaagaatgtactgatgaaagatctgtgggagcacttgcagacggctgtggcctccacctttctgtggggacctggctgatgtatcctattcatgacagctgtccatacggatgcagcgttgcatgattctcactccaggcttaatcttccctttggcataagaagtttgggcatcctgtgatttttacgcccacagccacttttttttttttttttttttgagacggagtctcgctctgtcaccaggctggagtgaagtggcgccatctcagctcactgcaacctctgcctcctgggttcaagcagttctcatccctcagcctcccaagtggctgggattacaggcacgagccaccacgcccagctaatttttgtatttttagtagagacagggtttcaccatgttggccaggctggtctcaaactcctgatctcatgatccgaccacctcgacctcccaaagtgctgggattacaggcgtcagccaccaagcccaaccagccaggccaatttttgaccaaaacaggatcggtgagtggatgtcatgtgtcatttgggccaacagtgaacacggactttgaaggcatcttgatccagaatattccattcccttcttccttgacttggtaataaccaagacggttctgtctctctttgaaattctaaaatgaggcaggcattggacattctgttactgttaaaatccacaccctgcctgcctctaaaaggaacttggagtggagatgcagaaaaatggcaggtgcgtttaaggagtccctgcaccccacgacgaagtgacagccacacccagacatcctggagcccaaaaggaggagctagtggctctggaggggcagcctctccgggtctcaagggctattattattattttttttttttttttggaactgaggtgacatttacataacatgcaaataatcatttcaaagcatacggtcggtggcgtctggcgcattcacagtgctgtgcagccaccagctctctcaaggtcaacacgtctcatcaccccagaagatcactagaacctggtaagcgatagctccccttcccctcccatttaaaatgagagttttcaaggagattgggtccagggtggctgtgagcactaaaattctggagcaaggtgaaaaatagaccccacttctccttccatgctaagccactgattcattaaagaaacacagggaaggagcctatactcaaaattagcatctccagtggaaacatggcttgagaattatgcgtccttacggaccagagaccaggcctccaagaattctcccaggaaacaaatgtccagcaggaccatggctgggctgtcacgtccagaagccaccaggccacagcaggggccccggcaggcaggccaccgtcggaagccggcaggccaccgtcggaagccaccagaccacagcaggggccccggcaggcaggccacggtccagaagccaccaggccacagcaggggccccggcagacaggccacggtccagaagccaccaggccacagcaggggccctggcaggcaggccacggtccggaagccaccaggccacaggaggggccccggcaggcaggccacggtcggaagccaccaggccacagcaggggcccccggcaggcaggccatggttggggctgctttggcctctctttcccttttgcaccagctttcaataaggctttcttcttccacgtccccacgaccccttgatcgtccacctgctattggcagcgaagccttgaggctctcatggtgtgtccccacatgtccgcagacgggaaggagtcaccccagcctcctggggcagcaggatgcagcatatctgactctcatcacactttctgtatctcagcaagttaccaacatttctttgtatttacttctggtaagaacaaaaaccttagctggggccttggctgcccttggagctgctgggaaagttacatgagtagaagggttgggttaaagcatggaaacacctctgtctacaccagctcacgataagcctgaagaggagtttggagtccctcagacgctttcggcaccacttagtcagcggggggaataatagctttccgggaaataggcccgagacgcgggaagggaagggaagggaaccccgtgggaaagaccttactcattctgccccttgcagtcagcacctgaggagaagcagcggggaaaagaagtgccaagctcgccgcgttgaccagtgtcagggccgagtagccacaggacagaactgagaagcgagtaccaacatcaagcctgccgcgccatttatatccacgcatgcgtttccccttacctgcaccgagcctcccgccccgtttacatccacgcaggcgtttccccttacctgcaccgagcctccattcccgtttatatccacgcaggcgtttccccttacctgcaccgagcctcccgccccgtttacatccacgcaggcgtttccccttacctgcaccgagcctcccgccccgtttacatccacgcaggcgtttccccttacctgcaccgagcctcccgccccgtttacatccacgcaggcgtttccccttacctgcaccgagcctcccgccccgtttacatccacgcaggcgtttccccttacctgcaccgagcctcccgccccgtttacatccacgcaggcgtttccccttacctacaccgagcctcccgccccgtttacatccacgcaggcgtttccccttacctgcaccgagcctcccgccccgtttacatccacgcaggcgtttccccttacctgcaccgagcctcccgccccgtttacatccacgcaggcgtttccccttacctgcaccgagcctgccgccccgtttacatccacgcaggcgtttccccttacctgcaccgagcctgccgccccgtttacatccacgcaggcgtttccccttacctgcaccgagcctcccgccccgtttatatccacgcaggcgtttccccttacctgcaccgagcctccattcccgtttacatccacgcaggcgtttccccttacctgcaccgagcctcccgccccgtttacatccacgcaggcgtttccccttacctgcaccgagcctgccgccccgtttacatccacgcaggcgtttccccttacctgcaccgagcctcccgccccgtttatatccacgcaggcgtttccccttacctgcaccgagcctccattcccgtttacatccacgcaggcgtttccccttacctgcaccgagcctcccgccccgtttacatccacgcaggcgtttccccttacctgcac

SEQ ID NO: 36626 - DNA, 1948 bp, Homo sapiens
gttacagatacggaaacaggctcggaggtgcaatctctggctgtgtagacagaacagggagttggaacacggccttatgcgtttcctcactctcacataccagcgggcagggagagatccggggaggagttgcacttgcccccggcggaaatctccaaaaatctgcaaaaatgtattccctggtaccgctttgggctccggtgggaccaagcgaaattccgagaccgaaacggatgcgcgctgcggcccagggtgcgggtctggaccgcctcctccgtggtggacgaatccgaggagcaggactccccgcaacccagccccagccccagccccagccccgccgcgtccccagctgtcacgctgcgcgcagcgggtggggcctggggttcctggacagaggaggactacgcgtgtccttgggcggagaagggaggtgactccggcggaagaggacaaggcagaatgcaggcccttcgggtgaggcccccatgggctgggccggagccccccacccagaaaaccccgccctaatacgcgactctccaagtgcccccgcatctagggccttggaacgtgagccaccttcagggcctgggactccccgctaaacagcctgggtcccttcccccacaatccactcttcggagacaactggggacccccaccccggcccaaagccccgggtttgaacttgacatctcgggaacccttaacactggcctcacccgggccttctcaggcagcctggacgctcccggggacctccattccggtccccacgttcccgggacctggtttcctccctttaatccaggaaaccctcccccaacaaaaatctcaggacttaggccccccagaacaaagtccttctgggtcctctcccttccaggaccctctaggcagcccggtcacccccaggccagactccagggcgagtcccctcccaacccagctggcagttcgcgggtaacagaatccaagctattaccctcctcgcctttgggacgctcgctagggatggggctgtccccacgtccaggcctcagagagcggggtcccacttcaggacacccctccaggtgcctccaatacccgcccacctcccaccccgcaggtgtcccaggcgctgatccgctccttcagctccaccgcccggaaccgctttcagaaccgagtgcgcgagaaacagaagctcttccaggtggggggtcggggggggtggggatccgacgcgccagccgggagcgcgccgagccggggcaggcggggcgcgctctaaggagcagccagcacccctttctcatcagacacccccacatccaggaggacaatgacatcccgttgtacctgaagggcggcatcgttgacaacatcctgtaccgagtgacaatgacgctgtgtctgggcggtgagcgcagggcccgtctgggctgcgggggaggcggggctggacccagagtaagaggtggctggtttctgggcaggactgaccaggatctgggttgggggttggcgtttaggaagggggtcgagtactgagctggagtcaggcctgcagggaggggagtaactagggtttgggctcttgtcccaggacgggggctgggttagtggtggggctgaggcccagggaggagtcggggagaaagctcccagcccggtctagatcaaagccagggggctttacaataggagtccaatctgggaagggagctggagtccgaactagagctggggtccaggctgggaaccagggagcctgaaggccttaaaagcctgggatgtccagggaggggattaggtctcattctgtctccaacgcttcccctttctaggcactgtctacagcttgtactcccttggctgggcctccttccccaggaattaagaccaagaagcctggggggcctgagagacttgaacaagtgtcaataaacgctggcctctg

SEQ ID NO: 36627 - DNA, 36707 bp, Homo sapiens
gccgtccaagggtccattggttgccatagagatcgtcgagcgctgggcctgtgatcgctgaggggcgagcagttgcgaccctgggctcctggggacctgagcgttatgtctttccgcgacctccgcagtaaggcagccccgcgcccctgtgacctgcgggtcttccagagattcagggctcccgcccgccgggtcccctgtgtaggcgatccctgaggcttgcgctgccggaggctcctttcgggcctctgcgcctcagggaccgcctgacccgcggctgcaacccggccgagcgtcccaggcccttcttcggccatttctagcgaggatggaaagttctctatctgccactggccgcgtgtggctcagaacgcttgaaatgtggctagtgcagatgaataactgaatttttaagtgtaatttatttctgtttgtgtagctgcatgccgctcttcgctaccgtattggaaaatgcatggagagtttagagactattttttgagttgggttagcttagcgcttagaaaaccgaacagcaggccgggcgcggtggctcacgcccgtaagcccaacactttgggaggccgaggcgggcgaatcacctgaggtcgggagttcgagaccagcctgaccaacatggagaaaccccgtctctactaaaattacaaaattagccgggggtggtggcgggcgcctgtaatcccagctactcgggagtctgaagcaggagaatcgctttggaggttgcggtgagccgagatcgggccattgcactccagcctaggcaacaagagcgaaacaacatctcaaaaaacaaaaaacaaaccaaaaaaaaaacaaccagcaacgaaaccgaggagaggaggctgggtgataatcattgcggctaacattttttgagttttaacgatctgccagggcccgctctgtgttatgcgcatttcattttaatcatctgaacaactctgtgccccctgtatttggtagtgaggaaacgggcacagagaggtcaggtaacttgggcaggtgatacaggcggtaggaggtggcactggggcttgaattcaggttgcctgaactccagacatcctgaactccatctgcatcctttctgcagggctggtaaggagaagggagctcgaattcctttgctaagagggtggggaagtggaagaacgaggctaagagtgttggttacggctgggcgcagtgggtcacgcctgtaatcccagccctttggaagaccgaggcaggcggatcacttaatttcaggagttctagactagcctagctaacatggcgaaaccctgccgctgctaaaaattcaaaaaattagccgggcatggtggcgcgcgtctgtagtcccaggtacttgggaagctgaggcaggagaattgcttgattccgggaggcagaggttgcagtgagccaagatggcaccactgcgctccaccctggccgacagagtgagactgtctttaaaaaaaaaaaaaaaaaaggaaaggtagatgatgattgccaatttggtgtgatccgaggggtctcttaaagccagttttctcgtccaattgttggtgcctgaaattttagcattagagattactccttttggttatgaattgctcttttctacaatgtaaaaatatctaggaagacgcattaccttttatccatgcagccactgagcaccagagtgtgaatcctgccctctggggtttgaaggtttttggtggccacacatcatgcaggatgactgtctcctcccacatagtttttagagaggccagcaccctgccgggggacgtagaatggggttttgttggggagcgcacacacggagatttcggaatattttgatcttaaattaatgctctgcagttgtgcagtgtatggtaaggatcttactcaaattagtgtctattttgacaataacaccgcagcattaacagaacttgactagtacctagtggtcaggagtatttaggcagtgccttactgtgtgaaggaaaggctgctgctttcttttctgttctttttttgagacagtcttgctctgtctcccaggctggagtgcagtggtgtgatcttagctcactgcaacctctgcctcccagcaattctcctgccccagcctccccagtaactggaattataggcgcccgccaccacactcacctaacttttgtatttttatttttattttattcttttctttttttgagatggagtctcgctctgtcacccaggctggagtgcagtgacgcgatctcggctcactgcaagctccgcctcctgggttcacgccattctcctgcctcagcctcctagtagctgggactacaggtgcccgccaccacacctggctaatttttttgtatttttagtagagacggggtttcaccgtgttagccaggatggtctcaatctcctgaccttgtgatccactcgcctcggcctcccagagtgctgggattacaggcgtgagccactgtgcccggcaacttttgtatttttagtagaggtggggtttcaccattttggtcaggctggtcttgaactcctgacctcaggtgatctaccctcctcggctcccaaagtgctgagattacaggcgtgaaccacccgcgcctggccttttttgtttttgtttttgagacagggtctcactctgtcacccaggctggagtgcagtcacatgatctgagcttactgcaacctcctgggcccaggtgatcgtcccacctcagcctgctgaatagctgagaccacaggcatgcaccaccacacccagttaattttttttttaatctctgtattcacatttcccagaaaacagttacagagtccctttgtgactttgctgtttcctgtgctcacactttctgtttcattgtcttgcgaagtctgacctgacttgcagtacctaggtaggttatttgtgaacattgatggaccattttgaacatggatcttcaagaagagtgcagacagaccttaaataaccaggaagcacactgaatgtagatcttggtacatatgggaactcaacaaatgtttgtggtgttcatttccaagtcctgctctcttgaaagcactaaggcttttcctgaggtgaccccaacctatggatcaacaagtattagtattactgtttcttaatctgttttatagtaaatctaaatatggttgtatagttcaaccactctatttaagatttctctaaatacaaggcgactgatctttaaaacttgtgttatttgggtcctatgtggtcactaaaattaaaaaaaaagacaactcagaaacatgaatgtcatcctacggattcccctcagaaataaccactgttaacattttaaaacactttttaatcagctgaatttgagtcaaaccactgttgacatttaaaaatactttttcttcatgacattttataaggacgggtgtttcttccttttagcagtaaaaagaaatgagatactaaagagagaaatgaaattcacagctaatccctcaattccattttcatgtatagccatctacttctcccattgaacttaaatatatgctttttaggtagcatttttggtattttaaattttatctcctttttgctttcccttgtagaaagttgacaaatagtccctaaagctgtcaataggttggaaataagaaggaaaagtaaagacaatatctaagttaataagtagttgctgtgtgatggggaactgaatgaattgtatttttccttggacagatttcacagagatgatgagagccctgggataccctcgacatatttctatggaaaatttccgtacacccaattttggacttgtatctgaagtgcttctctggcttgtgaaaaggttcgaacggcactttattgacatctaagagtgaatactgggttttatttattagtcatctagaaaacaggacacagctgtgatgctgcaaaagggaaagtttttggaatttgacagacccagctgtattctgttacaaaggagttgtggctgggcacagtggctcactgctctcatcccagcacttcataatctcagtcattcaagactagcctcatcaacatagcaagaccctgtctccatacacaaaagaacaattagctgagcctgggtggtacacactcatagttccagcgactcaggaggctgaggcaggaggatcacttgatcccaggagtttgaggctgcagtgccactgatcatgctattgcacaccagcccgggcagattgagactgtgtctcaaaaaacaaaatcaggccgggcgcagtggctcacgcctgtaatcccagcactttgggaggccgaggcgggtggatcacgaggtcaggagatcaagaccatcctggctaacacggtgaaaccccatctctattaaaaacacaaaaaattagccaggcgtggtggcgggcgcctgtggtcccagctactcaggaggctgaggcaggagaatggagtgaacccgggaggcggagcatgcagtgagccgaagtgtgcagtgagccgagatagcgccactgcagttcagcctgggtgaaagagcgagactccgtctcaaaaaaaaaaaaaaaaaaaaaaaatcagtggagtttaaagaatgctgtgggagtgggaaatataccaggaagtcgtgaaaggagacgactattcctcagtaggatgctgggccaggctgctcttcagcccctcatggcagagtgacaggggcctttttgcacattctgatcagtacactggattagaaataatggagatttctttttctgtgaaaaaattgaatatgttatatgattcagggttggcagctttttctgttaaggaccagataatattttaccttttgctaaatataaaattcataagatctctattgcgtctcttctttttgttaaaatgtaaaaacagttcttagcttgcaggctgtacaggtcggaggctgcagtctgctgacccctggtttcaataccttgaagaaaataacttcaccaactctgctgctgcttagagctgactaatcggccctagcactgatctctgagtcaagggctgtcagccagggtagcagttctgattagcttcatgacatggtgagatctgagagagatttaattttataagctgagatccacatttagtttttgaaatctgtttttcttaggtggggatttgctcccttggtatttggttttgcttttgaagtttgccttgatctcactctcccacttggggacttggagagcgttgtgttccagacccgctgtcctctcagttgcccacattctctttagtagactttctccttggttaacccgtgctctctcctcttacctctcttgatagatatgagccccagactgacatcccgcctgacgtggatactgaacaggaccgagttttcttcattaaggcaattgcccagttcatggttagtggacacttattttgtggagttgtaaaattaaataaactagaaaggatgactccttgttagggcgactttcaaactgtgtaattgagtttttctttctttttttttgagatggagtctcattctctcgcccaggccggagtgcagtggcacaatcttggctcactgcaacctccgtctcctcgggggttctcctgtctcagcctcccgagtagctaggattagaggcacacgccaccacacctggctaatttttgcatttttagtagagactgggtttcaccatgttggctaggctggtctcaaactcccgacctcaagtaatccaccctccttggcctcccaaagtgctggaattacagatgtgagccaccacgcgcctggcctgagtttgctttctaaaaccattccattgctgggtttctgtggcaccatttcaccagcgaagttctttttgtttgtcttttaattcattatttgttaagaattttgtttatgccaggtgtggtggctcacgcctgtaatcccagcactttggaaggccgaggtgggcggatcacgaggtcaggagattgagactatcctggctagcagggtgaaaccccgtctccagtaaaaatacaaaaaattagttggatgtggtggcgggcacctgtagtcccagctactcgggaggctgaggcaggagaatggtgtgaacctgggaggcagagcttgcagtgagccgagatcacgccactgcactccagcctgggcaacagagcaagactctgtcttaaaaaaaaaaaaaaagaattttatttatttatttttgaatagataacatatttcatggctcacaaattgaaagtaggctgggcgtggttgttcatgcctgtaatcctagcactttggcaggccaaggtgggaggatagcttgagtccaggagtttgagaacagcctgggtgatgtagtgagatcctgtctctacaaaaaataaatttaaaaaaaattagatgggcctggtgacacgtgcctgtagtctcaggtgcttgggaggctgaggtgggaggattgcttgagcccgggaggttgaggctgcagtgagccgggatcatgtcattgcactccagcccaggtgacagagtgagaccctatctcaaaaaaaaaaaaaaaattaaaaacattatgaaacaaaatggagtaaaatgactttttaccctatctgccctgggccaagttccattccaaataaccactattttaaatctcttccagagtttgtgtgtgtgtgtgtgtgtgtgtgtgtgtgtgtgtgtgcaaataaaaatatatatttttcctttgttttacacaaatggtactgtattctacttgatgtacttactgtacactacaagatgtttagcatcttgctttacttaatggtatattttagagaactttccaaatacatatagaatttcctcattctgtttacgcctgagtggtattgcttgcatggatttgccataatttatgtaatttatataggtaggcttttaggttgtctgaagctttgctctttggaacagtgctgtaacaaataacctgtacatctcattttgtttgtgtttgagtgtgtccctagaataagttcttagatttgggattgctgggtcaaaagatatgtgcatttgtaattttgatgtcttttaccaaattgctctccatcaagattgtcccagtttatacaaccactcacaatgtttgagtcacttgaatgctttgcttttattaggttatatcccagttgtcagcagaggcattttcaactcacctacatgggatttagtttagacattacatggaaagggccttcaactttttttttttttggtctaaaaataggccaccaaggcacatataaaactcaacactaagaagctttatcaagcagatgggtatgcggtaaaagagctgctgaagatcacatctgtcctttataatgctatgaagaccaaggggatggagggctctgaaatagtagaggaagatgtcaacaagttcaagtttgatcttggctcaaaggtaaggacaacaaaagccttgtagtgggcgatggagcgttgatttcttgagctctgaagtggaaggagtctgctacagctccgctgcttttcttcctcctcagctgagggcagtttgtcagttttgtgctcatcagcatttggataaagtcaaagtcacaatccactaattcaactatttattaaaagcttagtatttgtcaggtagcattcaagcgctgaggatacagttgtgaacaaaaaggacaaaaatcgtgtgtttattctcttcagttaggggagtcagactgtgaacaataagaggtgtggaaggccagatgcagtgcaggctgtggagaataataagctgggatggggatggatgctgcccagagtgatcttaaatcgggtgatcaggaaggcctcatggattggatggtgtttccagcagagatccaagggagggaaagagtgagttgtgcgggtggcgggtggcgtcagggtgtctcaggatgataatttgttttgggctgggtgcagtgactcactcctgtaagccaaacactttgggaggccgaggtgggaggatcctttgatgccaagagttccagaccaacctgggcaacatagtgagacgccatttttaccaaaaaaaagaaaaaaattagctaggcgtggtggtacacacctgtggtcccagctgcccaggaggctgaggtgggaagatctcttgagcccaggcagtcaagccatgttcatggcactgcgctcccgcctaggcaacagaacgagaccttgtctggggggaagaaaaaaaatgtgttttgtgtgtttgaggaaaagcaaggaggccgtgtgatgagggttgggattgacagaccctctggcgcctgggaagcccctggaaagcctttgtctttgcctctaaggtgggaatcgttgggatccaagcggaaccttctgtgcttatttcccgtccaaagggttgctctggctgctgagccgccatcagaccgaagcaggcggcagggctggaagcagcgagcctgtttggagagtgaggggtgaccgtggctttgagcagagtgctggtgggacaggtgccgtcaggtgtcagggagcgaccacagcagcaagccagaaataaaggttaagccgttactctgaggcccaaggcctcagagcaggagacctaggaatgaaggccccggggctgggagtgcacctaagagtgtggccacgcagggtacgtgaaaccacagtgcactggctgagctccaagtctgctgcagggaagaaagcttcccctgtgaggcctgctaggtgaggccttgtcatggtctatagttgggcttgaaaagccacacacagcttttttgttttgtttttgttttgttttgagacggagtttcagtctgtggcccaggctggagtgcaatggcacgatcttggctcgctgcgcctctgcctcccaggttcaagagattcttctgcctcagcctcctaagtagctgggattacaggtacacaccaccatgcccagctaattttttttttttttttttgagatggagtttcactcttgttgcccaggctggagtgcaatggcacaatctcagctcactgcaacctctgcctcccaggttcaagtgattcttctgcctcagcctcctgagtagctgagattacaggcatgcgccaccacacccagctaattttttacttgtagtagagtcagggtttctccatgttggtcaggctagtctcgaactcctgacctcaggtgatctgcccgcctcagcctcccaaagtgctaggattacaggcgtgagccaccgcacccggctttgtatttttttttttttttttagcagagatggggtttcaccatgttggccagctagtctcaaactcctgacctcaggtgatctgcctgcctcggcctcccgtagtgctgggattataggcgtgagccaccgcgcctgtcctcacatgtgggtttttaaccaggagcgacactcgtcagcaagagaagtgtctagagattggggcatattttgatggtagatctcacgggatgaggcatgggttgagagtaagtcaggtgctacaggccgggtcttggggcagccgtgcggcagagcttgcagagctcatgggtgtgttccgcctctgtgctgtactctacgggaaccactggccacatgtggcaagcacaactgaggaactgagttgagttctgcattttctttaattcttaagtaatttaagtgaaaatggccacatgtggctattggttactatattagacatcactgctctgaagttttttgtgtgagcccctggaaggatgaagttgccatgtactgaagcagagaaggttctgcacatgctccatttgccacgccgattggctgtccaggtggagatggtgcacaggtagctggtatgtgaaactagagcccagggaaagcccaggctggagctgggagctggggagcaatcagcacacagatggtattaaagccttgagggtaggagcagagccagcagaaaagacggggggtccaggaatgaaactctgactcgctccacttttgagaagcagagaaggtgacagactcctgcaaagaagtttggggatgtgctgctcggaagggaagaaaagcagctagagccagagcaggctggatcctggaggactaaggaagagggaagcaagctatcaaagccatcagctgcaaatgaagagggagagttgttgctagtgggttgaaaatgagagccagaaggtgaggattggttgtccaggagagagggagagtgagcagagcagggagacgtttatgtttgggctccttagaagagttagcatattctaggaagaaggggtgacacacacatcctaagaaagaagcctgtgcacagggctcagtgctaaatcctcattgtggttgtcatcaccttcctggcaacagctgcccatctgtggagcccagaaccattgtaagtccttagtgggtgccacccgatttgcgcctctccaagcctgtggaggaaagtctgaggcagagaaggagggcaggggaggacgaaacacaggacgtcaggctgctgcaagaggatgtgtgtccctcaggctgtccctttgtgtggccgctctgctgccgtcaggcaccctactgtgacaaagtccaagtaggaagcacgtcagctttctcccagctatgccctcctggttgtggcttcagtttgaggtgacattaggttttttggagagacccaggcgtcctggaattggtctctttagtacttagatgatcatttcctgagcgtgtgtcccgcagcctgtgagcatgtaactggggaagcacatgtttgtggtcacgtgtcccaaccaaaggtaggagctgacatgaacaggctagtggttgaatgcatgttaaaaatctgtggctggccgggcacggtggctcacgcctgtgatcccagcactttgggaggccgaggtgggtggatcacctgaggtcaggaattcaagagcagcctgaccaacatgtagaaatcctgtctctactaaaaatacaaaattagccgggcgtggtggcacatgcctgtaatcccagccacttgggaggctgaggcaggaaaattacttgaacctgggaggtggagattgcggtgagccgagatcgcgctatcacactccagcctaggcaacaagaacgaaactccgtctcaaaaaaaaaaaaaaaaaaatctgtggctggctgaacatggtggttctgcctataatcccaacactttgggaggctgaggtcggagggtcacttgaggccaggagttagagagcagcctgggtaacatagccaagaccctgtctctattaaaaaacatctgttgctgaggtttctgtttttgttattttccttccagattgcagatttgaaggcagccaggcagcttgcgtctgaaatcacctccaaaggagcatctctgtatgacttgctcggcatggaagtagagttgagggtaagcattccagtacttccttaaccatgcagattttctcttcaaggttttctttttcaattctgtttctcccttttcagttctgatttaatgaaatacacctggttgaatgagctaatgtgtggaaaggtgatagaggatattagctgtccttcctgcttctggtgggcactggtctagctttatttatttatttatttatttttatttatttatttttgagacggagtctcgctgtgttgcccaggctggagtgcagtggcgcaatctcgtctcactgcaagctccgcctcccaggttcacgccattctcctgcctcagcctcccaagtagctgggactacaggtgcctgccaccacacccggctaattttttgtatttttagtagagacagggtttcaccgtgttagccaggatggtctcaatctcctgacctcgtgatctgcctgccttggcctcccaaagtgctgggattaccggtgtgagccaccgcgcccggcactggtctacctttaacttcttgtttaggagtggcagctccatggcatgtgactgagctgtccttgttgtgcccactggcagactttattgatcatgatgtttttttctggtgtactctgcttcagcattttctcaaaaatgatcttctgagcttgcagttccccgaccttgctgcccagtgcaaacacctggggacctctaaagacttctgaagcctggctttcactctggggtccttgttatggaatgtgacctgggcattgggagttttcagattctcccgggtgattctaacagcagtttgggaccagcaatcttggcatcacttccagtcagctgaagttgatgttgcagtggagactgatttgatttgcaatccttattccagccaatgccagccaagaagtatgtgccatcacctacatttaagtagctgtttaagactggagtggtgtttattttttatttttttaattttgttattttttttgagacagtctcactctgttgcccaggctggagtgcggtggctcaatctcggctcactaaaacctccgcctcccaggttcaggtgattctccttcctcagcctcctgagtagctgcaattacagatatgtgtcaccacacccggctaatttttgtatttttagtagagatggggtttcatcatgttggccaggttggtctcaaactcctgatctcaagtgattcgccttcctcggcctcccaaagtgctgggattacaggcatgagccactgcgtctggcctagagtggagtagtgtttaatccttacctgtaaagatttatggcatttgaagcatatgtgctcaatctaatgctttaaaactaaatgaatttctttcattcacttcctagcaagagtgccagccatggcttctctctctcactgccttgcctgtgttctggcataccctgggagcaaactggaagtggaagtctggggaagagggacttaggtgctagattgctatgtctgctcatcatatattgacccggcagttgccacctgatgaagtgtggttggcagaatgaaactgccactgacatctgctagctaattcagatgatgagtaaggtacctccaggctttcccctgttctgtttgtagtgcagtggtgtacatatgtctgtacatgtccctaagagactcagagacaggagctggccacttgctgattgccactagagctgtggcatcattgtgagacttcatttccatcccacggggtctctttcaacaccatcctgtaaagaatgatgaagtaaccagtggctgaaactgttcccaaggaaaccatgagaccctgaatgtagtacttgtcaaattctgtgtgtagtcatgatccgaggaagagcgcctatccagtgtttgtttttctttcattcagtaaacatttactgaggtgcagcctcagccacaggcaaggcactgagctctgcctccttgactaagtcctcaccctgccctcagccattcccaccaggtgcaccgtggatgaaaggaagcacaagacgagttttgacacagtgcttcaggaaccttgtcttactttgttcaggctgccgtcccaaaacacaataagctgagtgacttataaataacagatttgtttctcacagttctggagattgggaagttctagatgaaagcactagcagcttcagtgtctggcgagggcttgttccccacagatggtgccttgttgctgagtcctcacatggcagcaggggtgagggatctccccagggtttctcttaggagctaatcacctcctaacatcatcacattgtggtttcgagtttcaacataggaattttggggtcacacaaacattgtctatagtaaacctcataactatatccacattacaatcccatgtctcagaagttttcagcactgatatgatagtcacagatgtctcccttgataggttaatggttcatgctaggggcagggccatggtcactgttcttatcggttgcgtttgttagtgataggcaactgagagggacttcatgctaagaaagatgcttagtttgggagtcacctggacagaatgcaggtaaagaagcaaattggggctgggcatagtgactcatgcctgtgatcctagcactgtgggagaccaaggaacgtggatcacttgagcctaggagtttgagcaacatagtgagaccctatctctatttaaaaaaaaaaaaaagaagcagcagcaaatttgggagaaaagataatggatgctaagttcagttttgctcatagagttggggtcacctaggcctctggctgaaaaggaggaccttgagctctggagagagctgggtaggcactcagataatggaagacattataggaggtgatggtggcagtgtttttgcatcagagatccacatggcaataaacttcggagaatcagtctataaggcacatctagatctaggaatactggttttgagaactccttttctgaaaatatacgtaaatgattttactgtttcctaggaaatgagaacagaagccattgccagacctctggaaataaacgagactgaaaaagtgatgagaattgcaataaaagagattttggtaagatgactttgcttttatataatgttttttatgcctgggattcaaaaatactgatttcttgcccatacaagacagaacaagctaggcttagtaacaagggatgtgttagtggggaaatgaaaaactcaagaggacattcgagcttacctaggtcacttactatcatttttttcccctcgttataaataaaaacagcttctcatgttattaaaaattgatcagtttcagtaatttgataattatcagttattcaataattttaataaataatgctctattttattttgtttaaccaattcctcactgcttagtatttaaatgatttcagggttttctaaattccagacagcactgtaataagtagaaggatcactattgtttactgctcgctcacatcagttatcctctcatctaaagcagtcagttggaaggcagatcatgagggtgactctagactcagattgcttgggtttgaattccactgtgtgatattaggcaagttacttaccctctctgtgcctcattttcctcatctgtaaaatggcaagaactgcattcccaactgtgtggggtccttataaacatgaatcacgacagggcatatcaagcctcgtctctgatgcacaattgataatcagtcatcactggtgatttattttactcagtagacacggatgagggcccctgtgtacattcagagtaggcataaaacaagaatttgctatgagttgtacaaaattctaaaaatcataggtttttaaaaatatgtaattcttttgtcattaaacagtaatacctgctgggcagcccagcctagggagtcagagcctcacagcgggagaagggcaccacagccctggtgggagattggtgacagataggcagatgggtcagataagtaaaaatatggcaaggataatggagccacgttcctcactgttggagaaaaaagtcacaaaaatgtcacaaaaatggaaagagagaaaattagggtgaacttgaaattggaggtgttggttaaacgcatagttttcaatatatagataggtataggaataaattttgatatacatgtatgcacatttaaggaattacgtatatatgtatataaatgttttatttatatacatacacgtagagacacccacactcatacatttcttagctctgagcacacgtagcacctggcttaatgccattctccactaaaaggaaccaggactcttaggggaaaatggctaattccagagttgggcaggagaagtacgagaaagtaaggaagagttcaaaggaggaaagggaactattggaagcatgcagaagccaacttaagtgggcttctcctggccaaagtaaggacaacttaagcatcaaaataaataagttagaataattaattttatggtataatagaatgaaataggaaaccatgagttttcactggcataaaaaaataaatgaatattggaggctgaggaggagcaggtcattcacacagattcgaagtaactttccacaaagtactttttttttcttttttttttttttgagacggagtcttgctctgttgcccaggctggagtacagtggcacaacctcggctcattgcaacctctgcctcccaggttcaagtgattctcctgagtagctgggattactggcgcacaccactacacccagctaattattgtatttttgttttattttatttatttatttgtttatttttttagacgaagtcttgctatgtcacccaggctgaagtgcagtagcgccatctcagctcactgcaatctctgcctcctgggttcgagcaattctcgtgcctcaacctcccaaatagctggaagtacaggcatgcgccaccacgcccagctaatttttgtttttttttttagtagagatggagttttgccatgtttggccaggcttgtctcaaactcctgacttcaggtgatccgcccgccttgacctctcaaagtgctgggattacaggcatgaggcattgtgcctggcccgcagagtacttattaattacagaggggaaaagagtcacttctcagggagaagcctgccagtcacccccttaatcaagagatcaaagtgaacatcatcgttacagaacaaatcaaaatcatgcacgcctggtaggatgcagtcacttctgagtattcctgccaacgatgcatatctgactctaatgagacaaagccggattgaggggcattctacagattaaccagcctgtatgctcccagagtgaaaaggttctgaaagtcaaggaaagctgagggggcatttcagactgagggaggctgtggagatgtgataactggacacataggcagctcctatctgctgttggggacttcactgggacaagtggggacagtggagtggggctggagttagacggtggtagtgtgttagtgctggcttcctgttttgatgattgtattgtggggatgtaggagaaagtccttatttgtaggaaatacacgctaaagtattcagggtattggaacgtctggtcagcaacttactgtcacctaggttgggaaaaacgctttgtgttgtacaacaggttttccgtaaatttttgattgtttctaaatttaaaaattaaaaaaaaattattatacctcttatccttgccagtgttctaactgaatcaggtgaacacggcatgaatgtgcccttagcactaatatgttaaaagtagaacacccaagagaggacagggttcatttcttggtagacatctcttaagactcctttcattgttagaaaatatctgtgatgtttgatcattctaaaaacaaccaaaacaacatgggtacttaaaagggtttggggagtacaggccatttatttcagaaaccagggaaaattgcttgtgtttacacagctgttttgcattgtggatctttcttgtttgaggaacagatatgtttaaggtgggataaatttactaggttttaatctgactttggttcgaggaaacagttgccattaactgaagttgtttagaaaggagacccacctttcttcctgtgagggtgaactcgcatttctcctgggggctctaaggcacttgcagcaaatcgatgataagggtctgattattttcatgaaagtatcttagaagtggctagtgtacttagaccaaaaaaattagaccataaacgcattgtcagtaacagtggctggttccaaaacacaccatgcctgagagttgtggagagtgtctgggcttcgtaggccatttctctgtggagcccatagcttttcagagacttgcaggaaaacagagtaaccccttcgtgggatgctacacataggcaaagagctggaggggaagccccaccttggccaccaggaacttaatgcagggctggaaagccagaaccctggggggcagttccacgctcagctgggtggcagtccagattcctcataaagagattggagcctgaaccccaggcatgtgatccagccagccaccggacaagacgcatgtgaagacggcgcactaccagtgactctacctgcttcaaatgaaccttctcttaggatagggagacttgtgtcaccgtcagtgggcccgtgtcccccttcccttctttactcagcctctgttgcccaagggcctctgtccaactgttgccctggaccccttccagagctggtgcacaccagtgtggccattgccactgtgggaactgctttcgtactgtcttcagagtggtttctcctcgtttttagtctgtagtcaagcttctgttgccagggagagggaagaggaccttctctcaatcccagcaggcagtgggttagggctgggaccagctgtttctttctctcccctcctagtagagcagtacttggtgtgtgtgggtattctgtaagtcgggtgtttgtaactaggggcatggcccgaatgataaaaaggcagactgaccgtccagagtgatgtgcaccttgttctaaccgagtgagccagagaaaagactgcaggcctctccaccttgaccaggacactcttctttgcatcttcacttctttccctgggtagaaatgcctgcttttcatggggaaaaaaaaagagatacctttttctggacctgtgtgacattctccctggaactagtgggttaagtgagtcattgcttggggaagtgtctatttgtttgcttttgtgtttgttgagcataatgttgctatgcctgaagagttgcaaaattcttctaagaattaggatggctgtttttattgccaccttgtctcattatttcccattaaatatagacacaggttcagaagactaaagacctgctcaataatgtggcctctgatgaagctaatttagaagccaaaatcgaaaagagaaaattagaactggaaagaaatcggaagcgactagagactctgcagagtgtcaggtagatatgaacacttggagaatgagtagaaagatgtcctggaaagttcaaacaaactgggcgtggtggctcatgtctgaaatctcagctactcatgaagctggggcggggggttctcttgagcccaggagtttgagaccagcctgggcagcataatgaaaccccatctctaaaaatttttaaaaattacctcagtatggtgatacacacctgtagtcccagctacttgggaggctgaggcgggaggattgcttgagcccaggaggttgaggctgcagtgagctatggttgcatcactgcactccagcctgagccacagaacaaggccgagtaacagaacaaggccctgactctaaaagaaaaaaaaagttagaacaaagacttaagagaatagaatgtgatcttaactcttctcaagcaatgaaaaaaagccttacataagggtatcttcacctcaaatgtacatgtgttgcctgtcataacaagcagatggctaaactcattctctttactgcttgcggtatgtctggaaaactgcttaaagcttgaactgccctttaagcttttatagcttcttggaactcaaggcagagtaagtgaatccagacggggaaatccagacgtggtctcctaagatcttgccataaattaggtagaaacagaaacatactcctgcctgtttgttggcatagattttagactttatttaaaccttgatcattcctcaccagtcagtaattcatctttcttcctacgttacctcattggaaatatatttcccaggaataccgatggagaatagtggtgccggctctctctctcttctcttcctcgttctgtgcctctttccctcccccatgcttctgctctttctcccttttcattcaccctttatttttctttcttcttggctccctcctcttcccagctgcctactctgctcggatgttttgcctttttggatgttggtggctggctacaccctgcccactgtcccgaggtctgtggggaggcagcacctggaggcagcgacagcaaccacagggagcgccctggctcctccctgcccagcgcaaggccaaggcccttcccctcctgaaactggctctttacctctggagcctcagagagggaaaaaaaaaaaaacagaagtcattgccgccatatagattgatctccttgacacattccacttttaaagcatcaattcatttttgttaagctccaaatcattttaacagaaaagtctctttgttttgctctagttcaaaagattataattatttctgagtttatctgcttatatttttaaaagagtagaattttccctttaaggtcaataataagaaaaaagaaaaagttcagcaaaccagtatagatttttatggttttttttgtttttgttttttttttttgagttggagtttcgctcttgttgccgaggctggagtgcaatggcgcgatcccggctcactgcaaactctgcctcccggattcaagcgattctcctgcctcagcctctcaagtagctgggattacaggcggccgccaccacgcccagctaatttttgtatttttagtagagacggagtttcaccatgttggccaggctggtcttgaactcctgaccttgtgatccacctgccttggcctcccaaagtgctgggattacaggcatgagtcatcatcacgcctggcctttttaaaaaattttttatcgtttaaaaacctctttagactgggcacagtgattcacgtctataatcccagcactttgagaggccaaggcgggcagatcgcttgaactcaggggttcaagaccagcctgggcaatatggcgaaaccccatctctacaaaaaaaaaatataaaaaatagctgggcatagtggcacatgtctgtagtcccagctacttgggggcctgagacaggaggatcacctgagcccaggcgttcgatgctgcagtaagccatgatcacaccactgcactgtagcctgggtgacaaagtgagaccctgtctcaacaaacaaaaaaaaaccaccagccttaattcgtaacaacctgtggtcccctttttagaggattgctttaaatttataatatcctgacagtagaacattattattattattattatttcttttgagatggagtctctctgtgttgcctaggctggagtgcagtggcgcaatctcggctcactgcaacctccacctcccaggttcaagcagttctcctgcctcagccacccgagtagctgggattacaggcatgtgccaccacgcctggctaatgtttgtatttttagtagagacgaggtttcaccatgttggccaggctggtctgaaactcctgacctcagttgatccacccgcctcagtctcccaaagtgctgggattacaggcgtgcgccaccgcacccggccaacagtagaacattatacccaaataagataataatatatatatttattgatttggagagatgtgtctggtatgtgatttttttgcctttagagatggggtctcaatgtgtcacccaggctggagggctggagtgccacggcaaggtcagaggatcctcactcactgcagccttgaactccagggctcaatcctcctcctacttcagcctcccaaagtgctagggttacaggtgtgagccgatgcacccagcctgatcatttttaactctattgagattacggtatattgaaatgaaataaagattataaaatttcttggtatatttaattttttttttaaatgcattcctatctatatttatgcatagaaaagtctggaaggatgtatgtcaactatcaagcgcttatacctggtgatgggattatcagtaatttttacgtcattcttcatactttcaggattatttcaagtttttacaaagagcacatcttatttatgatgaaaaagaagtatgttcattttggggggagaaagcagaaaagggaaaatatttttaagcattacaagaatgaaggaccttctctaattaagggtttccagagaaagccaccatggaatctgaaactgtgaatacccatttcaaactactgcatataattcacctttcctttttatttcatttgcttcttttaggccatgttttatggatgagtatgagaagactgaggaagaattacaaaagcagtatgacacttatctggagaaatttcaaaatctgacttatctggaacaacagcttgaagaccatcataggatggagcaagaaaggtttgaggtgagctgagcctgtcctctgttcagccattccttctggtgtgttattttgtactgggtgacaggtcattttgttaatatcattgtgaaaaaaatatcagtacatgttttttctccctggtcagtctgaggattgctcatgtaatgtgtttgttttgctggcagtgtacactggactccagggttgtcaaatctttgatgtcatatttcatcaggtttggtcagttaagagaacagacagggccgacatgaggcctgtgtggctgcgtaagaccctgtgccgacatggggcctgtgcttgctttcaggccctgttgtcactgtcttgaaattcataataatttttaagtgcattttattttccactgatcccaaaaattatgtagctggtctcgagtgcagatttaaaagcttgcttggctttgggaggccaagacgagcggatcacttgaggtcaggagtttgagaccagcctggccaacatggtgaaacccctcctctcataaaaatacaaaaaattagccgggtgtggtcgtacacacctgtagtcccagctactcggcaggctgagacaggagaatcgtttgaacatgggaggaagaggttgcagtgagccaagatcgtgccactgtactccagcctggacaacagagcaagatcccatctccaaaaataagaaaataaagcttgcttagtcagttcacataaagattttcaaggcaaggtgcgatggcttatacttgtaatcccagcactttgggaggcttaggcaggaggatcactggagcccaggagtctgagaccagtttgggcagcataatgagaccctgtctctacaaagaagtaaaaataaattagctggacatggtgttacacacctgttgtctcagctacttgggaggctgagatggaaggattgcttgagcctgggagtttgaagttggagtgagccatgatcatgccactgcactccagctcggttgacagagcaagaccctgtctcaaaaagaaaaaaaaaaagggccgggcgcggtggctcacgcctgtaatcccagcactttgggaggccacagctggtggaccacgaggtcaggagtttgaaatcagcttgtccaacatggtgaaaccccgtctactaaaaatacaaaatttatctggtatggtggcgggcacctgtaatcccagctacttgggaggctaaggcaggagaattgcttgaacccaggaggcagaggttgcagtgagccgagattgcgccactgcactctagcctgggcgacagagcaagacaccatctcaaaaaaaaaaaaaaaaaaaaaaaaagaaagagattttcaagtcctggttaattgaatcaccagaatagctcattggagattgttttgtaaagaggaatggcagtttatttattgattgtgggaaataaatgtgtggccttgagcctgaccaaccatcttacaggttcctctcatccctgtgggtaaggccatttaggaaaagagtgttttagacccgagcatgagttgataaatgtggaatttagagcaaaggaaattgaaccaagttgtgatcagtttttgaattgccctatccttaacctgagaatggtcatttagactccattttcatgatgaaattggtctgcagtctccctttctcatgcccttgacagcttttggtattaaggttatgctaggcttcttacaatactgagcatttgagtttggcagagctattttgttgtccaggagggctaactgggagtacctaacgcatccgtgtggacacatgtcatcttgacgaggaattcattgctagcattactctgtggcagaggcaggccatggagaaatggtacgggacaggcacatttcgagggcactagaaagagcttggagtttagaacattttaaacattgggtacctgggaaagaacagtcaagggcagtgaaaagaaacgttggccatttttttgtattatctggggccacctctgggttcagagaacaaaccaaacagtatgcctcagagtggcaggtaggtggcccaggaaacttcccagggagcccctctaccctacccttccttcaacaagtacatctctttttctcttactcactctcgctctctgtcgttagaatacctgttccctcgaaataccccatgccggaaacacagtgctttatttttaatgtttagaacaacaatatataaagccaacttcctccctctgtctgtccctcccccccactctctctctttgtctctttctctttctcaacggggtctcactctgttgcctgccactctgtctggagggcagggtgtgattataactcactgtagcttcagacctcttgggctcaagcgatcctcccacctcagcttcttgagtagctgggactataggcacttgccaccatacctggctaaattttttaaatttgttgtagagatgaggtttccctatgttgcccaggctggtctcaaactcctgggctcaagtgatcctcctgccttggcctcccaaagcgtgggggttacaggtgtgagccaccacgcccagcccccattctctttcttgataataatcaaggccacattttatgatctgagatatttcctcctgtccccacccctgttcccatccttacctgtcccaccatttagcatcttttgagctggaatctgaaggcagggcaggaaagataaatgataaaatctatactttcttcctttgaaagcaggaggcctgtctctgccctaaaattagatgtgtctgttctgtgtccccaggtcatacaggcatgcgtgatgggcatttagttctcctcagaggcagggaaatgcaatcggagaagcatggggtggggcagctgcttcactctgggcgcccctgtccaccaggccacgaggcaaccgcagagagaaagggcagtaagtttcaggaccctggagttgctcaggcagtgttaattctcttccccttccttgagtttagctctttttttgttctgtagcacaaacttagcagtccttacacagtggtgaagaagaatagaacagtccagaaaagggccatctctcctgagtctgtatttcctcttccacaggaagctaaaaacactctctgcctgatacagaacaagctcaaggaggaagagaagcgcctgctcaagagtggaagtaaggctgggcttcgtagacgagcagtttactctggactagtattttcagccttgaaatatatatagagagatatatatatattttttaatatgtattttcttctttttttcagcagttttttttttactgtagtaagaacacttcactttacatcttcaattttgaaaagtataataaattattgttgactataggtacaaaaatattttcaaaaggcggttttctcacaacttctatattgggtaccattgtattcactcaagagtctggtttaaatatagcatttaaaacacatttcgttcttgtgccagttaagatagtgttttcccctgtttaaatgatagtttgaattatatatgatgcgtaactataagaaaacatggccctagatgtgtgtagggttctgtattttcaggctgaatgatggaaagcaagcactgggatgcagtgcagggagaggggccgctcgctttgtgatggtccccatgctgctgagatgccccccataatccagaatggctcagcaagacactcagctggagagacacagggttacgtccatgcaaagcctagattccgggaaggagctctctgtgaccaggcagcttcccttatccttgtgtgggcggcaagccgcccaggtgccgaggcaagagaccgagagcacgagctgttccagtataataaaatatataaaataagaatagttatactagatatagatcatagatatgattatatatgaatatcattaatcattagtttatagcaattactctttattccaatatcataataatcctcgctctacaatcataacctaggaaaaaacaggccatacagatataggagctgaggggacatggtgagaagtgaccagaagacaagagtgcaaaccttctgttatgcccagacagggccaccagagggctccttggtctagtgggaacaccagcgtctgggaagccgcccgttgccaagtggaccgtggtctagtggtagcgtcagtgtcaaggaaaaacacctgctacttagcagaccaggaaagggagtctccctttccccgggggagtttagagaagactttactcctccacctcttgtggagggcctgacatcagtcaggcccgcccgcagttatccggaggcctaaccatctcccggtgatactgtgcttcagtggtcatgctcctagtctgccttcatgttctgtcctgtacacctggctctgccttttagatagtagtagcaaattagtggaagtactaaaagtctctgataagcagaaataatggcgtaagctgtctctctctcctctctgtctctctgcctcagctgccaggcagggaagggccccctgtccagtggatacgtgacccatgtgaccttacctatcactgaagatggctcactctccttaccctgcccctttgtcttgtatccaataaatatcagcacagcctggcattcagggccactatcagtctccacgtcttcgtggtagtggtcccccaagcccggctgtcttttcttttatctctttgtcttgtgtctttatttctacagtctctcatctctgcacatggggagaaaacccaccgaccctgtggggctgtaccctacatccctgaacttcagtgtcaagtcactgtcagggaccggtagcagcccaggatcttcctgctgaattgatggccttgttgcacggagttcctcctcctcttgctggttgccctttcttttcttcagggtgaaatattctattcactctcatgttgagggcagcatacttgaggcatcaggcccacacacatgctcccacacacactctctctctctctctttctctttctttgccatttcccttgtatctctctcattttgcacctgttctgtgactctctcgtctgaatctcaggaaactttggaggaaggatagggactgctgggaaatcctccaggaacaaggttaggaaatttgaagggcctgtctagccaaagcagccctcccctttttagttccatgtcagccaggagcatgtgaagcagccctcagtgatcagcctgcatggggtttgtcccttgcgagaggcccagctcagctaggagccctggtttgttgcttgcatcccatgctgtccccgggccaggatgctaagacctgccattctgatcttgctttattcaccaagatttacctttgtgttttcttctaggagttctatagttttagctcttacatttaggtctctgatccactttgagttaatttttgtatatggtgtgagacagggggtccaacttcattcttttgcatgtggctattcggttgtcctattatcatttgtggaaaagactattatttccccattgagttatactcgcatgttgtcagccattaattttaattgtcactgtcagctcagtggtttcagtgtcagcatgcattaatgtcttagtctgttttgtgctgctgtaacagaatacctgagactgggtaattatatattttacataaaatatatacagcattgtatatatggatacatgcagtcatccctcaatatctgcgaagaactggtgccagaacccacctgtggataccaaaatccacagatgttcaagtccttttcatgtaacctatgcacatcctcccatatactttaagtcatctctagattacataaaatacctaacataatgcctatacatcacttcattcacatggattcaacatagtacttggtatgtggcaaattcaagttttgctttttggaactttgtagatcttttttgaactttgtagattttttttccaaataattcagatccatggttggctgaacccatggatgtgaaatccatggatacagagggccagttttgtatgtgtgtgtgtgtgtgtgtagtttatatatatatgtcatatatattattatatataatatatattatattatatattattatatataatatatattatattatatattatataattatattatattatatatattatataattatatattattatatgttatatattattatatattatatattattatatattatatattatataatattatatattattatatattatatattatataatattatatattatatattattatatattatatattattatatattatatattattatatattatatattattatatattatatattatatattatataatattatatattatatatattattatatattatatattatataatatatattatattattatatattatataatatatattatattattatatatatattataatataatatattatataatatattatataatatatattttataatataatttataatttataaatttatatttataattatatatgttatatagttatatattattatatataataatatatgacaattatataacatatataatatattagtattaggttatattattatcattataatcagaaacttacttgtctgaaatttaatgagccacagttctaggagcaagcccaagatcaaggagctgcatcttgccgcaccatcccatggcagaagggcaaagagagggcgagagagagcaagagatcaaactcacagcctcaagcccttttataaccagcattaatccattcttcaaggcggagccctcatgacctaaacacctcccagtatgccccacctcccaacactgttgcattgggatttaagtttccaacacaggcttttcggagacacattgaaatcatataatagcaattgactttagtttacctgctcacttctcaggtctgtattggtttgagttgtaagaagaaatcttattgagcctgaggtacatgtattaattttattttaaaattgattatataatttgatttgcattgcatgggataaggatttaatgtcttaatttcctggatagaataagaaatgaacaaatgacttttgcacacagaccttactgggcagagctgtttcgttgtgatcatgaagccactcctttgttttgcctgcttgtgttcctgctaggtaacgatgactcggacatagacatccaggaggacgatgaatccgacagtgagttggaagaaaggcggctgcccaagccacagacagccatggagatgctcatgcaaggtaccccggcgtctttcgctggacttcctccctgcgccctgtttcacagaacacctggccaggactggggcaggctgcttagtattgaggcccacaagcgtgctgcgaatggcccctagaagcagctcttgctcaggtttatcctgtcctgttgtttatggctcttgaactgctcagtggtcatgtttgctccttgtctgtgatcccaagactggatggttcatatttatggcttggtatttctcacagccacaagaacacattgcctctgccactctcagtgcagtgatatacttaatagcctgagaattaatgcagaaagggacttaaatgagcatctctgccttaaaaaaagttcttctaattcctttactcatcacaaaagattcaagcaacaaagctcagcgcagtggtgcacaccttattcccagctactcaggaggctgaggcagaaggatcatttgagcctaggagctcggagctgtagtatgtgatgattgtgtccgtgaatatccactgcattccggcccgggcaacatagaggggctcttaaaactaagttaagccaggcgcggtggctcacgcctgtaatcccagcactttgggaggccaaggcgggtggatcacgaggtcaagagatcgagaccatcctggctaacacggtgaaaccccgtctctactaaaaataaaaaaaaaattagttgggcgcaatggcgggcgcccatagtcccagctactcgggaggctgagacaggagaatggtgtgaacccaggaggcggagcttgcagtgagccgagatcacgccactgcactccagcctgggcgacagagtgagactccgtctcaaaaaaaaaaaaagagttaaaacaaaaaaagactcaggcaacaaaatttgtagagcaaatgtgaattctctcctggggtcttcctcatgtcccactcccacctgggagggctcatggctagtggccagggtgggtgtgtctttacagattacctttctgtacatatacatacgcacacacatacacatacaaagatcacctgaaaaaaatttaacctgagtgcaaccagacggtatgtatggttctgcaacttgcttttgtttttaaaaattaagtacaattggaactcttcctctgtcagcaatagatctgccccctaattttttttttttttctttttgagacaaagtctcgctcttggtccccaggttggagtgcaatggcatgatcttggctcactgcaacctctgcttcccggagggagcaattctcctgcaatcccaagtagctggggttacaggcccgtgccaccacacccagctaatttttgtatttttagtagagacggggtttcaccatgttggccaggctggtctcgaactcccaacctcaggtgatccacccgcctcggcctcccaaagtgctgggattacaggcctgagccaccactcctggcctgccccctactttttaatggctatgtcatattcctagcaggactgtacccatgatttactgggcgttctcgcattgatatttcccctcttttccttgtatatacatctttctgcatgtctgcatatctttaggttgcatcattaaaagtcaaattcttaggtcaaaggttccataaatttttattttaatactataaaattctcctatatttgcctttaaaaacatttcttatctaccacctgttaatgtttggagcacagttgcttttttttttttttttttttttttttttggagacagaatctcattctgtcgttcacgctagagtgcagtggcacgatctcagctcactgcaacctctgcttcctggtttcaagcgagtctcctgcctcagcctcccgagtagctgagactacaggtgtgaaccaccatacctggctaatgtttaaaaaaatttctgtagaaatgaggtttcattatgttgcccaggctggcctcaaactcctggcctcctgtctcagcctcccaaattcctgggattatacgcaaaagccaacatgcctggccagaaaacaaatcttgaatgctatttcctgctttattttccaagatttttatgacttcttcatgcttttgttgttctcaggaagacctggcaaacgcattgtgggcacgatgcaaggtggagactccgatgacaatgtaagtcccccgctcccctcagtggttctgtgcactctgggtttggctgtccccatagatgggagtggctgagttgctgtcagcagccagggagccgtctatggtcagcccggccgtgcctcgatgcgtggcagggtttggcctcatgaggctctggactcttcgttgctcgtggatggctcatctcttttcaagtgaatgtgcttgctctgctttttttgccttctcactgttctttccattctcgctttccaaagatggaagcagcaccagctctcttaggtaaatgcaagacttccagctccaagaagcaggttggttttctgttctgcctcatgtgtttgtgggtgtctgtcagccctcccggggccagccaggggcctctccctaggagtgatgcttcctctctcctgggcaaaaaggccactcaaaagagatcctgtggtgacagcgggatcactgaaggcccctgtgctaaagtggaggcgcaggcacggagcctggaggcggggaaagctcaggccgggccatcctcaggccctgggccgccacctagaaatgaaggaggacgccgagggccgggctcaggaccaacccccctccctgttctgtgctggggacggaatggtgaagcagcactgtccccagaccaggccctcgaggtgccaggcatgaggctgagacataagctgccttgagctttactgagtggataactccctggagcacttaagcaaaaggggattctaggggtcctcagtgaggtccagtcatcagggctctgccgcccattgctcaagcctacgttctttgttgcgtccctggcagtgctgctcggcccacacagcaaagggcgactcaacagagactgaccccaggctgcctccatgtgccctgaatttacagggcacagtctgtagagaagcagagagagcaactggaaaataattttcctaacaagctcgggtgtggatggtatacagcgtctctccgtcttgcccacccaagacagaagcagagggagtgtggcgtgggtgctggcaatgctgaggcagcaccgcctgcctcttctccagggtttgccttctctctcctcagagcgaatgcattagtcgcagctgagctttatgcctggtggtcacttgtttatttcaaggaggctgtgtccatgccgccctccaggcacagggttccatgctttacgtgttcaggcatccaacacgtgtctgttgagtgcctgccacatgccagtgctgtcgtggattatggggaacgcagcaggggcagaggcaagcccctgcttcatggctcacaccccagcaataatgatggattgtcggatcagggctcatggtgttaacaggaggaataacagcttcaggggacagggagtgacagggaacaaggagggggtggcgtcttctgcgaggtcagtgaaggcccctgacgtggtggtgtttgagcagggcctgagtggagggagcgagcgcatgggttggcggcacctgggcatgtggaatgcactcctcgcatcgaggagcagaggcagctggtgtgattgtgggtgagtgcgagaggcagcaggggccatgcagagctttgcagggtgagatgaagactctgttttctctgagtgtgaggggaaggccctgaagaatcatgagcccagaagggtcaagagctgatgatccctgtttgagagaagccagttaggaggcgcctgcacccgtggaggtcagaggtgacggtgcttggccgaaggtgtggcagcagaggtgttgagaaatggtcaggtcctgggtctctctaagaaccatcaggttttgtgaattgattggacataggctgttagagaaagagaaaaatgagggtgcctgggcttggtctaatcagcagaaagcagagtttcattttctgagatggggccgacttgacaaaggggcttggaaggcagatcgaaagtttgattttggacattctgaatgtgacagccacatgctagggttgagtagccaggtggaatttaagtctggagttcaagggccacgtctgggctagagattgaattttgggagccacccttatttggttggtatctaagccacaaggatagatgtgactgcctagggagagcaagtagaatgagaagagaggcgacccaaggtcctgagctgcatctgccctgcagaggtccgggaggaaggggcaggcagaggaggctgaggggcgtcagcagtgaggaagggggacctggactagagaaggggccctgggggatggagaagatgggttttaaggatgaaggggtgattccacagctcaagcaggatgaggcctgagaatcgatcccagtccgttgaatgtttccttcttgacaggagcagtgctggggtcagtaggtgagagcccgggggaactgaagcagtcgtgaggggcacaggtgtggacagtgagttcaacgactcgctcaggagctttgtgtgaggggagagagacagggcagagcagctggagaggaaggtgggattacctttggggttttttttcaagaaggaaattacagcatgagtgtgcaccgacaggaatgatctagatagaacgaccagccatcctggtttacatgggacgcaggaactgccgttttaaagctgggctgagttggtcaccctggagccctggatccgatgaggagagagagggtgtgtctttcactttgctccctttttttcttttttttcttttttttttgagatggagtcttgctttggagtgcagtggtgcaatctcggctcactgcacctctgcctcccaggttcaagcgattcttctgcctcagtctccggagtagctgggattcactttgctccttataccaatgtctatgttgctttccatccacaatctacaaaaagccaaaacaggcctcccttccctctctccaagcccctgtccttcttgccatctgtagggggagtctctaggtccagtggccctcagcgcagatgcagagtgcttcttagacgctgcgggaaagccagcccctgcagcaccacacccagatgcacctgcagtttggaggattctggttggatgataaattccagctggcagtacatagcctcagtcccatctgtatgccctcccacagcctgcttgccactctgccagcctcttccttcacacagggatgctgctatagaaagggaggcagagagtcttaggacaagatgtcaggaatgaggcaggatcccccgttgcatctgccatttttttcctataggaggactcggaggagagtgaaattgacatggaagatgatgatgacgaggatgacgatttggaagacgagagcatttctctctcaccaaccaagcccaatcgaagggtccggaaatctgaacccctggatgagagtgacaatgacttctgacccttttgccaagggaccctggcagattaaaaccctcagacttgtaggtaaatgggaacttagaaggttaggaaggtaacccctgttttgtttactaagctggctggactcatgatcactgaagcaatacttatttctgctttagcctcctatgtttgcattccatgaagcttaaataagaattgaagcaaatccctaagatttatttttttccaccttatttatcttctaaaacttgaggaatgcatgtgttcttagtgattcacatccacgggacaaaaactcaagaagaaataagagctgacgccacacaagtcttggctgcttttgttactatacattttctctgagactccagcagagttggggctggaacttggcactggggactcatgtttggaatcgtaggggaacatctggctgttaatcacttgcacagttgagaacatttcctatacatcggcttttaattctagctcttatttcattttgtaatcttattttctttcgtctgcatgttcacaataccaagcattaaatgtattttaataactaaacttttctgaaagaaggttagctaaagttaaatgaaaacttggtttctttgaaaatcaggcaatagagacaggctccagatgaggaatcctccattttctgtccgaagctgacattcctctggcagtccagttcaccttggattacagccaccttcatgtttccacggttggtactaaatctggaaactctggtgacctgggctgccctctcagaaactccagactcccatggcaatgacagccgggacacttttcttccctccagccagggtttctctaaaggagctttgttttgtctaaagtgtggcaagacatagtgcacaacacagggacaaaggcaggtttcctgcagctcgctacctaagtgtttctgtaggggaaggagccaattaagaaaaagtgttggtacagattcatgtttctgatttaaaaaaacaacaacacaggattgaattaagtagagtaatagcactagaagaatttttctgttgtgaaattagaagtggagttggtttttttcttttttcttcttctttttttttaatatgaaaagtacttagctgggagtggtggcaagcgcccttgggtccagctactcaggaggccaaggtgggaggatcacttgagcccaggagttttagactagcctggacaactaagtgagactccatctctacaaaaaattaaaaaattagccaggtgtggaggggcatgcctgtggtctcagctattcaggaggctgaggcaggagaatcacttgagaccaggaagttgaggctgcaatgagccgtgatcatgccactgcactccagcctgggtgacagagtgagaccctgtcttt

SEQ ID NO: 36628 - DNA, 12887 bp, Homo sapiens
cagtttgcaaaagccagaggtgcaagaagcagcgactgcagcagcagcagcagcagcggcggtggcagcagcagcagcagcggcggcagcagcagcagcagcggaggcaccggtggcagcagcagcatcaccagcaacaacaacaaaaaaaaatcctcatcaaatcctcacctaagctttcagtgtatccagatccacatcttcactcaagccaggagagggaaagaggaaaggggggcaggaaaaaaaaaaaacccaacaacttagcggaaacttctcagagaatgctccaaaactcagcagtgcttctggtgctggtgatcagtgcttctgcaacccatgaggcggagcagaatgactctgtgagccccaggaaatcccgagtggcggctcaaaactcaggtaagcagcaaacccaagagcggtttctcccccaaagagctgtcctcatttgcctctcccttttgcaactgtgtctgtgacggctgatcttgataataaatgtgcttcatgcctgatggcaataaactgccagtgtaatccaatagccttaggcagtggagctcctttgtttaataaattgcatgcaactaaacgaagaagctggacgctctgctgagggtatttcattgcataagcctagcctgattgcctgaaatctggcacgtaccctcttggagggggaggggtgagaggggaggaaaggcttgaatgttggcatgcttcaaagcgctctctatactttccagaagctgatctaaggtaagacctggcttgtttgatgctgtccctcttcctttcctcttaagactctacctcttcacttcttgacttctctacctaagagaatacacagaaaagctccctcttcagactgattttcagaaccatagccctcaagtctgacaaatccagggcggattcagagaaaaccctatacatcccacccccaaccctgctgcctgtctccctcctggctctgtagggctccattcagtcgtccctgcagcccgtagccagagagcccctagaaaaaaaaaattgtgaaacgtagcagctgtttctccaagggtaaggtctcactttcgtcttgactcttggagcagttaattgtgcattatcttggcttctgaaggaaaagaatcattaggaagcctgcattgacacctctgcctcttgacttctctggctccacttgttccccttccaatactgccctctgtcctccaactgtcagcaaagaccggatcacaggtgtcaaaatgctgcagatgatgatccccttggaagagcacaggtccctgccgagaggagggcttttgcttcacttccttttgtacttagttgctatagagatgcagtgattcacaattcgagcttgcctaaaacaatagcagccctaatgcatattaaaactgcttaaagcaaagttataatttaaacccgtggaaatatataattagggaaatgacttgtaacatcctagaggctgcgggtggtgggagggggtggggaagactaactgaaccatgcttttgatctcagaggagaatcctatggcatgaaggctgcagatcattccttgcctagctgcctgccagaacaccccccttctgtgggagaaaaattacttttatgggagatcttatccagaatgtagaaagcctcatgcaagttttttgcggttttcttccagtcttgcatagggaggccttggcctggttattccacacctgtgtttcttctttctttctttctttctttctttcttttttaaaaggcttttaatatgaaagagattatgcatacctctaagcactgtcctagtggagggttggggtgaaacatgaacggatcagatttctttttgccaatatgacggtaagttaaaagcctgaaatcagaagggtctccaagtggactcctggcacagtcttctctgccatttagactaaaatcccatgctttttactcgggagtgcatttttccaaagctagatggattccctggcccttttacctcttaaacctgaccactagccactgtctccttccttcccatgctttcaagtgctaagcaatgacctttgattctatggaatggcttaaaggcactgtgcatttccagacttgagcctcacttctccagacaccaaaattgtaggtaatggtgaaacagggagcgtgtgtctgaaacagagaactccctccctgtccatcatgtactccagcaatcataaacaaaaggagcctgtctatcctctctttctcaatcaaatgggtctatcaattgcccctcatgacagattcctaggataagttcttctgacctcatgtccttgaaattcacctctgcacccacttgatcccacccagccattcctcactgtttgacccagaatggatggatttgtctctttcagctgaagtggttcgttgcctcaacagtgctctacaggtcggctgcggggcttttgcatgcctggaaaactccacctgtgacacagatgggatgtatgacatctgtaaatccttcttgtacagcgctgctaaatttgacactcaggtaataaaaccttgacccctgctcccactggctgcttgtctttaacagtgtgttagaccatggttcttaggaaccagtcttgtagggaaccagccctgcttctcagcttccccactctaaattcccatctcagcatgtgtatgcacaagtgtgtgcatgcacacacacacacacacacacacacagaggcactcatctggccaggaaataggttctgtataagacacgccccactcactctaatgcatgattctaaggagctagtagaggctgtcttataaggccaggggtaataagccaaaaagattttcctctgtaagaggacataaaaacgtgcatagagcaaggaagttctctctgcatgacctagcatactagcttttgatctgaattctcaaagtctcaatctcaagaatatgaagtcagattacgactatttttaagctgcagaatggttgatcacggttcatcttttttttctgtaatttcatttcggtagagcttaattctcaagggaatccagggagatggggagagggcttttttttttttcaatccttagccgagacatgcaatcttctcattgcaaggatatgcagatggccatgatacgttgcccagatgagcccccttaaattcctccatgtatatgcccatcctctttgtcaggtcaagctaaagacctccctcttgtccttcctccatggcagggaaaagcattcgtcaaagagagcttaaaatgcatcgccaacggggtcacctccaaggtcttcctcgccattcggaggtgctccactttccaaaggatgattgctgaggtgcaggaagagtgctacagcaagctgaatgtgtgcagcatcgccaagcggaaccctgaagccatcactgaggtcgtccagctgcccaatcacttctccaacaggtacaaactgagtctactttttcacaatcaggggactgggagcaggtggctggctggcagagccagactgggagggagggttaaattgccacagtcatgctcttattttagcttgcagtcttcccagcttttgcaggaaaaaaatatgtttgtgattggttgtgacagtttaagcagcttgggcttttttttccctactgttataggaaaagtcttttcatgcagctcatagaaagccagcctcatctgcagcatccctgggtgctttcattgaccattttttgccataagcctgaagggaatggtgaagtttctggaaacaagcttttaagacatcagatttggctgaaaccatgaccgtgcaacaacacaattggccatgattaaaaaaaaaaaaaaaaaaaaaagccctctggttaaatgtcataatgcagattttaagtctccatctatttcaaatcagtcccaaacacagtcagagatttcactgggtagcccagagcaagccatctcacttccctggggctcagatttcctttgtaaaaagcaaaatggctggactggaccattttcaggtttccttccaggccttatgttatcccattcctctagcccaagatttcctagaatgagtgtgttttatggctgtccagatcccattctcatcttagtattcaaacaccacccaaggccactgagctagtacagtaacatctgggcattgtacttttcagtgtttttaccagccaggagtgaattcctgttacatgagacagctggcatcctcagttcatgtgcgtggcctggaaaggttcccagcaagaactaagagatgccaatggggttggcgtggaggtctggcaggggcagtgcagaccggtcaagtttagccccctgtgatatccctcagcctaaaaacttgactcccagccttgaatttctatgattctttgactctccactcaaatctgcacatatccacaatgatcagtgctttgcatgttactctgaccacctgagagttatcacaggcttatctgattaatttcctagccaggtgccaccacccttcttaagacagtggcaacagccaagtccctctggggcttacaagtgatttagtcatgtacatacatgcaacaaaaaagtagttcctccttagggaaaggctaaggtgcctaacacaaacgctgtgtaaaatttctttttcacccttaactacaggtgagtgcccttcagaaccacaaatcaatttgtaaaaatcacttctctagtccttggaagtgactttatcatggggttctaaatggtttcctcagaacagaaaaatccaaccattttctcaagtgggctgtctctatataactcttggttttaaatttcccctaggaagattcttattgcacagaggaaacaggtgcagagggtggggaggggagatctgattaattattggagacttccttcaccattaggaaaagaaatgaagaattcttagccagacaggggctaaggacaaagtatgtgtttgtgtggtagttaggggtggggggagaggtacattagcaaagccactattacaatttagatccttaaggattctgtgacaaatcatgatctataatacggcatatttccaattttgaggcgatactaatctccctatttcatctgaagtagcatcttccattagaaaggcagagaggtctttaggcagaactatatagctactcgactagaggtcccaatttatctaagaagagactagtaaatttttaaccaggctattatttcttctaatcagtgccttattttcaacacctttagaaaatggtcacaaagaaagtcttcttatctccctctttcatcttagggactcattaggaaaggtcaattggagaaaaaaaaaatgtggccagcccttgaaaaccggaatcttccatgcaacctttctccaaaaatttcactttaacaggctatattattcctgctcaggattgtagaaatgtccggttccatgctgggcttgctttgctccattgaagctgctcaccttcctgagacatcctgctttcccagcctctatcccaccatagacacacgctaagtcagtgccaattggcacagaattgcaagaggaagtagttacaggttcattccaccttcctgtgacttatctagcatgagatttggggctgggagaatccaaaagcctgtgactggaccaggagccagaacaaggggattttccatgacagaaatgcacctagagggtaaagaggtagctggagtttccacctgcctgaatttgcagactatgctttcaaccctgtgggaagcaggcaaaattgatcaggccagcagggcggtgcgaggcttgggaaccacttagaccaacccagatccagagtgggaaaactgacaaagcttccaactctctagggcatggatagggaacaggaaacagaagaataatattgatcaagggaaacaaaggactatttataaaccctcacacagaacgttcctaggcagtatgtgtgtatttgggtaagcatggctgaaacagtagctatggagaatatctgatcttattctttatcaaaaaaaaaaaggtcagggatggaattttcaaagtgagaaaaaagaaacataattaaaaaggtcctttcgggctgggtgatcagaacacttagtccaccaagtctttccaacacatctcctccatcctccataaagataaagaaaggaatcttcttcttctttttttttttttttttttttttttttgacagagtatcgctctgttgcccaggctggagtacagtggtgagatctcagttcactgcaacctccatctcctgggttcaagcaattctcctgcctcagcctccagagtagctgggattacaagcactcaccaccacgcccagctaatttttgtatttttagtagagacagggtttcatcatgttggccgggctggtcttgaactcctgacctcaggtgatccacccatcttggcctcccaaagtgctgggactgcaggcatgagccaccatgcccagccaagaaaggaatcttcttaagcagtcctaactaccactgcaaaggaggggatgtaagcagagctgctctattttttgtaaaattgagaagaaaaatgtgtattgaatccctagaaacatagaatgtcatagttggagatgactgctgaggttaactagactaactgcctcattttactgattaaagaataaaggctcagagagtggagtgacctgctgaaggtcacacagcttgtgaataactaagttgggcttagaactcatgtggccttgagccaagctatttgatttctacttcaaaaatggcagccagcaaaatctgcaggaaatagccacaacccaaaaatagaataccaagcacaattgaatatatgtgcaccgtggtagtccacaattaaatttgcgtcctttctctcccaaaaggatggacacatcctaccaatagctataggaactataagaccatagcacaagaaggtgctcactaaataggtgacgattgctaagtcaactcttgctggagacacaacctcttaaataatccatctcacttagtgacacaggaaagggctatgtcattggcaagcatgatcccagaggtaaatggctattccagcccttactggacaggcactggttaacctattgctcatactgagaaactggtgacatcaaataatcctgacaaattttccagcctttgaagaactactaatggagacatggactttgttttatattctaaagagctttctcagcctgcccttgctgagttaacaaaagccccatgagggaaatagggtagattccagtgggggtgggtggttctcactaagagccctcaggctggcaagggtcactgtcaagaaacaccaaggtcaggtgtcatatctgagccagcagacaaagcaacagtaaaggtagaaaggtagaaaccctccaaaaaagagcaggcactctgacaaagtggggcctgaaggaaatgtatggccctgaagctgcaaagctggctgcagaagcttaattaccttaagggtactagacttctttgtccagacaagagctttcaagtccttctaaggaagaactagcatttctttttatccctttctagggaaagattgtattttccagcctatctggggactcatctggcatgaacagctctttctagaaatggaagggttaacttctaagttataaagtccttattggagggatgggagatcagaaaccacccaccaggatctaatcaccctctgaaatagacacagccatccaaagacccaggtcctagcagagcccaagagccaggtgatgcctggagatctatatgggtgtgtagatgtcagaagctgctggtgcaaagttgtttattctatgtttctccaaaactggttttctcctcatttccccatccaaaggagatctcctttgactcatgtgctttgtaattccaaagagttggacaatgttcctctgtgccagagagtcccagttttgaccacagctggatataattctccctggagggaagggtttcaccaggcctgtgtcagcaaccaagacactgcacttgcctctcagtccccagcttccttctgctgtgccacagaagggtgaccatatcacctcattacccacgttccatgctatttaccacacatctttgaaataacctctctgggggattaagttattctagaaagatgtttgatcctgtgcactgtttggtgagttaaaaataaacaggtttcttttcacggaagacctggtggccccagagatccttgggctcctctgagaaaaagttctctccatgtaaatactgcaggtcactgtcactgagtctcttattagcgaacacagaggtaatgggttttgacaactcaactgcgactacaaaatggaccaaatgcatcccagtctaaattggataatacctgaactgtcttcccaaataacaggacaagtcattgatatgccctaaatattagacagtttaatcctttctgagccacaaagcttagctacattgcttgggggtatttaaagaattcgctgcaaagatgaaggtaactgataccaaacacaaggggttttggtaaaatttactaaaactacagataagttttcttctgggaatcactacttattggagagaattatattcttaaaactccatttccttagtggctgcaaaataaatcaacaaatgtgcagtgatcaggcaatgtagcacgatggcaccgggccataaggaatacaaagaaggacacaaatcctgccttcagtaagcttacagtctagtcagcgaaagaaagccatcacaaaaccatcaaatgctggcctatgtgatggcaaacaaagatctataaatatccaaaaagggaagaggttagcaaactctggtatagtagaagaaggattcatgaattatagtagcatgaacccttaaaaaccaccaatatttccatttaaatagacttcttgcctaggatttggccttctgactacaatatacctttgaaggagggctgaagatggagtcagtcaatatcttttatcagggctgtccaagtatgtgataagggcattagattttgtagaaaaatgcatggcacacagaagagggggccttagacagaagtttcatcagaagatgcacagatctgcatacacacacacacacacacacctgtgcccacacaccaccaaaaaaaggaaaattacaaaaaagcatcaaaataattacacatgcatgtacaatggctactaatctcagtgatgagcattggactcacttcattctaatttgcttcacctcatccaccttagtttcttctctacaaaatgagagttgaactagtcaccaaatggtctctgtggtcccagctagctctgtaattctgtttctaaaaatgtcagtcaccacagtcagcctgctcttcaaagtgtgatctaaatctcctcaactctaaacatgaagatctgtcttgcattgtgtggtaaaccctaggagcagatgcattgaaactagggtgacatggcacaagggttagagagcaaaagccaccttcagctgatgaactattgatgtttgcatggtcaggccattagggactcgtgttggctagagcccgggtgaaagcctgggtctcgccgggctctcactgggtgaccaccatatgcactctctttcttgatgcagatactataacagacttgtccgaagcctgctggaatgtgatgaagacacagtcagcacaatcagagacagcctgatggagaaaattgggcctaacatggccagcctcttccacatcctgcagacagaccactgtgcccaaacacacccacgagctgacttcaacaggagacgcaccaatgagccgcagaagctgaaagtcctcctcaggaacctccgaggtgaggaggactctccctcccacatcaaacgcacatcccatgagagtgcataaccagggagaggttattcacaacctcaccaaactagtatcattttaggggtgttgacacaccagttttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgaccattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttcttttcctgggaatggaataactatctcacttccagatatccacataaatgctccttgtggccttttttataactaagggggtagaagtagttttaattcaacatcaaaacttaagatgggcctgtatgagacaggaaaaaccaacaggtttatctgaaggaccccaggtaagatgttaatctcccagcccacctcaacccagaggctactcttgacttagacctatactgaaagatctctgtcacatccaactggaaattccaggaaccaaaaagagcatccctatgggcttggaccacttacagtgtgataaggcctactatacattaggaagtggcagttctttactcgtcccctttcatcggtgcctggtactctggcaaatgatgatggggtgggagactttccattaaatcaatcaggaatgagtcaatcagcctttaggtctttagtccgggggacttggggctgagagagtataaataaccctgggctgtccagccttaatagacttctcttacattttcgtcctgtagcacgctgcctgccaaagtagtcctggcagctggaccatctctgtaggatcgtaaaaaaatagaaaaaaagaaaaaaaaaagaaagaaagagggaaaaagagctggtggtttgatcatttctgccatgatgtttacaagatggcgaccaccaaagtcaaacgactaacctatctatgaacaacagtagtttctcagggtcactgtccttgaacccaacagtcccttatgagcgtcactgcccaccaaaggtcaatgtcaagagaggaagagagggaggaggggtaggactgcaggggccactccaaactcgcttaggtagaaactattggtgcttgactctcactaggctaaactcaagatttgaccaaatcgagtgatagggatcctggtgggaggagagagggcacatctccagaaaaatgaaaagcaatacaactttaccataaagcctttaaaaccagtaacgtgctgctcaaggaccaagagcaattgcagcagacccagcagcagcagcagcagcacaaacattgctgcctttgtccccacacagcctctaagcgtgctgacatcagattgttaagggcatttttatactcagaactgtcccatccccaggtccccaaacttatggacactgccttagcctcttggaaatcaggtagaccatattctaagttagactcttcccctccctcccacacttcccacccccaggcaaggctgacttctctgaatcagaaaagctattaaagtttgtgtgttgtgtccattttgcaaacccaactaagccaggaccccaatgcgacaagtagttcatgagtattcctagcaaatttctctctttcttcagttcagtagatttccttttttcttttctttttttttttttttttttttggctgtgacctcttcaaaccgtggtacccccccttttctccccacgatgatatctatatatgtatctacaatacatatatctacacatacagaaagaagcagttctcacaatgttgctagttttttgcttctctttcccccaccctactccctccaattcccccttaaacttccaaagcttcgtcttgtgtttgctgcagagtgattcgggggctgacctagaccagtttgcatgattcttctcttgtgatttggttgcactttagacatttttgtgccattatatttgcattatgtatttataatttaaatgatatttaggtttttggctgagtactggaataaacagtgagcatatctggtatatgtcattatttattgttaaattacatttttaagctccatgtgcatataaaggttatgaaacatatcatggtaatgacagatgcaagttattttatttgcttatttttataattaaagatgccatagcataatatgaagcctttggtgaattccttctaagataaaaataataataaagtgttacgttttattggtttc

SEQ ID NO: 36629 - DNA, 3189 bp, Homo sapiens
atggcttttacagccagtcagcggtgggaggagggccaggcgcggcagatcggcttccggttccggtgggctctgaaccctgaaaggtgggcgcgggcaggtggggtgtgggggggcgccggggcagaaggggaggggcaggtgggtgcgggacaggggccggagtgagaaccgggggccggggtagggggtagcgggtgagagccgggggccggggtagcgggtgagagccgggggccggggtagcgggtgagagccgggggccggggtagcgggtgagagtcgggggccggggtagggggtgagtgccgggggcctggccaggctgcgactgactgcgagcccccacctcccgccaggctcgcgatgcctctacacaagtatcccgtgtggctctggaagcggctgcagctgcgggagggcatctgttcccgcctgcccggccactacctgcgctccctggaggaggagcggacgcccactcccgtgcactataggcctcatggggccaagttcaagatcaaccccaagaacgggcagcgggagcgtgtggaggacgtgcccattcccatctactttccccccgaatcccagcgggggttgtggggcggcgagggctggatcctgggccaaatatatgccaacaacgacaaggtgggtccgcaggcggccttcaggggctcctctcagggcttggctgtgccggctctgtgccggacgcccggggtacctggagagacctgggtgggccctggggattacagcctggaggcgacacatctccggcaaaggagcacgctgagtgaagaaccgcagttctggcaaacaggactgataaagtaggggtgaggtggggtgactcaggccgggggagcaaccagaggccgtggggagtcggggtaaagttaggatggggaggaggcctgtgtgatgagcagagcaggtgggagaggcgagcagagcaggtgggggaggcgagcagagcttcgaggctgcttgtggtggacttcctggcgggactgctgaagcctgtggggagacttgtgtcacctccaggttggaatgtgacaacctgtaaactgtggggtcgcacatgtttctgaaacacatgcagcaaccatgtgaccagggcgggaacgcccagcttgttggggagcagctgacttctgggtacacagtcaggacccgggtcgggctggggcggcactgggctgggggccggcccagttagctctaggtccccagtctgacagcagtggttctgtgatggagcctccgggggggaggtgagggcagttgcctgggccccccttggtatgtaagagaaagcagcagtactcatggaggctctgttgcaccctcagctctccaagaggctgaagaaagtgtggaagccacagctgtttgagcgagagttctacagtgagatcctggacaagaagttcacagtgactgtgaccatgcggaccctggacctcatcgatgaggcttatgggctcgacttttacatcctcaaggcaagcggggtggggcgagtcagtgcacacagggtctgggatgggccagtcagactcacgggagccccaggtcagcatcacaccggggcacgctgacatctgcacaggagggtcactgggaaagcgtgagtggggccatgcccctttctggccagcaccagtggggtttcctgccttcaggagaggctgtcgctctgtgggtggctgacttgcccgtggggcctgagcgagcacagccgcccctttccctgcacttggacttgcttctgtgctgatcccaccccccaggctggggtgctgaggcggccccacccgggccttctctgtcctgtcctgggaccaccagcggctagagaggagccaggtgggttggctggaagggtaggtggggccctgccaccagcacctggccccatgtgagccttctgccagaccccgaaggaggacctgtgctccaagtttgggatggacctgaagcgagggatgctgctgcggcttgcccggcaggacccccagctgcaccccgaggaccccgagcggcgggcagccatctacgacaagtacaaggtgagggtttccgtcccgctccctacacctggggactcgtggcccggccctgggcctcactgccctttccatctctgcctgcctaggaatttgccatcccagaggaggaggcagagtgggtgggcctcacgctggaggaggccattgagaagcagagacttttggaggagaaggtgagtgtgtgagcaccagccgatgctgcctgcccagagcctggtgttcagggtctgggagtgtgctgccttggagagagcctgcacaaggggctggtgcactgggtgggcttggggaagagctgctgctctgcattgcccacccagaggagcatggcccgctccctcccctccaagtccccaccctgttctgtcccaggaccctcagtaggaggagtgggttcctgcactgagggtttgctcggccaccagcatcccagggtctggagcctgaggtagctgtcaggacagggagcccctgatggcatggcagctggctgcccctattccctctgtttatccatgaccacagggatgggacaggggtatgtgtgtgcctccggcatccccaagggagggggttcctcatctcaccgacaggactctgccctccagggcctctcatgccccggttcctctgggcggcagctgctgatcccatccccgtcggaactccagctgccctgggcttccctggcctcaccatgagcccctctctccttcaggaccctgtacccctgttcaagatctatgtggcggagctgatccagcagctgcagcagcaggcactgtcagagccggcggtggtgcagaagagagccagtggccagtgaccacacagctcctccatgcctgaccaacaggcccagctttccctgccaggccctttgcactgaggacacagatcccggggagctgtgagggccaccggtgggcagtgggtggatcctggtttcgtgtgctgcccatgcaccttccagcccggggccagcttggcagggatccccaggaggcctgggccgcccagaggctcctctcaggctgggccccgacgtttgcggcagtgttccttgtgcccgtggggccgggagcgagtaaagtctgggccaggc

SEQ ID NO: 36630 - DNA, 20514 bp, Homo sapiens
aggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggtgagtcactttctgagaagcaccttgtaactagtaaaagatagtttttccctgctattggggaaaactcactagaatcccactcaaaatttggcaaggcttgtgcacagcagccttagacaagcaagttaactttaaagggtctcagttacctcatctctaaacagacaatccctttcagctgtagagtgagaagagcccaaacctctgacacatgctgtgtttgtgagcaatggcaacttttactctgccagctgcatgaagcagtagaaatatcagtaccaggccacagctttcctctctacaccaccattcccaccttcacccctagcctctgcctagaaccacaggaccttgtgccaactgcagtgttagtaaaaccagtgactttatatcactgcagcagaatcagaaatggactgaggatgagaagctgtgtttgccttgtgttccaattttatgaaaaggggaaatgtgtgtttatgtgtgtatgtgtacatgctctttgcaagaagaacatgcacactccttttctttgtaaatagtccctgaacatggctcaagtgcttatgttttccattgtcagcgatgatggtaacacagctatcgttagtgcctcaggctcccagccacctatgtgtttctgtctaatccccaaaccatccactacacattgggactagttctttatttccttacatttttactctatattctatgactactaaatatttagaaaaatgattttgacctagtgtctttccttgccaaatacccaaggaacctgggtgtatagatgtgcatggtagaggcaaatgcacatagctttcttatatttttcattatgctaccatcatctcactctccccatgcactgccaaaccctgcatgtgggttaaatgtcccagctcaggatttaacctgtttctatatttgtgaagaagagattgatgtgggtttcttgttttaatagcaatagttggccatcagccaaaagacatacatcaatcctccccaacattctgactcccttggttcaaactcttggaatcattcccatttcccttctggtatattcacagttaatcccattatgcatggcttgaactaatattgcttttcatgagtcaccttttctctatatgtctaatcgcctttaatccaacccacattggctctaactccaacctaaaagagactttcatctcagcatctgctttgctgtcttcaaaattcggtaagacttgtgccctccacttactgtatttctcacatattgtctccctgctcccctatacacctgcatctccagggttccttacttgttcagtcaccccctgccgtggccactgccccttcattcccctccagttcttcactggcagaagtctgtcatccatcaaggtttgcctcaaatgcggtctcttccacgaagcttctctgatcctccaacccactgaaatctctgcttcctttgaactcctgtagattttgctcacattcctttttgtgggcctgaccacattctgccttgaagttgggttatatgtgtgcttatcattcctcacactggtcaaggaggtctcaagaacctcaccctcttcttttctttgtccaacccctttgttcaaccctcacaaacccttcccagcacagtgcctgaagtgtagtaattaattttgaaacacaagggaaggaggcaagatggaatacagaagtaaaggtgtggtgcatgttcttgaagtgggcaacaccaggagaaaaatgatttaaaattacacaaagtgatcattctttagagaaagcacaagatgagaaggatactcttaacttcggtgggctgaagcttctggaagcctctccgtgttaattttcttcaaggctttataatccatttctagaaatagctccccaccaagacagctacaaaagttaccaactgacccattctaagcttcttcttgcaagctttgatttctaactgggaagaaagggagggagccagcccagagaagtcagagcgagaatgaggctgagagaaaggcagccaagctggcaggacaagcgctggcttaaccattagctcccgggtactggggaagctcctccgtaaatatttgagagtacaaactccagttatttggagggagtcaaataaatagggaagataaataaactccaaacctctcctgtcagatataatgtgtatttatcattctgcctcactatcttgtgatcatatgatccacttttgcctcacagctgtccttagaagtgaccttgctgctgggagaggctctagaattctaccagaggctcagaatcccaaagatgattgatagacacattcaatctgagttccagctcccgtagaatggagctaaatttataagcctggcacccagggcagtgaagggacagagtatttctaacacgtgagaaactatgaagttaccctgagtgcatcactttaccagtgtgtgccttggtttcactaactataaaatgaagaatgttgctaaagtgaacagaaggtataaagtacttttgtatgggagcagtacagagatcaccaagttcacctccagtatgctcccatacaaaagggaacacagattttcgccagggatattaagaatctgggttaaagagaagtgaattggtccagaaaagaaatagatcatctctcccttcttctgctgactccttccccttccttttttcctctgctctcgtttagaattgctctttctgctgtctgtgttccctgcatatttagctgtaaaatgtctgcttctttcactgggctgtgctctctttatgggcacaatgcatgtcttattcactgctgtgtatttggactagaactgtgttgggtgtgctcaataaacattggaaggccctatcagaaaaatcagctagcagaaaacttacttaaaagtaggaaaacagtgggtatgttcttgtgtagaaaaaagaaaggagaaagacatgtaattagaggtacacttttaaaatgagtaaagattgtataattatgccctataagggcttataacatgtagaagtaaagtatatgacaataatggttcaaaaggatgcagagagtaaataaagtcaacctaaagtttttgcagtgttccaaaagtaagataagtattaatttaagtaagattacaacaagccaattatgcatgttataatctttaaggtcaccagtaaaaggaaaagagggtataaaatgaataataaatatttgcttactctaaaaggatatgggaaaggaggaataaaagaacaaagaacaaatgagacaaatagaaacaaataaaaaaatagacttagttccggctgggcgtggtggctcacgcctgtaatcccagcactttggaagaccgagatcaggagatcgagaccatcctggctaacacggtgaaaccctgtctctactaaaaatacaaaaaattagctgggcgtggtggcaggtgcctgtagtcccagctactcaggaggctgaggcaggagaatggtgtgaacccaggaggcggagcttgcagtgagcagagatcacgccactgcactccagcttgggtgacagagtgagactccgggtgacagagtgagactccgtctcaaaaaagagaaaaaaaaagatttagttccaactatattagtaattacaacaaatataaatggatgaaatactcaaattaaaacaccactattgttagacttattaaaatttttttaaaggactaaaatatatataccgatcacaagagatgtatgttaaagataaagacgttaagaagttgaaagtaaaaagggacagaaaaagatgtaccatggaaacagtaagcaaaaagctagtgtagctatatcgacgtcaggaaaggaaactttatgccaagaatatcacaaagatgaaaagggatatttaataagtatagaagggtcaattcaatgaaaagataataacaatactaaatttgtagtcatctgataacatagcttcaaaatatagaaaattaattaaatgattgctatgttactgtcttttgaggaaattgtctacagaccattagtgggagtttgactgttatctccatcacaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtatgtacggccacgaaccttatgtaagaaaggtgctggaattggaggctgaatattaccagttttgcttttcagttccccaggtggcttcatctagtgaaggaaggacaatatattcacacagctgctgctatcatcccacaataaccacttagacttatatagctttacagttaggtagcatgttcacatagccattcatttaattcttacaacagcctaggaagtgtgtattataccagatttatagaagagaacatggaagatctgatagcttacacatagtgagtggcagaggcaaaaatgccaaaccacatctgacatatttcctattttaccgtacctgtttctcttaaacatgtcctaagtctctgagagattggtgatgttgaaagatgtatgcaagtttagatgttcgggaaaaaaacaccttcatagaaacaggcccagaaaaccacaagatagactgtgagtatttctactctttctcccttaggtggctccttgcatattgctttttgcttaacatattaacattaccttgtatcttacttatatcttctcccagtgctatatttgaggactaacccctgttgttacagcaagaaatgattcaagggaaacagtacagtatgagagcttgaagccatagctctatcaataatcattgataaattcctgaacctctttgagcctcagggttatttgcctatctgccttgcttaacttataagaggactgaataaaataattcatagaaatgtgaaattttcataaagatgtgaaaaaacagtatgttggcagtagttaagacactctatatttactaagtttgaaactaggattaaaaaccttagaaaccatgataagcattaattataaaattaatcaaaaagccttaatattggcagagtcctcagagatcatctaattcaatatcttttgctttagaaaaaagaggtcaagaggagtgtaacagtttatctctgtacatgcagcaagaccgtgcaattacaaaagttcattccaggcttttccaactgccctacctggctccatcattaacaattccactgacatgggatggtccagtctacatcatcaagtctgttcttaaagtgcctctcctacttgatacttgtattactacctctctagtaacccctaccaccattaccaccactgatatgtccaaccaattatttagttgaggagtagaaatgaaaaataaggggcattcaccagcctttaaccaaaaatcaaagagcctattcttgagagcattgtcagccttaagcatgccatttcaaatgcgtagattcttctgaggggctgggtattccacagatggggttgcaaatgcatcttttaaaaaaatgtggtatctaggtataaaagtaaaaatttaaaaaacaagttattgaaatgtgaatctttagtttgtatttaaaacaaaaacagctaagcttgagcctggacactcggactacataccctgcaggtgacagtaaccaccaggaccagaggatgccagtgtgaatgagaactctgcttctgacctagccagtcattcatctggggaccctcaggtgggagggagtggctctgagactcagggagttctgaatcactccagagaaaagtggaggggatgaggaaagagaagagtatttctggctcagattggctgggagtccccatgttttcttgtgtttttttttttaaatgaaaataattaaaatttatatttggaaaaaaacatacacatacacaaaagtatataaagcaaagaaagactcctcatttgacctgttaccacttcccaaaatttaacactgatggtttatatgtattcttccaatattttttctaagtacctgcaagtatacacatatctattccattttaaacattgtacaaaatattcctcatctcttaggtcttagaggtaattctgtatcaacatatgtaaggtctatctgattctttttaaaaccacaatattcttgatggatatgccaaattttatttaattaatcccatattgatggatatttagttttttagcaatgataaataaagttttaatgaacattgtacaatagctttgtatacttttggcattgtattgtaagaataaattcctagaagtggaatatcaggataggttgatttaaaagtttgataaaatgtgccaaattcttctccaaaatgttgtactaacttacattcctacaatgtatatattatcaaactttctaatctttgtcaatttaacaagtaaaattataatgtttttgatttgcgtttcttttactataagaaatcttgaatatttctatgttgtttattggcctttttttattatatagcttgcctttttttattttttatttatttatttttttagacagagtctcgatctgttgccaggctggagtgcagtggcggtgatctcagctcactgcaacctctgcctcccaggttcaagcgattcttctgtctcagcctcccgagtagctgggactacaggaccccaccaccacacccggctcattttttgtatttttagtagagatgggatttcaccgtgttagccaggatagtcttgatctcctgacctcacaatcctcctgcctcggcctccccaatcgctgggattacaggcgtgagccaccgtgcccggcctagcttgcctttttaatgaaacttttataaatgaagataaattgatttttgttgattgtaagtattgtaaatactcccccaatttgtcttttgactttgtttctgatagaaggctttgatttttagataatcaaatttactggccttttcctaaatggattctaaatacttttctatagtttctaaagttttcaaaatgtgtgcgtgtgtgtgcttatatacaggtagaaaaaagtattgttttcccttaattttatgtatataaaaattatatatacttaaatatatatttatatatattaaatataccaatttacttatactaatatatttatatatactaaatatatacttacatttatatatttatataaattatttgtatatttatatatatacacacacacacatgcacatagcattggggaagaaaacaatactttttcgttgatgttggagttgggattgttataattcttaagagaaggtccctggatttcagtgaatttgggttggagtcctgactctgaatccttaccctaccatttattagctatgtggtttttgggcaagtggcttaaattctttagccctcagtttcttcatctgtaggatggggataactatatctgctacatagatttatcatgaggattaaattatatagaaatgtggctcccaaagcagtgctgtgggtgaatactgggagcttcctcacaggtcagaatactaaaattactaccatatctcacccacaaacttgagtttttgggacagtacttcttacagatgaaagtggaacacataatagtcaagaccacaattatttattgaatactagtctgattatcataaagttagtgactacggatcatttactcaatataaactattttcacaatgaaagtagtgccacacaattcaaggcacgtggttcaggatccagtcagaactgggtttgaatatcaaaatccatattaactagctatgtgaccttacactagttactcagtctctcaggaaggcaatgtcttcacttgtgaatgtggatgttacctacctcattggattgtttcaagaattgtttaaggttaactagtgtcctactagtgttttaaatgttagtttccctccctgtcctttaccttctatgatttaggatataatttcaggatcatggtgtgctataaggagatgggtacaaacccaaacctgaattgtctccaaaagtgcgaattaacacatttttcactgaagtcagagacagaattctgaataaatgagcgttttacagagtgtcaggacactaaattttgactttacatttcaaatgtatcatgaattgcactagaacataagctccacaggactgggattttttattttgtttatcactctatatccaggacctagaattgtgcctggtacacagtaggcactcagtctactctagatttggtaatgatggtaaatatttcttgtttctctttacaggtcgttatgccatggtggtctgtggagacattgccgtctatcccagtggtaatgctcgtcccacaggtggggccggagctgtggctatgctgattgggcccaaggcccctctggccctggagcgaggtttgtagtaatccattaccaagaggctgtgcatggcatagccaagaacatagatcctaatcccacattggcacacctgctactcagggctgaggtatgcgtttgaggatggtattgcttgcctctaaaaagggctggtctatggagcagagggaggagaggagaaatgggagaggggaatccgcgaggcttcctctcttgcatcatcaggcattgggataacgatgcatggaatgagtggtgcagatgatggtgaggaatcttagggaactcttctggcaattgaagattaaaatatataactggatataaagtgaaagtctttcctttgagactgttggcttctattctaggttttgttaagcccatgtaggtgaggaaagggaaatatacatctcatttttgtaataccaacaacctgtccaactccttttgaatatgcaagggatgttgaatgggcttgaacttgggcatgggacacagataatgaccagaaacctcctttatatggttctctcatcttttgtgctcaaggtaggctgcattgtgtagtctctgaaacactttgtgtgcctttccagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaaggtatgagattcagagggcagaaagtgggggctctatttacataggccaagggtttgtacccaaaggccatgagatggtcttttctctcctgccttgaaaataatgtcaagagaattgtttcctgtcctctttcttacactcttccctgggtctatgctaaaatccatttggaagtcattcaacttcaggtgtaaaattgcttctaacttgagctaaataaaagaaagtaaataatccagggcaaggcccccagtgtgaaaccaagggatgtcagccacctgagaagatggtgttaagaggctgggcagtcacattcgacagtggttggcatttgtttctggttaagtcaggcatggtttggctcttggtttgtggtttaccatcttttaaagtctcacgttgagaaatcatacctatattttctatatgctgaagtgttatcagtgatttttctcttcgtgatgctactgcaggttgattttattttcacctttagttttggaatttccctcctgagaaatatgtactgctttcataagcagaaaataagcaaataaatcttccttttaaaatacagaaaagcagggagtggtggctcacgcctgtaatcccagcaccttgggaagctgaggcaggaggattgcttgaacccaggaatttgagaccaatgtgggcaacaaagcaagaccctgtctctaaaaaaaaaaagtacaaaagttagccaggcatggtggcataagcctgtagtcccagctactcagaaggctgagatgggggaaattgcttgagaccaggagcccatgcagtaagctatgatcaagcaactgcctccagcctggactacagagtgaaacaaaccctgtctctaaaaacatataaataaataaaaataaaatacagttaaacctactttaaagacataaatagtattcttgcctgctcaggcatgcccagatgggcatccgcaaaagacagattgcagtgtgggagaaggcatggatgccttgggggtgtcataaagagctacctcttgtccctttctactgcagtgggtgggacaccacctgccagaggtgaacctcatgggcaagaagttgctttgggcctctctgcctcagtctgtcttctgtaattggttatttgctcctaactcctctgaattcttgtggcatttaaattttactccttatttgcatatgtaaggtgacagatgctgctttggatcccagcactaaaatgtaatatttcctaagggcagagattgcattgccctcttcttcagagtgagagagacagtctgtagagtagagtcagagacatctgaacctgaatccaaagccagccttttcaaagttggacagatgacaatgttttgtagaccggttcctcctctggcaaatgaagaaaattatataacacaaggttgatttgagccaagtatcatagaggctggtaatagtagatacaaaggctttgtttctttcccttctttccttattcgtagagattgcttagtaagtgcatgtaaaatgaataaataaagctcatatgtgtttgcaggaggtgggaagtagttccctgggaggcctggagaaactcggcacagttaaatctcagggaggatatctaaatggctcgcccctcatgccccatccttgccttcacgcttcctcttccagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcgggtgagttctcttcttggggagcctagaggctggtgaggtgtgagcaagaaggaggcttcttcatgccttaagtctagaccaccagcacccctgtgggggacaaatggcaatcctccagcagaacaggaacaatcccaggtccttccacggggtagtgggttattgtctgggtagggccctccatgagttattgcagggaaacatgggggatttggcagcactgcaggatcaaggggcagtaagaaactacagaggataaagaaagaaagagagaaagggagaaagagaggaagggagaaagagagtagctaaatcattcagtcaataaacattttctgaacatgttatgtgctagacatcgtattaacctctcaggatactaaaatgaatgtgactccatggtccctgccctagagcatctcacagcctatacagacacaaacacacagaagcaaatgatcacactacagggtagcaatttgagaagtgtcaggtcccattctcatttgccattgtcttaattcatgtcctgcttttgcttttctcccatctataaaatggggatgttccagctcatccccttagatgtgaaaaagcagaaagaatgctgtttattgattcactacactaatacactaatatttacaaagaaatgtcttcaatacagtttccactgggaaaggaatctttccctttcttcttggtacctgtttatttcaaattttggtcaattttatcaacagtagaataggctaccaagtgtagcccctgttactaactagtactcctaaccctgccactaactaaaacatcaaaattagcacaaacactgcttgtaagaccagccctatcgaaacaaaaagtataacatataccaaagatactagcttaatatctttaatatataaagatattatcaataataaaataaataccctaatagaaaaatgagcaaaggatatgaacagaaaattttctcaaagaagacatgtatatgatcacattttaaatatgcatattcattaataaaaagtttactcaagttaccattttctctagatagtctttttaaaatgtgaatacccagaattgtcaagcctgtgggaaaatgggcagtagtggatgcgtaaatggatcaggtgttttgaggagtaacaggagagcatgaagccaaagccttaaagatgtgcaaactttgggctcagtaatcccatgtgtttaaaagaacacctacctattcgctgtagtgttttaactagtgaggaacaggagcaggaagatgggttaaagtgcggtacatcctgtcatggaccattcttcagcctttacaaataatgttatagaatgtcatggaaaaaaaatatatatatatatacacacacacactaagttaagaaagtatgctaaccacaacacatagcatgattttctttctaattttctagtaagctctataaaattagggatggattccaccagaaaaataagccctaagtactctctctgaatggtaaggccattagtggtatgttctcctctgtactgttctgtatttccaaatattgtaggaaaaacatgcgccccaaagtcctctccagaagctgttacttttcccccttgctccctgcctcccgtcccctggcctctcacatggctacctctggctacctcacagggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccagtgagtactgcatctggctccatgtcctccatgcacaccctcagcctccgcccccgtgggctgcagggtcaacaaagttgggtttctcttttggctcagaaatttaaaagaaaggaaggggcctggtgtagtggctcatgcctgtaatctcagcatttggggaggtttaggcgggcagatcgcctgaacctaggagttcgagacccgcctgggcaacgtggtgaaacctcatctctacaaaaattagctgagcatggttgtgtgcacgtgtggtcccagctgctcgggaggctgaagtgggaggatggtgtgagcccaggagtggaaggttgcagtgagccatgattgtgtcattggactccaacctggatgacagaatgagatcctgtcataaataaataaataaatataaaagaaaggaaaggagggagaaggcaggaaaaggaaggaagatgaaagaaactcgtaccaaaggtgtatgtataggcagatttacagtctgtatcagacagtggtctccaaagtgaagtacatgatgtcaagggatgggcaagatctgtttgggcacatcaagaaaacagtagctttggtatgcatatttttgtctcatttatttaaaatctctatacttagtagagcatggtggttaaatgggtctgactttagagcccacaacctgggttcaaatttttttaaccaattattagggttgactttggataatacttaacctcaatgcacctcaccttccccaactgtagcatgtgtgcaatcacaatacctgtgttctactgtttttatgagcattaagtatctaaaacaattaaaatagcagtgcttagcaggtgctcaaatgttggatgttatttctattcattttctgttttgtgggttttataaggaagtactgcatctaacataagaaagggctcatgaagtggctcatgcctataatcctagcactttggaaggctcaggcaggaggatctcttgagctcaggagtttgagaccagccttgggaacagagggaggccccatctctacaaaatttttttaaacaattagccatggatgttcacggtggctcatgcctgtaataccaacactttgggaggccaaggtgggaagatcacctgaggtcaggagtttgagaacagcctggccaacatggcaaaaccccttctctactaaaaatacaaacatcagctgggcatggtggtacgtgcctgtagtcccagcaactcgagaggctgaggcatgagaattgcttgaacccgggaggcagaagttgcagtgagctgagatcgagctactgcactatagcttgggtgacagagtgagactctgtctcaaaaaaaaaaaaaaaattagctgggtgtggcagcttgcacctgtagtcccagctactcaggatcctgaatcctgaggtgggaggatcacttgagcccaggaggtaaaggctgcagtgagccatgatcacgccactgcattccgggcactccaggctgggcaacagagcaagactctgccaaaaaaagaaaaaaaaaacgggcaggaaaaagtgcttatgggtgaacttgatcaaattattactcacaggggatgatcaaaaagttatgactgctgaaccattaccaatcaacatgggagcctgaagggtgagtccagtggtctgatctccatctggagacaccttcagaatgcactgaatttaccctgtcctcatgagaggggagaagctctatgtacaccaaaaattatcttgtgttttctctgccttatatatcttggatattagctgctttccttttggcaaggtttcctacacaaaggcctgtccctggggtctaccagaagtccctctttatgtagggtgcctggaacccatttctagttgcatgaggtagacagggagaagatcgggatgataggctgttgttctatttgaagtgcagaatataatatatatatacatatatgtgtgtgtgtgtgtgtgtgtgtgtgtgtgtgtgtgttttatttgatttctttccccacagccactctgcccaagaactggctggctccaggattggtgccttctcttatggctctggtttagcagcaagtttcttttcatttcgagtatcccaggatgctgctccaggtgagtgtcatctttctagtaggccttcctgacaagattcatctggtagaataaccatcttcttccccaccattactgaggctgccatcttgacagagttacgttattattaatagcaaagtaaatcactgaagggatttaagcatggagtaagtttgtttaatttatgtgtttaaagcacttatttggctactacttagagactagattgaaaaggaacaaagctggatatggggaaaccacttagattgttccagtaactagttcaggcaagaggtaatggtggtttgattgcaactgattaaagagaagttgatggatttgagatacctaataagaatttattgattattttgtgattgatgtgattaaggacatgcatttaagtactatgtggcatacaccttgaccaaatcagtgtgtctgcctgcatgttttgctaacaagtatgcttgcttatcatttcttggtattctaagccacacacaccacacgttcctccagggtgtaacctcccacagaacctggctctctgttgaactcgtgattggcaatagtgataatgacaatgaaaaaggtgtaacaatcttgcttttgcttcccaggctctcccctggacaagttggtgtccagcacatcagacctgccaaaacgcctagcctcccgaaagtgtgtgtctcctgaggagttcacagaaataatgaaccaaagagagcaattctaccataagggtaagaaaaaagtcaggaagagaggaagagagaccccattccagtagctgggagccagggatttctttggaaatctagaatttagtagtccagggtcaagacttttacgagatatggttgggagaagatttgctagaagatctgttgtccaaaggggcaagaagtgggtggggaaacagaagatagagttgggaagagggaggcaggatgcagcttcccagtatagaatatagctaaacacccagaatgtgtagtcccatggaagccagaagtatagtctttgaaaataccatctgcaacagttgaaagagtacagactttagagctagatatccaaatctaaccctgagctgtgccactcactagctgtttatctttggaaaaatggttgaacttttctcagttgtcttatttctaaaatcataccgattttgcaggatttccaaacaaattaaatgaattactctatataaatatgttatcgacaaatattactgtcccctccaaattgccctctttctccaccaaacataaaaacaaaaaacaaaatattgctccaaaagcaacaaatgaaaggaaaatgaaacccaaaggtaatactagagtgattagttggtggttttaaaaccatagtaatacacagttttaccatgatttctacaggttttatatatattctcaagcaaaacttgggatgcatgttgttttgcagcatggtctcaaaaggagacagaatatacggaattggaaatgttccagaaaacctagacctagtggtcattgatctcttctggaccagtggatatgttatagcaaagaaagacaatgaaaataaaaatggagcagggcacagtggctcacgcctgtaatgctagtcctttgggaggcagaggcaggtggatcacttgaggccaggagtttgagaccagcctggccaacatggtgaaaacccatctctactaaaaatataaaaattataaaaatatgaatataataaaaaaaataaaattatgtaaaaattagccgagtgtggtggcacacacctctaatctcagctactcaggaggctgaggagaattacttgaacccaggaggcagaggatgcagtgaactgagatcacaccaccacactctagcctgggtgacacagaaagactctgtctcaaaacaaaaaaaaaaaaaagaagaaaagaaaaataggacctctgagacaaacgttaacggacaaagcactgaaatactgcaatgaatcagaaccagaaaatttagagtttagaaggacgtgtctgttaggaaacaggaagctgggaattacgtctcaaagtaggaactattggcaaaaggatgggatgaagatttcaatggaggaaggctatgtttactgtaggaaaatgttgtactcttataataaaagtcttaatagacttttattaaggccttaagtgctagattcaagatggctgcccctcttgttctgtgggtccagtgttctatttggtggactaagggtgaccttgcagccccttacagcccagccaagagagcttcactgtgaaggggcagacatcttcattactattttctcttccaaaaactcatataactctttgtgagtactgcctcttctcctcattccacagtgaatttctccccacctggtgacacaaacagccttttcccaggtacttggtacctggagcgagtggacgagcagcatcgccgaaagtatgcccggcgtcccgtctaaaggtggtgagtgagagtttgcagagttggtggcataaaaccctaatgtcttcctctgagtaacaacacagagagagaaggtggggacaggtgcagggagaagaaagtttaatggaagaggattggggtgacaggagaaatgggagaattatctgtggaatttttaaaaggaaaagcaagtattcagaataggaatcttgtagtttgggaacattaaccaggccagggagggttcacagctttcaaactaatcagaagtggggatttgtaccataaagaccaattaaaactcttggggctctttgccttggaaaggcaaaagctgggggagaaacatgttctgaaatcttgaatgtgaaaaataggagctggatttgtttacctgatctgctgaagataggaagctctcctagaagcttgacagattagcattcagagcatccgttgagtgaacaggctgtgaacctgaacctatagaaatcattactccagggggatgagatcaacagatctgatgagcaacagaacaaccaagatgaacagccccaaaacctcagaaatggtacacaccaatgtgtgggagacagattcataaggaatggggcggttgaagattctgttaaagccagatacttctgctggagggagttttaggctaagggtcatgtaacaattcttatatcatgggattccttctggggagaagcaatgaggttcaggaaattcgtggacacaaggatagggagaagagagcaaggtgaaagaggattgcggtgacaggagaaatgggagatattctttatgatcgtttttaaaggaaagcaaacattcaaaaataagaatcttatatgaacccaggtagctgccttcagttgaccaaataggtaggataagcagaatgatagagtgagaagagatttattttacaacccataaattttaattagtgcagtctccatgctcaagtttttaagattttcccctccttttggtagatggagagggaagaagaaaaaggtgtgccgaggcagggaaggagcagaggaagggaaggaagaagtcagtgggtggcagagatgcacagatacagccacctgagaggaagcagaggtgcgggtggaggggccctgggttcattccttaccgctgggatattggcaggtgctaggctgttgcagcccagatgttgttagggctaggagaggtggacaagtgggctgagggccgcaggatgcctttgagaggacgagctcagttagcagccctgaagactgtggtactgcccgggagcctgtgtgcatgttggaaatacggttcttaagggcaggtcagtagcaaagaggggctgttaaatgtgtcaacttagttcattcatcagaagaagagtgggagaaatagggagggaggggggaaagggagagagagaggttggggagagagtcagcgggagggggagagagaaagagaaatttggaatttttaaaggagaatttccacgtcagcctccctccctctcatggtagacaagcttcttgcaagtgcttaggcagaattatacctgaaaaaaaaagctggaactcttgaccttttctcatgttgattattaatatgagcagtgaacttccaacaatgagattttagcagaaatgaagggctgctgtcagtgcagtgctcatggtggagctctacaggtctctgcagcgccctagcctgcctctcctgctctcctatcacaggcagatgtgcgacggggaccctgcctacccccagccttggctccagtagcattgggcacagatccctcaggtgtccaggcttggcacagggtgcatagtgggagcaccctcaggatgcagttaggggagcccctctgcacagccacacctcgggcaagaagcaggtactgggggcagggtgcccaagaggagacccatgattgaatgactttttgtttatttaagttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagagg

SEQ ID NO: 36631 - DNA, 17133 bp, Homo sapiens
tggcgggcgcgacactatccgtgcggccaggcggaggtgagtgcgcggcggccggatgggcgggacgggcgtggaggacgccgagcaccgtggcgcgcgctcacgtccgcgtccccaagggctgcgctccctcaagcgcagtgcccagaactcggagccagcccggcccgggggaccctgctggccaaggaggtcgtcagtccggtcttgtcttccagacccggaggaccgaagcttccggacgacgaggaaccgcccaacatggcctcggaggtgagtgggacctcggggactccggtcctcctagcctccaaaggagagagtgggggcgccagacctgcctcgggccaccctgctgggaatcgccctccaggaagcaattttgaaaattacctaggaagcctgcacccccagccctcccgggcgcatcatctggagcccagcagtcacctttaccaggactcaccagtatccgcaggcagcccttgtggcaaacccaccaacccacactactaggggtagagtggctctgccctcacctcacagtgatgcctgcctggccaggaaaagtggctcccaagccttcagccttccaactcttccttccttcttaccacgtgtcctcctgtcaggtcccaccccacaccacatcccttctcctgctagagcaattgtccctgtttatagaataaagctcagcccctaagtgttcttgtccttgactgtggcatgtggaaagagccaggaaaaaggggacgtcgcctcgtggctccagcaaccctggtgcctggtcccttcctgtctcactggaccctgcctcttagggtcagtggctcctggcctctcctcctgaccactgagatgctggattcccaggcagaggttttccttccttgggccatagttgatttatctggcaatgggggtaataatagctgtcggcctcactctgtaaggcactagattatgaggccattgctttggacccttcaggtgagaggggctgttcgcctgatgcttgatgaagggaactccgggaagcaggaggtctgggttccaggcccttttggccttcattagctagcaattcacttcctctttctcaatgccctgcaagctcagtgccctgcaagcttctgggtcatggcaggggggtagggcctggactttggagccaaacagacttggtttctgtaccagtcacttgagccctttaaacctctttcctcatttgtgaaataggggtaatattgcccacctcataaaaggccgtaataacatatgtgaaatccctagcacagggctgagcaacagtaggtgctcaataaatggtggctaaccacaacaatactgatatttctactttgggaggccgaggcgggaggactgctgaagcccaggaattccagaccagccagggcaatgtaatgagaccctgtctctacaaaaagattttgaaaattacccaggtgtggtggcgtacacctgtagtctcacaggaggcggaggcatgaggattgcttgagcccaggagtttgagactgcagtgagcatgatctcaccactgcactccagcccaggcaacagagtgagatccagtttcaaaaaaataaaaataaaaaaacctggcaggcatggtggctcacacctgtaatcccagcactttgggaggtcgaggtgggcagatcacctgaggtcaggagtttgagaccagcctggccaacatggtgaaaccccgtctctactaaaaatgcaaaaattagctgggtgtagtggtgggtgcctgtagtcccagctattcgggaggctgaggcaggagaatcgcttgaactcgggaggcggaggttgcagtgagctgagatcgcaccactgcactccagcctgggcgacaaagcaagactccacctcaaaaaaagaaaaaaaacccacaagtcccaaaaccaaaactggtatttcccatgtacattcgaccttaactgttgctcattcaacccagcccaactcagtgccccatcccctggccctgaagagaccattctggcccagatgtgtcctggcttggagtagcaccttctgctaccacactaggcctccactctcctcagtgcccaaggggaggcacctcactctgatctccctgtggggtcctcttatgcctgccagtaaggataggagtttggttctagagcagagtggtctggcttccaacaagcccagtgttctaggtgacctcaggttgccccaggccttcctgtaggttggcactaattggtttggctgcagctccacttattaagtagttatttttattactaacaacctaggcagggtggcccaggagcccgctgggggaggcggtgccaggctcctggctgaggggcaggctggccccaattctgactggctggctccagtgatcaggaccagggccccacgtggtgctttgctggagatctaggcttggtggggcagctgtggggtaaggggcaggaccagctcaaagatggggtgggggcggaggctgcctctgcagggcagagtcctttggcagtcgggactgttgggcatagaggagtcagctcacagctcagggccagagcactggagaggtctctggggtgcatacaggaaccaggagtggagctgaagcatgtcctatcccctgccagccctcccttagtaacagctggcatttctcgagtccttcctgagcaccaggcaccgtgttatgtatgcaatttgcaaatattatctgattaaatgctcacaataaggctatcagagaggtactattattatccttatcttattattattattattattatttttaagaaggagtcttgctctgtcgcccaagctggagtacaatggcgccatctctgctcaccgcaacctctacctccaggattcaagtgattctcctgcttcagactcccaagtggctgggactacagcttcctgccaccgcgcctggctaatgtttatatttttagtacagatgaggtttcaccatgttggccaggctgatctcgaactcctgacctcaagcgatccacctgcctgggcctcccaaccctgagggtttttgtttttgtttttgttttgagacagagtcttgctctgtcgcccaggctggagtgcagtggcacgatctcagctcactgcaagctccgcctcccgggttcacgccattctcctgcctcagcctcccaagtagctgggactacaggcgcccaacacccccatgcctggctaatttttttgtgtgtgttttcagtagagacggagtttcaccatgttagccaggatggtctccatctcctgacctcgtgatctgcccacctcagcctcccaaagtgctaggattataggtgtgagccaccacgcccagcccctgaggtttaataataggtgccaggccaggtggttaatagaagtctggggcattgtagggggacagaggaggatatatgtccccattggccattgtagactcccttccacaaaaaggacgtcagtgaagtgacatgcccacctctaccccaccctcctcccagtcctgggcactagggctgctccccaggtgttctgtaccccctccccactctgtcccatgccctggcctctgccctctttcaaaacatagatgtggctggcgcctaggctcatgcctataatctcagcactttgggaagctgaggctggaggacagcttgagcccaggaattcaagaccagcctgggcaacatagtgagaccctgtctctaccaattattttattttattttattttgttcatttatttatttattttgagacagagttttgctctgtcacctaggctggagtgcagtggcgtgatcttggctcactgcaacctccgcctcccgggttcaagcgattctcctgcctcagcctcctaagtagctggaactacaggcgagtgccaccacgcctggctaatttttgtatttttagtagagaccaggtttcaccatgttgaccaggatggtctctgtctcctgacctcatgatccacccaccttagccttccaaaatgctgggattacaggcatgagccaccactcccagtcctataaaattttaaaaaaatgtctgggtgtggtggcgcatgcttgtagtcccaactattggggaggctgaggcaagaggattggttgagaccaggagtttgaggctgcagtgagctatgatggtgccaccgcactccaacctgggtaacaaagtgagaccctgtgtctaaaaaagaatttaaaggccgggtgtggtggctcacacccgtaatcccaggactttgggaggccgaggtgggcagatcacgaggtcagattaagaccatcctggctaacaaggtgaaaccacgtctctactgaaaaaaaaaaatacaaaaaattagccaggcatggtggtgggcacctgtagtcccagctactcaggaggctgaggcaggagaatggcgtgaatctgggaggtggagcttgcagtgagccaagatcctgccactgcactccagcctgggtgacaaagagagactccatctcaaaaaaaaaaaaaaaaaaaaagaattaaaaaagatttttttaatgaacaaaacaggctcggcacagtggctcatgcctgtaatcccaagcacttcgggatgccaaggtcaggggatcacctgagatcaggagttcgagaccagcctgaccaacatggtgaaaccccgtctctactaaaaatataaaactcagccaggtgtggtggcacacgcctgaaattccagctactcgggaggctgaggcaggaaaattggcttgaagccgggaggtggaggttgcagtgagccgagatcacgccactgcactccagcctaggcaacagagtgagactctatctcaaagaaaacgaacaaaacatagatgcctacataccattcctctgcccttggctcctggggagtaagggatcacccagtgacctcctagaaggccagtgacaatggggggtgtcagggtgcttttcagagccaagggagtggtaggaattgggatcttagtccagctccaagctgtgagggagagagttgcagggcacttaagcttggtggagaccctcaaggcctctttgcctgtccctgcagcaaaggttctggacaccagagccaagtccagaagccctggtggaacaggggtgaaaagcataggttctgacttcagactgctgggccgcagccctggctatcccaccccaggtgagagcaggctgctctgtgcctcagtttccccatcttcatagtggaattgtattggtgcctacccagagggttgtgtcaacaattaggatggcacctagcaccttggtcagtggtgggaaaggttccagaagttctgctgtggtcccaggggtgtctcaggccctgccatcatctccttggaggggtgccatgtggtgggaaagaaccccaacttcaaggccacacacagtggctcatgcctgtaatcctagcactttcagaggccaagatgggaggatcacctgaggtcaggagttcaagaccagcctggccaacatggtgaaaccccatctctactaatgatacaaaaattagctgggtgtggtggcacgtgcctgtaatcccagctacttgggagtctgaggcaggagaatctcttgaacctgggaggcagagtttgcagtgagctgagatggcaccactgtactccagcctggccgacaaagtgagactctgtctcaaaaaaaaaaaaaaagaacccaaacttttggtgttcagccatgttcccatgctcactcccagggtggtgactctgggaaggtctcagcctccttgtctgcccagttagaatgatctgatgcccctgctaccatcagacttgataagtttcccaaagactctttgcaagaagcactgttctggagggtggaggagagactaattgttcttgctctcctggccagagtgggaagctttggggtggccggtttgtgggtgcagtggaccccatcatggagaagttcaacgcgtccattgcctacgaccggcacctttgggaggtggatgttcaaggcagcaaagcctacagcaggggcctggagaaggcagggctcctcaccaaggccgagatggaccagatactccatggcctagacaaggtacttgccgtggcccaagccccacccaaggccccttccctgtggccccaggctcccaccaaatccctgagcaaacagtgcagtgttgcccatctgtggtttcacattgaactaattatatactcaagtgctgtttaactgtgtgccttgatgactgcctctctccatcctttaatgacccctgtggcccacatggctcatgggtaaaggtgtgctgggcctgagatgccccctcccagggtgcgcttccaggactcagctcctgggcagggacagtcagtcaccagggatagggtgggaccaaggcaggggctctcttggctgctgatgcctgctcacctgaccccggcattgctgctacccactacaggtggctgaggagtgggcccagggcaccttcaaactgaactccaatgatgaggacatccacacagccaatgagcgccgcctgaaggtacgacccctggagccccaccgctttccttgcctcccctctccaccttgcccagggccactttgagcattagcaccattctgtttacttcgccattggcagacagcatgtgagacctcaggacatgagccaggcaccctggctcatgcctataatcctagcactttgggaggctgaggtgggaggattgcttgagaccaggagttcgagaccagcctgggcaacataatgaggtcccacagctacaaaaattaaaaaaagaaaagaaaaaaagaacaggcctcagcagaaatggcgagagatttggggaggacccggagccctggggtatggaggtaggttggcagggctgatgaggaaaactgccctgcctgggttgactcctctgggggtatagaccgtgaccctgggtctcccttcacctccaggagctcattggtgcaacggcagggaagctgcacacgggacggagccggaatgaccaggtgctttagcccctccaccccctgctccgtgttgtcccaaccttgaggagcccagggggcagttagagttctgcagcggtcctggctcctcagggaagcaacacatcggcctccctgagcaccatctcctccttgcacaggtggtcacagacctcaggctgtggatgcggcagacctgctccacgctctcgggcctcctctgggagctcattaggaccatggtggatcgggcagaggcgtgagtcctacagggacacccagggggcagacagaggtgtgatggaagcctgaacaggagacctagggggcaggggtgaacagcgtgggggtgccaggccctgggggacaggggcatcccagaactccaggatcgaggcagagcagccaggagtgggccatttcctgcaggccccaatactcccatgccagtctagctcagcaggcagagaagactaacccttcgtggggctgggtgcggtggctcacgcctgtaatctcagcactttgggaggccgaggtgggtggatcacctgaggtcaggagttcgagaccagcctggccaacatgggaaaactctgtctctactaaaaatacaaaaattaggcaatgtggtggtgtgcgcctgtaatcccagctactcgggagcctgaggcagaagaactgcttgaacccgggaggaggaggttgcaatgagccgagatcgcgccattgcactccagcctgggctacagagcgagactcctgtctcaaaaaaaaagaaaaaaaaaaaagaaaactcaccatttgcagatttgaaggcaggaagctaagccaagcacagctagcttggctgtgcctggagcagccagagtcactccccacactgcctgtcccccagatcccccatcctaagcttcgcctccccatccagcccatctggcaaaagacagagccaaaggctgcctcctgctggcctcatttcaggctttggcttctgggacctggtgtctttgggactggatttgttccttgcagacctggacgaagagctgctgagaagtctccatgtgttgtcagagacccctcctcttcctcaactccctgtgacccctgttgtgcagacttgggggaaaacaagggcacaagaattgtcacccagcaggtggtgtggggctgctaggaggaacagggagtgtctgctactgagttcagggtttctttaattttttgttgttgttgtttgttgttgtttttttttttttgagacagggttttgctctgtcacctagtctggagtgtagtggcgctatctgagctaactgcaaactctgcctcctgggttcaagtgattctagtgcctcagcctcccaagtagctgagattacaggtgtgcaccaccatgtccagctaatttttgtatttttttcagtagagatgggttttgccatgttgaccaggctggtcttgaactcctgagctcaggtgatctgcccgcgtcggcctgccaaagtgctaggattacacccataagccactgcgctcagcttaatttttaaatttttaactttttaaattgtctttagagatgagatcctgctctgtcacctaggctggagtgcaatggcttggtaatagctcactgcagtctcaaactcctggactcaaatgatcctcccacctcagctttctgagtagctaggaccacaggtgtgcaccacctgtgagacagagtcttgctctgttgcccaggctggagtgcagtggcgtgatctccactcactgcaacctctgcctcccaggttcacgccattctcctgcctcagcctcccgagtagctgggagtacaggtgcccaccaccacgcccggctaattttttgtatttttagtagagacggggtttcaccatgttagccaggatggtctcaatctcccgacctcatgatccacccacctcggactctcaaagtgctgggattacaggtgtgagccaccgtgcccagccgcgaattctttaaattttttgtagaaacagggtctcactatgtggctcaggctggtctcaaactcccggccttaagtgatccttccctcttggcctcccaaagtgctgggattaaagacttgagccaccgtgcctggccttgagtacagaatttcttcatggggtgatgaaaatgttctaaaattggttgtggtgatggttgtacagtaaagtgtaaactttaaatgagtaaattgtgaatgatatctcagtaaagctggtttatttaaaacaacaggccaggtgctgtggctcacgcctgtaatcccagcactttggaaggctgaggcgggtgaatcacctgaggtcaagagttcgagaccagcctggccaacatggtgaaaccccatctctactaaaaatacacaaaattagctgggtgtgatggtgggcacctgtagtcccagctacttgggaggcaggagaatctcttggacctgggaggtggaggttgtagtgagccgagatcacgccactgcattccagcctgggcaacaagagcgaaactctttctcaaaaacaacaacaacaaaaaaacaggccaggtatggtggctcatatctgtaatcccagccctttgggaggccaaggcaggaggactgcctgaaaccaggagtttcagaccactctgggcaacatagcaagaccccatctttttttttttttttgagacggagtctcgctctgtcgcccaggctgaagtgcaatggtgcaatctcaactcactgcaagctctgcctcctgggttcatgccattctcctgcctcagccctcctgagtagctggaactacaggcgcccaccactacgcccggctaattttttgtatttttagtatagatggggtttcaccgtgttagccaggatggtctcgatctcctgaccttgtgatctgcccgcctcggcctcccaaagtgctgggattacaggcgtgagttaccgcgcctggccacaagaccccatctttacaaaaaactaaaaattagctgggcatggtggcatgtccctttagtcccagctactcaggaggctgagacaggaggatcgcttgagcccaggagatcgaggcagcagtgagctatgatcatgccactgcactccagtctgggcaacagaacgagaccttgtctctaaaaataaaaacaaaacaaaacaacaagaaaacaggaccatcactcacagcacctctgcctctgccctgcctacttgaatgaggtgcagggcatctcacctgctcagagcagcccttgaatgagccccagctatttctagggtcctcaaacgaaacctcccacggccaagtcatacccaacatgggcctcctcccctattctggcccctgctcggagatgctgagtgacagaggctggacttggggtgtttctggcaaagcctcactgcaggaagccccacagctcaggcccagtccttggttcacacggtcccacttccagcttcttttgcccttaagactgatttgtccctgggagatcaccagatccctcattcaggtggagtgctgcagcgtgacactttttccaggggtgacccaggcctgcagggttccagtgtcacaggcaggccttgcatgagcctccacccgagcttctgctcctcctctcccacagggaacgtgatgttctcttcccggggtacacccatttgcagagggcccagcccatccgctggagccactggattctgaggtgagccaggtgaggtgcaggggctgtgctagaggggaggaccccggctgccctgaccctcctgcccctggcttcccacagccacgccgtggcactgacccgagactctgagcggctgctggaggtgcggaagcggatcaatgtcctgcccctggggaggtgggtgaggctccagtgccccgagggcctggtgggggtggctgctgcatagccttagggattgacagagctgggaagtgcagagtgggacagaaaaccgccttatctgctcagcgggggactctgcatggagccccagctctcgctaaggtgacgaccaagccattgaatgtgtctgagcagggccagagccctccagcaaggctcctggcaagcccagcctgctgccctcagcctgacatgtgggaacatgtgtcaggagacaagtgtcctgcacccagggtgacttagtgcttggggacaagtgttttgtggacacttggggacaagtattctgtacccaaggagactgggccagggaagaggctaagcgccaggtggttgccctggcaaccaggacttggttctctgtgtgtgcgttcgtgtgtgtgtgtgtgtgtgtgtgtgtgtgtgtgtgtgtgtcagggctgcctgccaggagccctggtcaccatgaatccctgtccctgcagtggggccattgcaggcaatcccctgggtgtggaccgagagctgctccgagcaggtgagacgtcctgcccctcctccccagggagaatcaccctcagcacccgccaagacctgcagacacacctgaaaccagagggcaggggcctgtggctcctggtgaaaccttcattcattgcctatgggcactgaggtcatcaagttcaggggtcactcatggcagggatgcctggtactgagagactcagggctcctgcctccctcctgggactgtgcaaaagatccctccccccagctgttgccccaccctgatcaggggagggggctgggcaacctagttgggggagagggggccactccctgtcctccagcttagccctgcttcctcccacccccccagaactcaactttggggccatcactctcaacagcatggatgccactagtgagcgggactttgtgggtgagtcctggggagccagtcccctgccctgtgcctcactttagtccttcagcccagcttctctccagtttcctcccacacctccacggacaggctggttgtggtgatattgtacactgaagtataaaccttaaatgggtaaagtgggtggggcatggtggttcaccatgcccagcactggccaacatggtgaaaccccatctctactaagaatacaaaatttagctgggtgtgtggtggcaggtgcctgtaatcccagctactcaggagttctgaggccagagaatcacttgaacccaggaggcggaggctgcagtgagccaagatcacgccagtgcactccagcctgggcaacaagagcgaaactccatctcaaaaaataaaataaaataaaataaaaataaataggccaggcatggtggctcacgcccgtaatcctagcactttgggagtccgaggcaggtggatcacatgaggtcaggagtttaagaccagcctggccaacatggtgaaaccccatctctactaaaagcacaaaaattagctgggcatggtggtgcatgcctgtaatcccagctactcgggaggctaaggaaggagattcgctggaacctgggaggtagaggttgcagtgagccaagattgtgccactgtactccagcctgtgcattgggagcgagactccatctcaataaataaataaataaataaatggataaattgtatgtgagtgataactcagtaaagctggtttatttaaaacaacaacaataacaaaaaacacgctaggtgcaatggcttacgtttgtaatcctagcactttgggaggccaaagcagaaggattgcttgagcccacaagtttcagaacagcttgggcgacatagcacgaccccatctttgcgaaaaatgaaaatttagccgggtccccccaccgcctaacctcctcctgccccctgtatggtcaggctgggtggggatgggagaggcctggtgactgggaaccttttctcccagccgagttcctgttctgggcttcgctgtgcatgacccatctcagcaggatggccgaggacctcatcctctactgcaccaaggaattcagcttcgtgcagctctcagatgcctacaggtaagccctgaactgccacctccatctgccgctgccggcctctgtatcccccgccgcccgcggacgtggctgccttcctccccgtcccacccctccgccagacctggccattgcggcgctggaccagccaagggtccagccccttcagcgccagcacctctgtccccagcacgggaagcagcctgatgccccagaagaaaaaccccgacagtttggagctgatccggagcaaggctgggcgtgtgtttgggcgggtgagcaaggcagggggaggggcggggcctctgggctgatggtgggtggccaggggggcaggatcccgggtccagcccctgtgcctccctcttcccgcagtgtgccgggctcctgatgaccctcaagggacttcccagcacctacaacaaagacttacaggtgcgaggccgggggaggcctggctagtacgtgccagttctcagggctctggcacactcaggcagggccccaccccgggattgccatacatcctcccatcctgtgcacacagctccatccgtggctgcccttgaactctctgcccttcctttgttggggtattgagtgttcttcccatggaaggcagtggggatgcctcagtgggggggtggggctgtggggaccctgggtgccagggggctgctaggccctcacctcctgccatgtgcctcccaggaggacaaggaagctgtgtttgaagtgtcagacactatgagtgccgtgctccaggtggccactggcgtcatctctacgctgcaggcaagacatcacccccctgcttctcctcccctaggtcccaggcactggggtgggcatgcggggagggtggccttgggaggaggtgaggtggggctggaggacctggggcagggaaggagaggtgtgctcgctcctgctcctggggaacagggaaaggacagaaactgctgccatgcagtggaagtagatgagactcagggggcctggggcctgtcaaatggcctgaccagaactctttaaaaaaagaaaatctaaacaaaaggccaggtgcagtggctcatgcctggaatctcacactttgggaggccgaggcagatggagcacttgaggtcaggggtttgagaccagcctggccaacatggcgtaaccacgtctctactaaaaatacaaaaattagccaggcgtgatggcccacacctgtaatcccagctactcaggaggcggaggcagaagaatagcttgaacccaggagatggaagttgtagtgagccaagatcatgccgctgcactccagcctggaccacagagtaaaactccatctacaaatatataaattaaattaaattaaattaaatatctttaaaaaacattttttagagacagggtcactctctgtcgcccaggctggagtgcagtggtgcggtcgtagctcactgcagcctcaaactcttgggctcaagtgatcttcccacctcagtctccagagtagctgggactacaaacatgcgccaccacgcctggctaatttttttattttttgtagagacagggtctccctatgtttcccaggctggtctcaaattcctggccccaagccatcctcccaccttggtctcccaaggtgctgggattataggcatgagccactttgcctggctgatttcttttaaaatcaattattatgggaaatttatgtatataacagctagagaatgcataatgaaccctatgtaccgacacccagcttcaatgataatcaactcacggacatcctggctccagctgtctttacccacagctctctcccactcccttacccccttattttgaagcaaattcccatcatcacatcatttcattcctaaatagttcaggatatgtcttgaaatcagtgtttcttggctgggtgcagagcctcatgcctgtaatcccatcaatttgcgagactaaggtgggcagatcactcgaggtcaggagttcgagaccagcctggccaacatggcgaaaccccgtctttactaaaaatataaaaattagctgggtgtggtggtacacgcctgtaatcccagctactcaggaggctgaggcaggagaattgcttgaacccgggagatggagactgcagtgagcagagatcacgccactgcgctccagcctgtgtgacagtgcaagactccatctcaaaaaaaaaaaaaaaaaaaaaaggcagtgtttctggaggctagtcccccaactagcagcaccagcatcacctcagaagtcctgagaaatgtgatgtgaggccccactccagatggctgaatcagagactctgggggtgctccccagcaatttgtatttttcttagtaaattctccagtggctaggcctggtggctcatgcttgtaatcccagcactttgagaagctgaggcaggagaagcgcttgagcccaggagttcaaaaccagcctgagcaacatagcgagaccttgtctgtaaaattaaaaaaattaaattagccagtcgtgatggcgtgtacctgtggtcccagccacttaggagactgatgtgggaggatcccttgagcccaggagctcaaggatgcagagagccaggattgtgccattgcactccaacatgggcgaccctgtctcaaaaaagcccaaaacaacaacaacaaattagctaggcacggtggtgtgcatggctgtagtcccagctacttgggaggctgaggctggaagatcccttgagtccaggctgcagagggctataatggccactgcactccagcctggacaacagagcaagaccctgtctcctaaaacagaaaacaaatcctccaggaacatctgatgcatgctgaagataaggactctttgaaaacataaaggccagtaaaacatacaggccagtaagtgttcatagcacatgtaaatattatcgataattatgagaagatggttcaagttgagagtgagacagagccgagtgggtaagagagtatctgcccaaggcagggatgtcctggcagaggggcaggtcctgggcctggcagcttcagatcccagggtccccagggctcaccactcgcccacctgtgcccccagattcaccaagagaacatgggacaggctctcagccccgacatgctggccactgaccttgcctattacctggtccgcaaaggggtaagtgtgtagcagccagggggagggtgaggagatggggtgccccccccagagggtgggggagctcaggaatgggtgcaagcggcccagcctggtggctcacccctgtaatcccagcactttgggaagccgaggtgggcgggtcacttgaggccaggagttcgagaccagcctggtcaacatggtgaaaccccgtctcttttgatgtaaaaatacaacaattagctgggtgtggtggcacactcctgtaatcccagttactcgggaggctgaggcaggagaattgattgaactgggaggtggagtttgcggtgaggtgagatcgcgccactgcactccagcctgggcaacagagcgagactttgtgtcaaaaagaaaaaaaaaaaaaaaaggaagggggtgcaggcaatggaggcagatcagggcatggagaaacctgcctcagcgccatcttcctccctggcacccagatgccattccgccaggcccacgaggcctccgggaaagctgtgttcatggccgagaccaagggggtcgccctcaaccagctgtcactgcaggagctgcagaccatcaggtacggcccatccccttccccatgctgcctcctaggaagtgagcctgggtgcctggagcccagggtggcctggcgccctggcccacctcttcctctctccccagccccctgttctcgggcgacgtgatctgcgtgtgggactacgggcacagtgtggagcagtatggtgccctgggcggcactgcgcgctccagcgtcgactggcagatccgccaggtgcgggcgctactgcaggcacagcaggcctaggtcctcccacacctgccccctaataaagtgggcgcgagagg

SEQ ID NO: 36632 - DNA, 895651 bp, Homo sapiens; identical to SEQ ID NO: 36080

SEQ ID NO: 36633 - DNA, 9768 bp, Homo sapiens
gggcggcgggtgccggtgcgcacggagccgagccggggctcccgttgcgctgcaccgcgttgggtcggagtcccaggacttcagcggagatccgcgcgctgcgacggccggtgcagagcccgccgagcgcccagtcccggcccggggctgagttgggggcatgctctagccgcccccccggagcccgggagagaacccaggagcgccgccgcccagccccagcgccccgagcggaaccgctgcgaaggggccctgaacggccgtcgccctccctacgggcagcccccgggggttggcgaccgaagtctaggttttcgagaagtgagtgtcccccaccccatgaggtttggggggccaggaaggaggagctgaggtgggggagggtgccaggttctaggagcggggtggcatcgggacagcacctccagtcttggggttgtcccaagtggccgggattagtggagcagcgatgcgttccattctgaaaggggcagggatgacgatcggggctccattctgagtcggggctggcttgggggataggccctattctgggaggggttgttttggaggctttctgtctgagagaagggagggacatgtccaggatgggagggggctgcacccctattttagggtctgggcaaggataggagggaaaagacctgggcactccacgcagcctcccggctctcctgaggaactgatgggctttctctgtctctttcttgctgatctttctgcctgacttcgttttcaaaagagccagggtgggaaccctaactggactcttcgggacccccaggaaggatctgaggcctgagccatcctcctttctaccctgtctgccccccaggactgggcagttgcaggaggccctgggggggggcccaggactgtggttgtgccccccccccaaaggccggacaggatgggaccaagttagtctgtccagtctcacccagcacctcccaggcccagagagaacccccggggctctgaaagcttgccctgccgcctgaccgccatggagacgaagctgccccctgcaagcacccccactagcccctcctcccccgggctgtcgcctgtgcccccacccgacaaggtggacggcttctcccgccgttccctccgcagagcccggccccgccgctcccacagctcctctcagttccgctatcagagcaaccagcaagagctcacaccgctgcccctgctcaaaggtgagctggctgctggccactgggggaaccgaacccccgaggggaccagcagggccatggggaggggtgggaggcagcgggcagctgccaagagagagagtttggatacccctccaggctaggttctccgccatcagaactgaccccagccctccagccctctctgctgacacatggcctgactggcctgtcatccttagaggtgggacatccgaaggtggtgccaccctaggggcagaccaaggccaagggtggggcccatagcctgggttccagggggccactatcagcccagccagctgccagatccctggagcaggcgcttggcagggttccctgggatcaccacataggtcccttccccagccttgggccatagggccagactggccaagcctgaggacaccgtagagatccttggccctgaacccctccccatttctggcccttagaacagggtgccacctgagagggaggcagcagctgtttggggcacctgtggaaagctgctgcatccaggatttgtgatcttgctttaaaactcaggccatcatactctctgagcctggattaggaggaagaaaagcaaccctcaacccccaggaatggaggaagggacagtagttgtttgctgtctgcaaggagcaggagatggcacaagagcatggggcctgggggcagcagaggcagccgtggagattaggagggtctgccccacccacagctggggcagctgggggagctggggcccaggcccaggatgccctctcctccccagatgtgccggcttccgagctgcacgagctgctgagccggaagctggcccagtgtggggtgatgtttgacttcttggactgtgtggccgacctcaaggggaaggaggtgaagcgggcagccctcaacgagctggtggagtgtgtggggagcacccggggtgtcctcatcgagcccgtctacccagacatcatccgcatggtgagcacctgccacccaggctccgagggccggccgagagggcgtgtgagccccgtttcctgtccgcaggacccctgcgtggagaataaccctgtactcatcggcttggcctcagtccacgtcttccttccccccgacctgctgctgcccaacacccactgaatgcctccgggcctgccccacgtccacacctttgcttatgcttgcctgagacctggagtgccctgccccacaccccataccatccatggcctggctcaggtgccgcctctgccaagaagccgctgtcaataaccaagctggaaatctcccttttcctgcccgtagacctcacagcttctagccttgttctccccactggattgcacctgcctagaaggcagggatgtgtcccattcacccctgggttcccagcccctggcccagggcttgcacgaactaggcgttcaggtgatgattgcccaaggaatgaactgcttgctggggcagatgctgaaatcaacccattagaactttgaatgagggccgggagcagcagctctcatctgtaatcccagcactttgggccaaggcgagaggatcacttgaggcaaggggttcaagaccagcctgacagtgagaccgcatcactacaaaaatttaaaaatttgccgggcatagtggtgtgctactgtagtccagctactcagaaggctgaggtgggaggatcgcttgagcctgcctgggaggttgaggttgcagtgagtcgagattgtaccactgcgctccagcttgggcaacagagcgagaccctgtcttgggaaagaaaaaaaaaaaaaaagctttgaatgagagactccctggcttctgtcttcaagggcttttccttaatgaaccccaactctgccactcagatctcagtgaatatcttccggactctgccgcccagtgagaaccctgaatttgaccctgaagaggatgagcccaatcttgagccttcgtggccacacctgcaggtctgaagggttggggaagacagagatccaagtttcagaagagatccaaggcatggggagagggcctccttagcccctagacagttggatgagggccatagggtggaatgagtgggtgaggctgttactgaactcacctttttgtctgtccccctcccccagctggtatatgagtttttcctgcgtttcttggagagcccagacttccagccctccgtggccaagagatatgtggatcaaaagtttgtcctgatggtgaagtggggagcccaggctgggtggtaccacaaggcaggggcaggctctctgaggggccagggataggatggaagcaacctggggtggacctttcccctgaccctgaccctgaccctgactctggttcccacagctcctggagctatttgatagtgaggatccccgggagcgtgagtacctcaagaccatcctgcaccgggtctatggcaagttcctgggtctccgggcctacatccgcaaacagtgcaaccacatcttcctccggtgagtggctgctgcctgcccagcagagacctggggagggtgagagggctgttagaagactgcggcaaaggccatgtgcggtggctcacacctgtaatcccagcactttgggaggccgaggtgggtggatcacctaaggtgaggagtttgagaccaacctggccaacatggtgaaaccccgtctctaataaaaatacaaacattagccaggcatggtggtgggcacctgtaattccagctacttgggacgctgagacaagaattacttgaacccaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagactgcgccactgcagtccgcagtccggcctgggcgacagagcgagacggatgaacccaggaggtggagtttacagtgagccgagatcatgccactgcactccagcctgggcaacggggagactgtgtctcaaaaaaaaaaagaaaagaaaacaaaaaaaaagaagactgcagcaaaggctcctgggctgcaggggcccttgtagaacttctgttttccaagccctttctcagtaacgtattacatattgattatacaaagcctgtgaagttgacagagaatgggtatttatttccattttacagatgagaaagtagaggccaagagagatgaaatggtttgcagggactgggtcagtccaggggcctaggagctaaatcatttgacccttatcatgccaggccataaggacccagagagagattctttctgcaaacatgcactgagcaccagcacccactgggcatcaaggctcacgtggccttgtagttgagaccatggctctgaagctgtatggcctacatttgagtttggttccaacgtttgggtgaactttggcaaattacttaagctctctcctagtttgctcgtctttaaaatgggaatgctggctgggtgcagtggctcatgcctgtaatcccagcactttgggagttggaggtgggcagatcacttgagatcaggagttcaagatcagcctggccaacgtggtgaaactccgtctctactaaaaatacaaaaattagctgagtgtggtggtaaacacctgcaatcccagctactcaggaggctgaggcaggagaatcgcttgagcctgggaggtggaggttgcagtgagccaagattgcgccactgcactcctgcctgggcgacagagcgagattccatctcaaagataagataaaaatggggatgctgcttgtactaactcagggaccattatcgaggtgacatggggccttgcctgcaaagcactcagcatagctcctggactgaggccgggactctgaaacattagttgttattagctacaaaatgggtgagccatgatccctgtcctcctgcaccttggagttcattagattccctgcctattaacattggggttgttttatttaaccgctgagtcttgatttcttcatccatgtgatggatttcttaagccccatctccctggataattctgagacttacatggtacggagtagatgtgctaagtgtttgtcattctcttggttgactggcaagagagccttgagcttgggactcagtggcagaggtggctgggctgagaagggcatttcagtgtgggggggcggggatctcaatggggcctggtttgggatgttgggaagggagcgcagcctctgggttgggggagagttggatgagcgtgccgtgcaggtgagggtgggcaggcaggatgcctaagggggcactgggcctaccctgcttgctttgagcccacctgcgttcttctcttgcaggttcatctatgaattcgagcacttcaatggtgtggctgagctgctggagatcctaggaaggtgattctccctgggcctcagctggagctcaggattctggaaggagggactggggccaggtcacctgagccctcttcctctcttctgcctcctcctcagcatcatcaatggctttgcgctgcccctgaagacggagcacaagcagttcctggttcgcgtcctgatccccctgcactctgtcaagtcgctgtctgtcttccatgcccaggtgaggcccaggcctgtccctgctgcagcaggagctccagacagtcagggcagccagtgggtcctggaggtcagatcctccagggatcctatctcaccttctttgtctttataattctgttccatctaccttagaaaattcccactggcgctttaaggctaacctcagatatcagctctgtgaagccaggcttttcttctctaccctcccttggcagaattacattcttctccatctatattcccaaatatttggatacacaaatctattatgggagattttgatacacaatttttttttttgagacaaaaccgtactctgttgcctcagctggagagcagtggtatgaacatggctcactgaagcctctacctgctgggctcaagcagtcctcccttctcagcctcccgagtagctgggaccacagatgtatgtgccacatgcctggctaattaaaaaaaattttttttttgtagagacagtgtcttgctatgttacctaggctggtctcaaactcccaggctcaagtgattctgctgcctcggcctcccaaagtgcttggattacaggcgtgagccaccacactagccatattatggaaccttttgcaaaatttataaagatgagtttgttgactgtccccactccccgcgagatcagagttgtattcccagcacactgaatgtgatgcctggtacatcctaggcaggtgataaatgcttggtgaataagaaagtaacaggccgtgggtgagcagtatttggcattctgtcctggacagcaagtccttggcgcctggtgccttcctgacctgtcttccttccctccacctgtcaccccctgcagctggcatactgtgtggtgcagttcctggagaaggatgccactctgacagagcacgtgagtacctctgggggctaaggcagcctctcacctctgcaggcgtgactcctgtctcatctcccacaggtgatccgggggctgctcaaatactggccaaaaacctgcacccagaaggaggtatgaagaagggctttgatgcccgccagagggaggctgggagggctcggcctctagaaggcagtcaggtgtgtgtatgtgtagggggagatgtgagctgctgcccctctgtccctactcccctccccaacccacccaggtgatgtttctgggggagatggaagagattcttgatgtcatcgagccctcccagtttgtgaagatccaggagcccctttttaagcaggtggctcgctgtgtttccagcccccatttccaggtatgaggcaggacaggcggggatgggagcagggctggcctggaaaggttgggtagctgacctaataaagctccctttgccctcagtttctcctccaatcccgggtctggtaatggggagatgctggacttagggtcaggagacctagggtgaagcctcggacctgccttccactggctgaggggccttgagcaaatcactgcaccactctgattctgattaagcttccgcagctgtaaaatgggccaacaacctcttcacagggtggggataaggatggaagagattgtgagtgtaaacatgtttggtaaactgaagtgtgatccagaatgtgatggaggactgttatcacttttccccttttgctagtggccttagatttcattagactcgctttgggatgcagccaggcttccccgcaccaacccagctaactaactcatgttctgctgcaagcatgtgcagacttcctcccgttcttatgggccataacccagtggaagtcaagtcttcctcacagtgattctggcacttcggttcattaaacacctaaaagtctagtatctcatttgattcttataacatcctgttgagataggtattattagcccattttacagatgagaaaactgaggctgggaggttaaatgcctctcccaaggtcacatggcatagtagagtctgtagtggttaggattcaccccgcagcattggattccgtatctagaactcttttcccttcaacactgttgcttcctccagggctcagataagccctgaaggtggggtgtgtgaaggtcagggggcctgggcgttgaggtagtgatggacaccagaccttgcacacagagagaagccactgccagttaatcactctgccatcttgtctgccccaggttgcagagcgggctctgtatttctggaacaatgagtatatcctaagcctcattgaggacaactgccacactgtgctgcctgctgtgtttgggaccctctaccaagtctccaaggagcactggaaccagtgagtgccaggccatgacctaactcacagaaactgggaccagggccagccagtccagacccgaccccagggttactcctagctggagaatatcagagaaagcatcaaaagatggcccaggggtggtgaaaaggacaggaaagtgggcagtgcttgtgttcaggtggaatgctgtatgtgaagggcagggaaagggagaggtgggcaaaccaaagctgtttcatctcctcatccctccttgacactgccaagaaccatcgtatcactgatctacaatgtgctcaagaccttcatggagatgaatgggaagctgtttgatgagctcacagcctcctacaagctggaaaagcagcagtgagtgttgggggctgggcgtgggggaagggagaagagcagggaggagtcagacccccatggctggagggaacccgaggactaccccaaactctgtctgatcagatgctgcaagactgtccatgctcctgccatcctatgcctgactgtctgcccctgtatcctcccgtcattcttcgagtagctcagacttgttctgactccctgtagcttcctacagaagccagaaccactcaggccccacccgtcatcttctctgtgactgcaggctgggatctgtctgtcctctgctctcttccctcagtagagggtttttatggagtcacagaacaaaaatggttccatgccttccctttgccggtggggtggtagtgagggagtctggactgtgagggagtctggactgtggggggccccaggaaagggagctgcctcaccctctctccccagggagcagcagaaggcccaggagcgtcaggagttatggcaaggtctggaggagctgcggctacgccggctacaggggacccagggggccaaggaggcccccctccagcggcttacaccccaggtggccgccagtgggggtcagagctagacagcacctcagaaggggaaaagctaaacccagagctgtcagtccctctatcccttctcctgtccaggggcccagagagaaacacacctacccctggccttgccagagtggcttctgaggactccctgcccagcccagctttcactggggggagacgaggagaggcaatggtggtcttggcaacagaatgctcagcccctcgtggcaggacttgacaagggcaagcttgaccaggaagctgccatcagggatcttcccctgccccgcaaagctaggctccagctgcaggcgggctcccaccctctgctcctggccttgggcaagggcactcagcgcctcgcctgcccctgccttggccaatgcgaggtccttccttatccccaccatggggtccatggtctatttattctcgcccagctcaccctctacacagacactgtcctgggtgcacactcctcccttccctcgctgtgtacttccttgtcccctttttatttattgggcagggggagggggagggcacaggcaagaagagattcacagtgtcctggggtaagggggggttcacagtaatcatggtctactcctctttccgtggctgggggtagacttaataaagagagaaattcaa

SEQ ID NO: 36634 - DNA, 127539 bp, Homo sapiens
tgctcgtcctgcacccctggtcctcccgctgctcccctggtcctctccctcctcacccctatcctccccctgctccccccaggtgagctgtggggcttctgttccaggccaattctttcagtgatgctccctgggctgtcccaggttccttcctgtggaccttgtaagttctttgaagctgccaggtgccaggctcccagacaacaggacccagtgcatcatgctaatatacaatacatagtgcctgctatttacaatgtaatcttaatgtatggcacacagcacctactacataatgcatagtgcttcccatatgaccttggcatacaatcttcacaaaacagactgagcacctcctacatattccatagtgcttcctatatgaccttagcatccaatcttcacaaaagagactggagaggaaaatcagttgcggtcctaacactgcctctttctcactgtgcctgccttggtcaaggcacctgaccttcctgggctacagtttgcccttctgaaaatggcatgtgtactggaggacttatctctcacagacctaaagttctatagctctctacagccactcaggaaaacagcagagaggttcctcaaaaaaacacaaatagaactaccatgggactcagcaacccattgctgggtaaagacccaggtgacaggaaatccatgggttgaggagacatcggcacccccacacttatcgcagcactgttcataatcaccaaggtatggaatcgcccttggtgcccaacaacggagaatgaataaagaaaatgtggtgtagatacacaatggaataccattctcccatgaaaaaaatgatatcccagcatctgtgacaatatggatgagcttggacatcatgttaagcgaaataagccaggtacagagaaacaggtactgagcgatctcatatggagctcttgtatggatttcttgtatgtgaaatccaaaaataacacaaaattttaagttgatctcctaggagcagagagtaaacagtggttatggaagcttgggaggggaggatgaggacaggggatgaggagagattgttctactgcacaataggctgactttggttaacaataaaatagcatatatgacaagatagcgagatgagaggcttctgagtgttctcaccacaaagaaatgatacacgcatggggcgatgcatgatgacacatgcatgatacacagtgatacatgcacaatgatgcataatgatacatgatgatggtacatgcatgatacatgcatgaggtgatacataatacatgcatgaggtgatgatacatgcacaatgatgcctaatgatgcatgatgatggtacatgcacaatacatgcatggtgatacatgataatacacgcatgaggtgacacattataatatatgcatgaggtgattaatgatacagacatgatgatgcacaatgatgcatgatgatggtacatgcacaatacatgcatggtgatacatgataaaacacgcatgaggtgacacattataatatatgcatgaggtgattaatgatacaggcatgatgatgcacaatgatgcatgatgatggcacatgcacaatacatgcatggtgatacatgataatacacgcatgaggtgatacattataatatatgcatgaggtgatacataatgatacaggcatgatgatgcacaatgatgcatgatgatggtacatgcatgatacatgatgatgcacgatgatacacataatgatccacccttgaggaaatgggcacacacactaccctgattggatcattacacaacacagatatgcatggaaacaacaaatcgtaccccataaacatgtacagtgtgtccattaaaagttaaatacatcaactttttaagtcttctgcagcctagctctgtctcatttgtcttttaagcttttcatgcacctggtactcttattctgtcattcatggcacccaatgcagtgctctgtgcatagatggtttaccacatgtagtaagagtaaatgaaaataaatttcatgctttcttgctacttaccttacactaaaaagtatcaggtacttgactgtgtactcggcacttgccactcacttttcattactgtttttaatcctcacaactttaaggaatgggtatttttggcctcacacaataaatgaggaaacagcattaaagagcttaagcaacttgcccgatacatcaaagctacacggttggagctcttaatctccacccagatggctttcagctgctctccagaaaactgagaatgtggggagacaggcgggtttctctaacacgaagctcttctgtttatctggtgagaatctatggttctcccacaagggctctgacaaagtttcttggacccaaaagatactgactgcatttcccagttcctgggaatctaagatctagaagtcatagaaagagatgattttggggcctctggtcaacatcaaggcacctgctgaggtgtgaaatgtgagcactgtgccctgacatggtgggtacatgtggagcacacccacttctgacagccgactggggccacaagtgggaccaagaaaatgtgcgcctatctcaactttggtcctgtgtgtggaacacacacacacacacacagaacttgtgtataaagaacgcatcgtcttcacaagatggtcatcttggagaggcagagctgagaaagactccactcctcggaagcgtggctggtgaaagtccgccctcatgagcacagtccctgatatcgcctagcggaggtccgcgctcacgagcacagtccctgataacgcctagcggaggtcggcgctcacgagcacagtccctgataacgcctagcggaggtcagcgctcacgagcacagtcactgataatgcctagcggaggtcttagaagggccacgcgtgtgtcattatcacatactcactgtaagagtttgcggatacttccccaacggcttcatttatccaactgtggaaagagcttgcaagccaggtcatgattgagaacccgcgtggacccagcagccagaccgcacacccacgtgatgtgccctggaaagtgcctgccgtgggtccagagggcaagaggtgaggaagtgccacctgtccagtgaaaccaaccccacctgtagtgagagcagcaccagcacttgctggggcacgttccctgggatggcgcagccacacctgcggggctggagcctacctttgctgctggacgctgctcagcacccagccctcctgctttccttgggaggcttccaggcccttggatgacttgatgggaccatttcttgccacaggagccagagggtccagacggcccctccccaatgacacagtgagaagggaggtggcatgtgaatgaaccctgacctctgagatgctcactcctgaaactgtgactcttgagataaggacacaaggaaatgccctgctaactgcttctgcccagccgtctccagcatagcagcccagctcgtcacctcggaaagtgccttagctctctgctgtcagcccacattgctgcagctcccaggccctgatatcctaacagcacgttccctttggtaattggccagcagcttctgctgtttgcatctagaaaccccaaatgacaaaacggctcacagcctgttcaagacagagggcaacgccacacctctaggaagccacccctccaggcggaaggttttccatgcagagctgtgttatatgtgcagtcttctccctgtaacagaatagactttgaaagtaagaaccagtgtgaatggaatcgatgctggacagcacagtcgcagactgtggaccccacaaatcctcacatgtggcatgagacaaacagcagtccccaaaactgtggggaagctttcctttcagaaaaactggaacaagcaaaatcactctggaacaaaatgtcactggcacaaagtacacccagagtccgtgcaggacagcctcctctgtccacacacattctctctttatgttagtatcaaaactgctagaaaaatgaatatgggctcattcaaagccattagctcccatacaacacagatgtctccatagcgagactggtgtgtccatgttgaatttccccatgtgtgactccatcaccgttcatcaaagcaatgtgtcacggtccccgtgcccttaagaaagcatgtcccttctgtaatgtgtgtttctatttcacctctcccgtctgctcagggactgaactgccgtgagaaatgagaatgctactcctgctgcacctgcaagcacatattatcccgcagaacccaaaactctccaggaaacacaaaacaaaacaagactcccaactctttccctccagccacctccacccccagaattcactgcagccaacacaatgccaggcttcaaaatggggctgtgggatgtttgtctaattgtctccgaaatactcgcatagaagcaaggctcccgcagtggctcacgcctgtaatcccagcactttgggaggccaaggcgggtggatcacgaggtcaagagatcgagaccatcctggccaacatggtgaaaccccatctctactaaaaatgcaaaaatcagccaggcatggtggcgggcgcctgtagtcccagctactcgggaggctgaggcaggagaatcacttgaatccaggaggtggaggttgcagtgagccaagatcacaccactgcactccagcctggtgacagagtgagactccgtcaaaaaaaaaaaaaaaagaaccaaggctctagcattttctaattttaggaaccatgaaccatcaggtgccgccaaagttgaggaggcgtttttctaaatgcaaatcttcacagtttcttctgccagaggcacagagagggctcactggattttctgttctacctcaaagccattgcacgttttttcttatttcttgttatttaatttttttttaaacaagccaaccaactaaaataacaaattgattttcattcaggcagctcccagaacataactggctggaccccagtaacgtcgcacactgtggaacatcagggccctcatctttaaagatgtggcttgaggtttgcaggccttatcgctcattagctatccagccagatgcaactgctctggaagcaagtagcccagatagacaggaccttctggaaatgagccttcagaggctgaaaagcgtcttggaagagcagcccactctccacccagctggcagctaagtggctggtagtgttgatttcattgtctgcctcagcttgggttctctcggaaagtctctgagccaaagatttgagtgcaggtaatttattaggcacttgctcccaggcaaaaacggtcaggggtgggaggatgaaagggaagaaaccaaaagttgcagaagcattgtcctcgcagctaacatggccgcgtgcaaacgtgccagccagcaagatgttggcatcgccctctcagctaacatggctacctgtggaagtgccagccagcaggatgtcggcatggccctcgcagctaacatggacacgtgcgaacgtgccagccagcaggatgtcagcatcctccttggagctgacatggccacgtgcgaacgtgccagccagcagtagtcggcatggtgctgagcaccctccgggaaccgtccctacctgaaatatgggtgtgatgtacggagcacacgcagccaccctgcagcatgagatgactgttgagtacaggacacgcagaacgaagctggaaaatgaaaaaaaaaaatcctggcttgctgacttcctggggcaaatactgagtgttgggagatcatttccagacttaaatatgagagagaagtaaaccccccttttatttcaaagcttagcatgcctataagtcacctgcagatcttgtcaaaatgcaagctctgaccagagagcccgggcttgtgacttacatcatctcctgctgaaatgctgacgacactccaaatggcaagggttttggcctctattatttggggttttctatcattcaccattgaaactaatcctcactaattaaaacagtttcacattggggaggaaaatagtttttgtctactttaaactactatgacttagggtctgtcaaaacctcaaaaactatatatatatatatttcatttcactcgctttcatttgggacacaaatggagacctgaatcacaggtatctttggaaactgttctcagccttcctagctcagctgaaatgtccttttccagggacactgggcccagggggtgtgctggggtctgcgctggctccccgggcattcataccttggaaagctgcagagctgacttcaggttgtgccaattcctgtgctgcctcatccctcatgtacataaagcgtgaggcgcgcaggcctgcacctgcgccatccctcatccacctaaagcgcgtggcgcgcaggcctgcgccggcgccatccctcatctacgcaaagcgtgcgacgctcaggcctgtgcctgcgtcatccctcatctacgcaaagcgtgcgacgctcaggcctgcgccggcgccatccctcatctacgcaaagcgtgcgacgctcaggcctgtgcctgcgtcatccctcatctgcctaaagccctgcgcgcaggcctgtgcttgcgccatccctcatctgcataaagcgtagggcgcgcaggccagtgtgttggaaaacaacgctttgatgttgtctcctggattttcacagcctccctctcacaggagaacaggggtggaccccggcctcgagcacatctgagctctctctctcctgcctgtgctcctgttgaagacattcagcctccgactgccctcgggaggatggagatgcccaggtgccgaggccagagcccatgcgcaaagcgagggctgagaccacggaggccccttgtctcctccagcgggttcctgaagccacgtccctgcttgtggaggaagaaagccgaactgcagctcagggagaggtgggcttgctggcctcgctggcggcatccgaatgcctggagcctcatggtgggttctgctattgctgccagcagctggatgtttcgaaattcgcccgctttggaatgatacagtgagaccttggcggccgcgctgcctgagacgatgctcttacgtctgcaggggaggtttcaaggcctgctggagtcagcggctgccttgccgccctgggaggtgagcagcccgtccctatgctggcttcctacaggatgcaacctgcattttcaccccagacagacgcagtcttggccatctgcttgccagcatagaaaatgcgttgtttcccccaagtttattttggttaatggattgaattggtttttttaaactgcattgctttgaaacatcactggagtttttcagttttcatattactacatttttgatgtattatcattgaaatgctattttaatgacggtcaaagcggctcccaagccctccttcactggtgaagcaccaaggtgctcaagtgagctcccagtgtacatgagggtgctctcgcttttgaaaaaaagtgaaggaggctgggcgcggtggctcacacctgtaatcacagcactttaggaggctgaggcaggcggatcacgaggtccggagctccagaccagcctggccagcatggtgaaaccccatctctattaaaaatacaaaaattagccgggcatggtggcatgcacctgtgatcccagctactcaggaggctgaggtaggagaatcgcttgaccccaggaggtggaggttgcaatgagcggagattgtgtcattgcactccagcctgggcaatagagtgagactccaagaaagaaaagaagagaggggaggagaggaaggaaggaaaaggaaaggaaggggaggaaaagagagaaagggagggagggagggagggagggagataaggaaggaaggaaagaaaggaaaaaaaacgtgaaggaaatggaaccctgtggctgtgcaggtcacgtggcattgagcgggccactctctgttgccctggtgcggccctcacgccgcgccagccaaaggcgaccctgctttcgatgactgttggaggaaacgttagccacgtccctcatagattggaaatctgacatttggaaaactgaactcaatcatcttttttttcccttttttacttttcaattccttcttcctcggttctccactctcaaaattttgcagtcatcattgattctttctctccagagttcagttcgaggccaggttctgcagaatcctgaggtggcatcacgagcatctcctcagtcccttggccgtgacagctcctcctccaccctccatcctggatgagccggtgaagatggttcttcctcagaaataactgcaacgcactggtccccctctcaaaagcctaggaagctcccctatgcttcaaaacccaagagctctgcctggttttctccaagtctccccccacccccaaatggccatttcctctccccatgattgcctgcacatgtttcagtgaaaaaattatgattggtccctatacaggggctgtggcaggtgaaaaagaaggagtcagctgtcaacctgcaagtcaacagcggcctctccatacaggggatcttccattcctgcctttgagcttggtaagtcgttcacttcccacacagaccccagcacctctgctcgccaccccctacatgccccctgaccctgatcacacccaccagcctctgccacatttagagttagatgtctctccctgtctctatctctatttcttactgtccctgtctctctctgtgtctctccctgtctgtctcctgcctctctgtctctccccacctctctctgtccctgtctctctctgtatctccctgtctctctgtccttccctacctgcctctccctgtccatctctctctctgtatcttattatctcactctgtctctctgtctttcctgtcgtctctgtctctccctatctctgtctctccctgcctgtctctgtctctctccctgtctgtttctctcaggtgcacacatgctgcacacacacacacgggatcactcgggagctgttcgcctccgtggtgagcgtgtcgtgatgcaaaaccctctctcgagtgtgttttgctggtagtgactgtcagggtgcttttggggtgtgtgctgattgctgtggtcactcgagggcggtgatgggatgggaccctcggccggctccagcacccacgcggcctcttccacccaaggccgcccccacaacagggctgtgaagacgtggctgcaccccccagtgcccctgaccttgagagcaaagtgagaagagaaagaaaaagaggagcgagaagatgacctcctaggacccctgccccagggaagccctgttcctcagatgcgcatcacagaccccaggggccttttcctctagaaggtgtccacacaaacagccatggggccctctaaaggtggctcccttcgcacaggagaacactcaaccacacggacccactgaggacacacgtgtgcagcgtgagcattgccatcagtgctgcgtgacagtcacctcttctccagaccctgcttggagtccctgacccgtctcaccatcacgtgatctcaagtttattgaaggaaatcagatgcagcagcaaacatgcttctcaggctcagaaacaaaaccctcgccactgagctgatgagtgtctctgtgcttctgaacagtgtggacaaggttaatgaatgaggcccaggcaggcctgtgggctccttcaatcggggcatcgaaagcctgggaagttttaacagaggctgttgatgggcatgtttcaaagcaaacagcatcagggccctgacaggccaatgacagcaccgtgcagtgccggggggggcccgggaggcacagccacagagcccagccctggggacacgggacctgggtgggggggcagagccacagagcccagccctggggacacgggaccgaggggccacagccacagagcctagcctgcactggggatacagggcccagggtgcacagccacagaacccagcctgccctgggacatggggcggagcctgagggtggctggggtcaggcagccctgtcctcgtccccaacactccacatccccagggtagctggagacccaagctgatgactcggacgcaggacaggaaaggacataagtgactgacaagctccaggcctgtcctgacaggatcagaggggaggcaggaagggccctccatggcaggcaggtggggcgcctctgcagaaaccatagcaggttacagagaagaatcgaaaagaggccatgcggctgggggcagaggggagggcccccatgagatgaggaggcactcatcgcgggagagccaatggagagagatgaagatgcggacgctgctctggccataaaaccaggtacgcatctcaggggtctcaagatgctttctttattgtagattttaaatctccaggtgaagggttgtccatggatcttcccctgggcaccttctaacgcaacagaccgcttgtctggttcccaaatgtcacactgcgtggggatgagatggaatcccacacagtgcctcaggaagaactagaaactgcgaaactcccaaacaacccgataaccacgcagctgctgcagcaaagtatgaacacagccaggtgaaaggcccacttcctccggctccccagcctgcactgacacccactccaaagacagctcaggccttcctagaaaaggcaggtcctgacctaggctaacacttgtaggtaaattcttggatatgaactacacgcccttcaacactgatatttctataaagagaaggtcaaataaaaatataagcaatcttgcaaaatttctcaacatttggggagatctcttatctccccttaaatattgcaaatttttttgcaacagagaccatattttatcactctgatgtttatgacaaattggtaggaagtctaaaaatctcattttagagacggaaattgagacccagagaaaggcttctcctgctaaacaactgttatctggtttggagagaaaaagagagctaatacaggctagaaaacacatttttagagaatggttgaagatgaaagagttattacaaagcctagcagatgttaacatgttataagtacataaaagaatttaaagctacagtgatcttttcaaacattatatgattagtttggttcatatgctggtcatgaaaaggaatttatttcagtgtaatctaagatttataccagctgtggtaggcagtcatagtccctcaaaaacatcctcatccccatcccaggccctgcaactgcgtaacactccatggtgagggattaaagcttcagggaaaggaggtagctacccagctgaccttgaaatagggaggctgtcctggatcatctgggtgtaccccatgtaacctcaagggcccttacatggaagctggcagaagaggcagagggagactggacaagggaaggatggggtaggtggggccatctgtggctgtgaggatgggagggacctccaagggggtcccggaggctggaagggaaatggcatctccccagagctgccagaaggggcccggctatcactgagcggacaccgcgtcggactctaacccacagactgtgaaataacaaacctgtgttcagcctctgagtctgtgttcgtgacagcagccccaggaaactcacacagcagctttcgccaataaatagattttcctatttctcagaaaattctataatatcctgtataagtacatattttcctgtactgctcaggacactgtcctgataagaagctatcgatagatagaaaatcaataggtagaaaaagttaaaatactggctttttaactaaagataatgtctggtgaaggtttgttcttagaagagaagtttgcaaagtgtttcgtcctggcatcactggcgagcgtctttgaagatctgcaaaggcgcatgttgggcagccccccgggagcttccattcactttcccagggtttcacgcccctgccctgctccctgacgctggcaggaaggccatcaggtgctccgtgtgggatgaattgtgagaatccagcgagtgcaggcaagggagacaaatgagagtaacagaggccggagggggacctggagagccagagccctggggaagagaaaaggggagcgattagaacaacgggaaacagatcagcacagaagagagaaaagacagaacgaagttgtgcaggaggactgagaaggcacctggagacatggggagggaacggctgacttctttccagccagaactgaggctggcccttgtctgagtcaggcgggcagggcccgtgggagggacagagacaccagtggggtgggggtgtgcggtggtgttgccctttcccaccccaggcccctacgatgtcgccctgcacaggctgcgtggctgtactgagtgtttccttgaaaaacaacacggtgcaatttggactatcgcagtttcactggaagtctttgaatacaaaccaaagcctacgtgtttttttatacctgatgtgtacatatattcacaaaacaaagcaattctttttttcccagaaaggcaggaagaaaacaaatgatctcaaatgtgtcttctatgaacatttttggcggagtttgaaccatattttgtctaggcaggccttgcacaccggaaagacctccgagaaaacctgtttcttctctttctcatgtggtctctggtttaccagctaacagaaataacttcaggggaagaaagagaccattgtccctttacctctggcttccttagtcaggaatatgaggttttagaactgtatcaaaactggactgcatgattgattctgcaccatttaccagcattagacttgccatgactgttagatgtacttgaaagctgtccagcttcctagtcaatccttgcaggcaacagatgtcggccctctgggtactgccagtcagcacaaatgcctactctcaggtttggagaatcgaactggggtggtcaggagctcctgatccattctctgcccaagccaacgtttaatgtctccaagtgggtctgtgagctcagtcacttctctgcaaggcgtcagttatccagtgcagaagccgtgactgtctacccctgtgtgcacgcgtgggagtgcgctgacggtgagtgcaggccgggcagggctcttcttaagttggattccaggagagactgagttagaaagcttctgcctcttcctcatagttctgtctcagagtcattgctctgtggttcacttcggtgtgccgtggggcacatgttgtctggctctgctgggccgtccagcgtctgaacccctcggatctggggaaccccctgcctcctgtgtgccgtggggcacacatcctctctgctgggccgtccagcgtctgaacccctcggatctggggaaccccctgcctcctgtgtgccgtggggcacacatcctcttgctctgctgggccgtcctgcatctgaacccctcggatctggggaacgccctgcctcctgcaaggacatcagatgctcgatcctcagctccctaaactgagggctcagctctgctaacggcatgctcatgactttttaatcaggagccatagcttttaaacaacagcaaccatggagaattctgtctgcttgataaaggacataaaatcatggagtttctgggtcaggcggcggcaggatacgctggacgcctgctgctcccgaggacagctcttggcaggttctgtggtcagccgtggaatatggactgagactggagctgctcccgtgcagaaggctctcagaacactcaaccccttttccgttcacatctccagataaaagtttctgcagttccaacggtgacaccagactgacgcatcaaagcccatggtccaccatcaactgtgggtcaggccgggcgcagtggctcacacctgtaatcccagcactttgggaggcccaggtgggcagatcacctgaggtcaggagttccagaccagcctggccaacacggtgaaactccgtctctactaaaaatacaaaaattagctgggcctggtggcaggcgcctgtaatcccagctactcgggagggtgaggcaggagaatcgcttgaacccaggaggcagaggttgcagtgagctgagattgtgccactgcactccagcctgggtgacagtgagaccctgtctcaaaaaaataaaataaaacaaaacaaaaaataactgtaggtcaatgctgggtgcagtcctgggccctactcttaacacacgtagaagctgcacaacaccccccgcctggaaggctctcgtgaacagcactggtacttgagtgaatcacccatcaaatcttggagacagatgagacccaaatagccaggcgctctccagagacagtggctgatgtttctggcttgtggctgctatggtaggaagggcgttgaggtccatgtttagctgagaaggctgcatgccacacaggttacacacgctcctatccacactaaccctcactaggttcctctgttaatgtctaacgaggctgtgaaccaaactaaagaatgaaagagcccagaaagtcatcttttttctagatgaatcagctcaacttgtgattacctgttgaaccagttcaaactagatccatcttttatttcactaaaactcctgaaccaaaacataagagatatttcagaacctgaaatcaactcattctttgaggctctgacttacaggacaagcactgttctttgcaaacaagccacaaggctgcattctccggacgaggtgtaaatggtgctacctgatgcatgatggagtggctgataaaggcagtattaattcttctctccccaccacacccctgctcatgaggcttttgggttcttgaccacattctggtagtgtccagagatggctccctccatgccacagatggatgtgggaagccccagatttactgactcatcccaggggttgtggccacacctggctcaccaggctccagcgcccgggaggaaatgaggaatcgtggaggaactccgtggactcagtccctccgggtccaggcctttgtgaataactaagagagcccaatgctgctctcaggatacagcctcactgctctactggtgcttctcatagagaacattttgtgaaggtagaaaatgatgctgcacgcccacctcggccttcacagactcggctggtccaccccatcttctcctcttcgttcccatccttcctcactctgccctcttcctctctcctgtgaccatcagcctccatctctgaccctccctctaggacacctggtgctccggggcctcttctccagggctccctcttgtctcatagacctttgcaaatttcaccacaaagtgcccaggcccacctcagcgctccacttgtcacatgtggatccgttggccctccatgctcagcagcacacgcacccagacgtccgcacgcacactcgctcaagcctgggcgtctgtccgtcacgcccctctgccctgggctgaggcagatactggattgactatttccgtgaatcacaaccacaccatcaaagcgggggcaggggcttctgcagctggagcagagaacagggccaagggtgcctctgtcgtttgtgggcacatgtgtgcactcacacgtgtgcatgtatgtgtgtggtgtgtggatacctctgtgcatgctcatatgcatgtatatctgtggtgtgtgtgctcacatgtgcacgctcacatggttgtattgtgtggtgcatgtgtgcgtatgtgcattttgtgtggtgcatgtgcacgtgtgtgctcgtgtgtgctcgtgtgtgtgcatgtgtacacgtgtgtgatggagggaagtcaggagggggccacctgtctgaggatggatcaggagggaagcatccctgggaagggagcctgaggacaaagccaaccatgatccagtggcctgtgcccccggtgtgcgccgcccagcagctctcgtcccagcttgtccaggacgcacaggctcctgagtggcaagaaagcctctcctgtcagcggaatccatggtggcagaagaggcagaggttgttgggaactgtccctctctcttatctctccccctccacaaagagggaccgtggagccactcaatctaacagcagatcaggttcctaccatgcgctgatttgcagaaaggactaatgtgcagattaaaacggacactgctgagcgaagcaatttccaccctgtgatatttgaaagtgctgataactgccatagcaacccgctcaccacacttcagcttcctctggccccggtcttcacagctgctggctgtggctgcaaggttaagatgacgttagctttctaaggctagagagactgtgcctaggacgcgccatgggaatgtaatggttctaactgtgaggttatatggtggaagagaggctactgacaatgtataatatggtggaagagaggctactgacaatgtataatatggtggaagacaggttactgacaatgtataagctgaataattgtagttgctgcttttgtgtatattaagcttcttttcaagatatagagaaatgtactgaggagataactagcccctaataccctatgcagaaaacataaacggagtcagggaaaactgcctatgctttgagttaggatcaaggggaaaagacggtctctgtggggaattgccatgctgtgcatagttgtaagggatggaggccgcttatctcctaggccggtgaggtgagaggggcaggaacctgggagatgagcatgagatgcagaagcccaggaagggcggcagctttaggcaacgccaccgggccaagttccactcgcttaagaacccgtcctcctccagtcacccgacaagcattttctttttaactaagtctgaatggaacacaggtcagcacttcttcagtcagtgctgccacaagttaggtgtcatgccgggagagagacgtggttcccgataggtccacagtctctatgatggtaaaaatataacaaacgatgacagtaaaatattacagacacagatactgtggtacacatttggagggagtgccagcatcagaggggtcaaaaaggttgatagtggcctgatctttaggcttaatcttaatgtgtgagtcacattctctccagaaggaggctggagagggagaaagcgtgtcccaggcccatggtccacagaacggctagggagagggagacagcctgttccaggtgcgtggtccacagcctaatgcacgaaggacttcaggtcagcatctaattgggtagagccacagagactgcaagggcccaatcatgggggtgtcaactgccacacccagttttatcctacagaccaggggtcagcaaaccacagcccctgggccagatccatcccacggctttttttttttttttttttttttgagatggagcctcactcttgccccggctcaggtgcagtggcccaatctcagctcactacaatctttgcctcctgggttcaagcaagcagttctcctgcctcagcctcctgagtagctgagatccaccatgcccggctaatttttttggtatttttagcagagacggggtttcgccatgttggccaggctggtcttgaactcctgacctcaggtgatctgcccacctcagcctcccaaagtgctgggattacaggtgtgagccaccacacccagcccacggcgtgtttatctgaataaagttttactgggacacagctacgcccatccatttgcatactgttcatggtggctttcatgcagccacgcccattcatttgcatactgtctatggtagtgttcatgctaccacagcactcaaacagttccagccaagatcacatggcccgcaaagcttgaaatattcactatctgaccctttaagaaagtttgacaacccctacacaggagacagacagttgttaaaggctttttaaaaagttgattatttggatttcatcaaactttaaaaccacttttcctcctacgacactgttaagatttaacaacttctgattctgacgagacagcacagactcctccctccctgctcctccccatgaggtgacaatcaaaggaagggtctgacaggtgggagggggagagcagatagtggggaggccctgaggacttgaggaaaggcagcatccgagtgctcccacccccacctgcgggcagaaggcagcccaggcccagacctccagcttactcaaccccaccaagcggcagaaaccagcccaatctttcttggatacttttctgctctgtccatggtgcctgcagaggtcagccaggagcctctgcagcactgggtggtctggtggagtctccacccacagtcctggggtctactgactcctactgagcaccagcaagtggccctgggaagcacctcagcagccacgtcagctggaacaaccaggagcccctctggcatgggtggcccagaaagcactccccacccacaggcccagcgtcccaccccacacccatgggcaccagtggctcaggagagcaccagcgggcaacaccagcaggaatcaggtgacacagacagggactgagcaggacagctacaggcaccaggcagcacaggaaaacctttctggcccagggcccaccaggcagcgctggaaggactttccaccacaaaccgtgcccacccccaggggtgccagcaaggatgaatagggcccatcaacaccaggtgacctggataaatgttctccccctcacaagcccagggtctccctcctccccctacacacaccgtgaggcctggggaagcactgtccaccctgcaactcagggtttctcacccacctcccaaaaactaagaagcaccaggagacttgaggaaatgcactccacccttctgagtggcactagcaaacagtgagcattctgccaacaccaagtggcctgagaggtgccctcctgcaggaccagaatcaccccccactcaaagacaataacaattacaaatactcttgaacaaagtgaaaaaggagaaagacttagcaaataaatagaagatacaaaaagaatcaaacagaaattgtggaaccccaaaatacaactgaaacaaaaaaaaaactcaatgcatgagctcaatggcagaataaatataccaaagagaggatcagtgaatttcatgatagaacaatagaaactacacagtctgaccaacagagaaaaaaaatagatttaaaaaaaaatgaactgagcttcaaggaccaatgtaacaataacaaaaacaaaatcaaaattcatgccatcagagtcccagaaggacaggagaaagtgtgtggggctgagaaaatgattcaaagaaatcatagctgaaaattggccaaatttggcaaaagacataaacctaaagactaaagaatcttggtaagtcccaagcaggataaacccaaagaaattcatgccaagacacattgtaactaaacttctaaagactacaaactaataaaaacatgtttaaaagctgccaagcctgtaatcccagcactctgggaggccgaggtgggtcgatcacgaggtcaggagatcgagaccatcctggctaacatggtgaaaccccgtctctactaaaaaaatacaaaaaattagccgggcatggtggcaggcacctgtagtcccagctacgcgggaggctgaggcaggagaatgatgtgaacctgggaggcagagcttacagtgagcgaagatatgccactgcactccagcctgggcaacacagcgcgactccgtctcaaaaaaagaaaaagaaaaaaaaaagctgccaagaagaagcagcatattaccaacagtggaaaacctactcaaatatagcagatttctaatctgaaaccatggaggccaatagaaggtggtacagcagttttcaagtgctaaaaggattgtcaaccctaaattttatatccagcaaaaatatccctcaggaatgagggaggaataaagatgtttacagatgaaaatatataaagggatgtgttgctagtagacctatacttaaaatgtggctaaaggaagctctccaaacagaaaggaaattagagtaagaggagacttgggacctcagaaaagaaggaagaacatataaataggtaaaaatagggataaataggacacattattcttttcctcatgagtttttaaaatcatatttgatggttgaagcaaaaatgagaaaaccatccgatgtggttgatgtatgcagagcaaatacttgagacaattttattgtcagagcaatactcatgacaatattttaaaagtagaaagaacaaattgaactaattgaaagtaagttttgtacatttcactcaaagtgctaagacagatactgataccagtagattgtgatgttgtgtatgtatattgtaatacttaaagcaactaatagaaattatatgaagcagtatactcataaacactataaataaatcaaaatggaattgtaaaaaaaagtccaaataacatataaggcaagaaaacagaaatgataaaggaaacaaatagacaacagtcttaagtcctaacatatcaatgattactttaaatgtaattagtctaaatatagcaattaaaagtcagcaactggcaggatgaattttttaaaaacctgacccaactatatgctgcctacaagaaactcacttcagacacccttatcttttttcttaacttgaaacaaaaaggataaggatggaaaaagatatatcatgcaaacattaatttaaaaaagcaagccaagtatggtggcacatgcctgtagtcccagttactagggagactgaggcaagaggattgcttgagccaggggttcaaggctgtagtgagccatgatcgtaccactgcactccagcctgggtgacagagagagacactgtttcaaaatatagaataaaataaaataaaataaaataaataaaaatttaaagccagagtagctatattaatatcaaaaaaatgtagacttcagggcaaataaaattactagggataaagtgggacattacatgatgataaaaggataaatgagaagacataatgatcctaaatatgtatgcaccaaatgacagagcttcaaaatacatgaagcaaaacaaggttgaaagaataaatagacaaatccacaattatactgagaatttcatcaccccactctcaacaatttatagtacaagaaaaattcatcaaaaatataaaagaaagcaatattgaccaatgagatctattgaattttacagaagactccatccaatgacagcagaatacagattctttgtatgcactcatcaaacttgtaacaaaatagaacatatcctgggccataaaagcaaaacttgggaaatgttaaataattgaaatcatgcagtatgttctctgaccacagtggaacaaacgaatagcagaattagaatcaatagcagaaagaacaggaaaacatccaagtgcttgaaattaacaacatacttctaaatgaaccatacgtcaaatggaaagttttaaaagaaatttaaaatgcatggaactggatacaaattaaaataaacacaccaaaatgtgtgggatatcactaaagcaattccaacagggaaatttatagcacataacatttatattagaaaagaagaaagaaatcaatcatttaagttcttacctcaagaaattagaaaaggcaaagtaaatccaaaacaagcagaaaggggaaataacaaagataaaaattgaaattaattaaacttaaaaggaaaacaagagagaaaatcaatgagacaaaaagctacttctccatccccacacccccaaaaggaaatcaataaaattgatagacctctagctaggctgacaaagataaacagaaggtacaaatcaccaaaattacaaaatagaggatatcactacagatcctggagccagccacaggataggagaaagtacttgcaaaagacacgtttgataaaggactgttatccaaaatatacaaagaactcttaaaactcaataataagctactcgggaggctgaggcaggaggacagcatgaacctgggaggcggagcttgcagtgagccaagaccgtgccagtgcactccagcctgggtgacagagcgagactctgtctcaaaaaaaaaaagaaaagaaaataacccaacttaaaaatgggccaaaggtctgaacagacacttcaccagagaagatatacagatggcaagtaagcacatgaaaagatactcatcaacatatgtcattaaggaattgtaaattaaaacaacaatgcgataatgagatactaccatacacctattacaatggccaaaatccaaaatactgacaataccaaatgctggcaaggatatggagcaacgggatccttcattcgcttctggtgggagagcaaaatggtgcagctactttgaaaggtagcttattagtccgttttcacgctgctgataaagacatacccaagactgggaagaaaaagaggtttaatggacttacagtgccacaaagctggggagacctcacaatcataacagaacgcaaggaggagcaagtcttacatggatagtggtgggcaaagagagagtttgtgcagggggaactcctctttttaaaaccatcagatctcttgagactcattcactatgacgagaacagtgcaggaaagacccacccccgtaattcaatcacctccctccaggttcctcccacaaaacgtgggaattgtgggagttacaattcaagatgacattcaggtaaggacacagccaaaccatatctggtagtatggcaatttcttaaaaaactaaacatacttttaccatatgatccaaaagttgctgttcttggtatttacccaaagaagttgaaaatttatgtctacacaaagacttgcacacagatgtttataacatttttattcataattgccaaaacttggaagcaaccaagatgtccttcagtgggtgaatggataaactctgggacatccagacaatggaatatgattcagtagcaaaaagaaatgagttaccaacccatgaaaagacatgcaggaaccttaaatgcttattgctaagtgaaagaagccaatatgaaaaggctacatgctgtaggattccaactctgacattctgaaggcaaaactataagtgaaggtaatttttaaaaaaatcagtggctgccaaggctgaggagagggagggatgaataggtggagcacagaggtttctttggagcagcagcactactgtgcatgatactaaaatgatggatccatgtcattatacatttgtccaaacccatagaatgtccaaaaccgagagtgaaccctaatgtaaactgtggatttggggtgataatgatgtgacaatgctgactcttcaattgtaatgagtgcaccctctggtgggggatgctgacagtggaggaggccacgcatgtgtgggggcagagggatatgcaacaactgtgcattttctgctcaactttgctgtaagcctaaaattgccctaaaaactaacatctaaagataaaatggtttggtagagggatagagaatagacgaatatgtgataaaacaggaatgtaaaatgttaatcataaagttaagtggtggaaatatgggctttcactgaaaaaaaatctttcagtttttctgtaggtttgaaaattttcataataaaatgctgtggaaaaataaatgttgatatcatgagtttctgccatccaggacatccatgccatccaggtggcagagtctggggatctgcacagaagttggctcaaagagaaaatttagaaagtggccagcatgcatttcatagggtgcaaattcaaattcctgcaagagttccggcggttaaggatgatgctgacctggtcctggctcaggtaactagacagggtggcccctctgcagctccaccagttgcaatgtggagatgctggcccagttttgtctggtattctaatatttgcaagaaaagtcaaaaatctgaattttaaaccttttgcttcataaatgttggtaacatttaaatattagtttaaaaaaataccagagactatgtctgaaggcacccttgggagtggtctttggggtctggtaaggctctttccttacaaaatcagcagggaggatcgcctcactggccactcattcaggagagctgccccagccccaccagtcgctcactcaggagaactgccacggtcccaccagtcgcttactctggagagctgccccggcccctctggtcactaactcaggagagctgcccgggaccctccagttgctcactcaggagagctgcccgggcctctccggtcactcactcaggagaattgccacagtccccaccagtcgctcactcaggagggctgcgctagtcatgcactgttttctgacagcgttgaacccactctccagagcatccagtcatttacagagctactggaagagacaccattttaaatggattcttcatcccacaggcagtcgttacttggatggaatattgtggggttcctctttcctggcacatttggaaatctttgaaatacagaacataaccacgaactagaaaattaacaggaaatacatactgcttcccaaatacatcaaacgtggagtgagttccttacagtggatactgacaattcctgggcaatctctattgcaggcctgctgtgtcgcccacggtcggcatttcaccctttcctgaagtagctatgcaagaactggagataccttcagtgcctgctggaggggcctaacccagaaagggcaacagtgtggtcctcccttgttcagtgggctcaagtccatatgtgacttcaaaagatgctgcaaaaccatgcagtgaagctaaaagtaacaacgcaagcacaagacttcagctaaaaaatgaaaagaaagaaagaaatggaagcacaacgctgcttcagcctgttttagtttgggcaaggaatatcattaatcagtccctcaagacatcttagctgttggtaagaaaataacacctttcataaacaaacttatctacaaggagagaaatgtaaagccagaggctgggagcgtcgttaaatgattccgttgctgaggacagcatgtggcctgggacagacagcaacagcagaaaggcacgaaagagaagaaaatctgtggtggctgggaggagaggtttgctgagagccttgccaccaggacaccctggcctcatggaaaggtaccaagccccgcaccacccagccccattctcttttttcaaatgggctggaaaagggaagcctgacataggagctgtctgagcacccacggctgcatctgatggcactgaattaggataattaatcatccccctgcatttcccaaacagaggcacatttcaaccactccagattatgatgttttaaatttaagttcaattttacatttgaaaaatacacattccattcttgagaaaaaaaaacagaaaataactgtaaagtaactgtacaatgtttcataaagataaagggctatgaaacatggtttcattctggtaaagatgacttttatgtttttgtgactatttttcctaatgttttcacttaaaaacaatagcaacaataacaacaaccaaaaaacaaacaaaaaaaacacacaatgtgtcacctattttaaaagttcccaactatgcagttagatatggaaatgtaattttgaaacttcgatttaaatcaaagatctcagcttccaccttaagtgaaaaaagaagaacaaagtaaactcaaaagtaatgagaagaaaggaaataataaaaatcagggcagaaaacaataaaataccaaacgaaatagaaaaatcaatgaaccaacattttgttcattaacagtatcaatcaaattgatagaccttcagccagattaatcaggaaacaaaggaagacataattaccaatatcaggaatgagagaggtgacattattatagattctacagatattaaaggatgagaatggaataatatgaacaactttatgccaataaattcaatagtttaggtgaaatgaaagaattccttgaaaaacataagctgtcaacatttaactcaagtagaaatcaataacctgaatatccccacatctaatacatttaacttatagtttaaaaccttttcacaaagaaaactccatatccatattgcttcactcatgaattctaccaaacatttaaggtaaaaataataccaattctacacaaactctttcagaaaactgaagaatagggaaagctttccaactctatgaggcctgcattacgctgatactaaaatcagacagagacttcagaagaaaactgcagcccagtctctctcatgaacatagacacaaaaatccttaacaaaataattgtaaatcaaatgcaacaatataaaaaatagtacagtatgtcaaaactgggtttatcttcaaaaatgcaaggttaacattcataaatccattaatataaatcatattaacaacctataaaagaaaaacaacatggctatctcaataaacaccaaaaaaatcggaaaaaatatcctacatccctttctgttaataactcttcagcaatcagtgaagagaactccttcaacttgatgaacatctgtggaaaacatagagctaatatcctaattaatggtgatatactgagtgctttctctttcagatcaggaacaacatggagttcaccttccccactttggtcatacattgtagtaagggttctcaccatcacagtacatcaaagtaagaaaataaaccaactgctactatcccaaggtacaaaatctgacagaacttgtactaaaagtaattataactaactggtaaatttttttcaaactgcaggatacagataaatgcacatatttcctctgtttttgtctcggaaactatttctccctcacttttgcaggacaattctctggacacaaaattctttattgatggtcgtttctttccagactttaaacatttcactctattctcttcttagttgcattggttcctgacatctgatgtcattattattatcgttcctccatagataaagtatttttgccctgaattctttcaagattttctttttgtctttggttttctgcagtttgaatataatgtgcctaagtgttgaccaagtctcttggtatttatctgtttggtatttattccctgagctttcttgatttgtagtctggtttttcctattaattttgtaaaggtttcaactattactttacatctttcacctcatcctttctctttctcctcctggtattcccaaacacacatattttatcttttgtgattgtgccacaaatcttggataccattctgcctttttcattcttttttcactttgcttttcagtttgagtggtttctattgacctgtcttgaagttcactgatgcttttctcagccatgtgtagtctgctaagagccaatcaaaagcattctccatttctattacagtgttttctatttctagtatttttattcttaggatttccatttatctgcctacattacccaactgttcttgcttgttgttcacttttcccacttgagcccttggcatactcatcataggtgtttttaaattcgtgtctgctaattctagtgtctctgccatatctgagtctgctctgatattttgtctcttgtgttttgacttttggcatgccttctcatcttcagctgaaagctaaacatgatgtattcagcagaaggcactgaggtaagcaggcctttggtgtgaggttttatgcctctgtctaggagggaggctgggctcattgtctgctgtagctgcaaggctccaatctcctctggtgtctttgcttttgcctcccctgttgtcttgatttcccttgaaactccttcttaagtagagtcagagctgtggcccccttgactgtccttattcaggagctgtgtagttgtgaggccaggtagaagaggggaggggaggggagggaaagggaaggggaggggaaggggaggggaggaaaaaggaaggcaggggagggaaaggggaggggaggggtctgtagtcccatgatttggtcttgtgttttcagggggcctgcacacgtctgtggctgtgaccttcacaaatgatcctcaaggtactgccccctgagacaggaaggctaagaggctgcagccgagtgattttccctccccccaggtcagatgtgctggtgaaggccttgcccttgcagagtgggtctgtagggagaaagcgctagctgaatccacagtcaccttccctcccctcaccacacaggagggggtccttctcccgtcttcaccataggaacttggtggtgctcctggaaagagaacccatgaaactgaggcagccagcagaccagacatctgggagccctccgtccgcagccagccccagcctctgtcaatgcctccatggccccatgtggggtcccgagccatttctggctgcagcagctgctcttccggaagccatcattctctgtatctgcctgtttctccggttttgggtcaccagtttgccctgtgaccacaactctctgttgtgatctaagaaaaatcactgttttctgttttttgcctttttatggtgagggagagagaaacgacttccaagctctttcacatgttggaatggaaaccagaggtctctagaatggtcacactgggaaaggtatggcaggctctcaaagttcaaaatcagcatttacaggaattcgcccaggagaatgaaaacatgtcaccacagagacttgcacacaagtgttcataccagctttatttgaaatagccaaaaactggaaacaatctaaatgtccatcggcaggtaaacagatgaatgtggtttatccacacgacaaaatcctactcacaatgagaagaaatagattgggatatgcaataaaattaatctttcaaaataatttttctaagtgaaagaaaccaaaaaatacatactgtataactgcatttatacaaaattatagaaaatgcaaattaatctctagtgacagaaggtagaccagtgcttccccaagggtggagtgggggtgaggaggggcagtgcagggaacacggaagggcccgggtgacttccttgggggattgtgcatgatttcgattgtggggatgatttcatggtaaatgcctgtcaaaggaaatcacgttttataccttaaatatgtctggtgtgttgtctgttacaccagaataccagaacaaagctgtttcaaaagagaggaaaactaaaattagctccttcagacagggagtggtcagagaacatatacaattaattttattactgaaaaagaaagaaaataacgtttatcagtagaacatttttgtattatggagctagaaaactccataatacttcaggagctagaaaacttttgtaatgcatatgcattatagaaaatgattatatgtttagccaatattctagaacttatccacctatgcaatgaaatgctgttttcccaaaacacagactgaaaataaaaatttttattccaatatgtggccattgctcaataaccatttttggactgtctcctggatttgaaatgattttcagtcccagtttatgagcaacattagaaaactacttttattgttttatgatcacacctggcaaatgaaatccttattacatttcctactttaaagctgggatttctaaaatgtatttgaaagcagcccagttttgacacagtgtaacacactgcctttcaacaacttcctcagtgaccattttctcaaggacattatcttggagcaaaattggctttgtgtttcctcctatgaaatgtgcacactgcctgaatatcagatagcttagaataataaaactacatgtttataaatggaaaaagtactaatatgtgaagtgaataaaatatggctcttcaatgatgagtttaaaactgatgctatcaaaaaatattggtataaatcccccatcttatcagcactcactttatccatctttggaataacacacactttctctttagaatttcttactcttttaattatataatattaggtacactgaaggaatagtataaaaaattccttctaattgtaaagtattataaagtatgaatactcagattgcttgagcccaggagttcaagaccagcctgggcaacatggcgaaaccctgactctacaaaaacatacaaaaattacccaggtgtggtggcatgcatctgtagtcccagctactagggaggctgatgtgggaggatcgattgagcccaggaggtcgaggctgcagtgagccatgattgagccagtgcgctccagcctgggtgacacagtgagacactgtctcaaaaaaaaaaagaaacaaaaaacaaaaaaacatgttcccaccatccaaattgagaaccaaacactgccaattctgagctcttcccaatcctaccctctgcccccaaaataggtgaccacggattagatagacggactggcagacgtggtttggttttgcttgtttttgtactttatgaaaatggtttcatatgtctgtggtcttcagtgcctatgttttcattccacattatgttcctaagatcaaggattgagtgtagcgtggtgttctccgattttaccgctctgtgctaactctgtgtagatttgccagtttacccctgtggatgtttgtgttgtttctagtttgatgctatcaccctgcacagtctcccaacacatgttcaagttctttagaagagtggttctcaaactggacagcagaatcccacgtgagagcatgtttattataaaaggcaggtcaccattccccagagattctgagtcagtagcttctagagacccagaggtctccattttaacaaacactcaagacgattctaatgcaaatgctctagacattacagcataatcaaccgtattctaaacacacacctagtgtgctgggcacagaggtatgcacacagccagacttccaagataatgtttccaaagttgctgtattactttaggccccaaccaacagggtgcaaagttccaatagtctatatatgctccacagattttccctccaatctaatgactgtgaaatggcatttcattttggccttaattttcaagttctcaatttctgtattttgttattggctactcatattttctcttttgttacatacctattcaggtctgctgttcaatttccaattctcctatagatatataaaatcttattttgttcactatcctggatagcagtcctttgtgaattatatatgttgcaactaccacttgtggtttatcatttcaccctaacggtgtcttataatgaacagaatcttttaattttaatgtagctgaattcatccatcttttctagtatgcttaatgcatttttaaagaactttaataaatctaaagttataaaaacaattttaattttgatgtttctcctttaaaatttaacagttaatgctggaattcatttttgtttggtgtgaggtatggatccaaatagattacttcatttcatgtggaaaacaaacagtactagaaccattaactaaataggtcactgtattagtcagggttctccagagaaacagaaccaataggatgtatatagatacacaaagacttgtgatgagggactggctcatgtgattatggaggctgagaagtcctgcagtctgtcatctgcaaactacaggcccaagagagctagtggtggtgttccaagccaagtctgaaggcctgagaccctcccacccccaatcaatcatgcctagacagggtgtcacataccagggcatgaccactccgacagcatccatgtgagaggtagacgtggtgcccaggtgagagggaggcagagtctgtggagtggggggggggcaaggtgctcatcagcatgggtgacagatgaacttagctaagataatggtgtctccaagttgtgactgacatttcctaactcatcatcaactctttaaggggaaaatcctgatcatatattttaggttgtcagtgcttgaaacatcttttgagtacactaagaaatgcctgcacagtcaatacctttcctattctgaactgtagaatgaagaacacttctttccagcaagaactgcctgttctaacccttagatctcaatccatcctctttctccatcctactgccaacaacagcccgggcaaccaacatccttcacctggatgactgggcagtctccccacttctgatcttcaccctttcaggtgcagaggatgaaatccacactcttccccagagcttctgggtgggacggtgcctgcatgtcaccccagccccccggggccaccacatttcacctgcactctggtcactctgatctcagcacctgaagtgtgccaagctcaccttgtttttgcttatggcactctgctcactggaaactctccccaccacttcctggtgccttgactaacctcagagaagcctccatgaccagatacccaaggaagctcctcactattctccactcagcccacaaaccaacaggccccaggaaactctagcttgacttccacacagagctcctgcatctccaaagacctgcttagttcattttcattttgaccaaaagctgcttaataaaagatattctactaaaattaattttaaattacacaagacttttggccaggcgcggtggctcaagcctataatcctagcactttgggaggcaaaggtgagcaactgctttagcttagaagttcgagaccagcctagacaacacagtgagaccctgtcacaaaaaaaaattttttaattaaaaaaaaaaaatcacacaagacttttggctaatttcattttcagcttcttcccactataagatgaattgtatatgttacatataataaattcaggtgttcccaaattttagcatagttttttaaattctaagttattagggaaaaacagtaaacctatggatagtaagggagaccagtgccctggcgttttggtgaaatcacagcaatgtgtaagcatttctatctggattcttgatactaatagagcatgaacttttaaattcactgaagatgtaacattatgaaatttagacaataatcgcaggctatttaaggaggaaggtgagaaagttaagtaaccagtggagaaatggtctgcctttctgggtgtgaagatactcccagcgccaatgcagcttaggcagtggcctcgccagcgtgaaggagccactatctgctcaagcaagaaccctcccagactctccacctgctgagaccgcagcagcctcagcctcagccacagccacggcctgggcctcagcctcagcctcagccaccaccacagccacagccctggtctcagcctcggccacagcctcaaccaaagcctccgccccagcctcagcctcagccccagcctcagccccaacctaggcctcagcctcagccacagccacagcaccagtcctggtctcagcctcggcctcagcttcagccatggcctcagccacagcctcagcctccacgcgtgggtcagacatggccatgcaccaggagcccccaggagccactcccagtctggtttgcattctcccacagaaaatggcacctactttctgtaactgtatttttttttaactttcaaacaagcttactgcaatgagaacggtatgagcattttattatactgaggaactttaccaaaaattatgtcaaactgttaacgcttttggaagttttcaggctcctgatgagggatgaagcaacataattatgtattgtttaatgttagcataagagacagacacaaaacacaactgactttttaagtctaaaaatttttcgagtgaccagtattatatttgttcaatttctagctcatcgtgatgtttatatagtcattcacaatgtttcaccaaagcaaaacatgaaaaactataaaaataataagactcccaataacacaaagcttttataatagtaattatggaacatggacattttaatgaatttcatattgcaatgaagacagtcaacacttagagacaattatatcgatacaataaaaactgattccatggaacacttataaatgcatacattttcctccaaagaaatatgtttttcacagacttaagtaacaaatgatttacataggattcttcagattccaaaatatgtacagagtttttgtctctacagaaactgatgagcagtggttgaaaaagagttgctttgcccaacagcatggctcttatgaaattctgtatcatatacagttttcagtaaccacacattttccgtctatcattaaatgaaattctggacacatcagcatacaggacaaaactgttcccacttccaaacactgtttcagacgagatcacgtgtggttgacagtatgacttaatttagccacacacacgtgcacacacacacacacacacacacacacaccatccccgatcttgtctgtgactcctgatcaccacgctgcagcagcagtggatgagctcacattagaagacgacacagcagcgaacagcaaggtgccccggctcctgagagctctgcctgagcaccacagggctgcgcccccaaggacatgcaggagtccagtttctgaggtccctccagtttgccagacaaggtgagcagctgtggcagtaaagggcaccagtgtgcctggaactcagtggccactaggaatattgacttttaaaagcttcaaaaatgtttaatctggcagagatctggttcttaagtttgatttggctatttgcagccatttttcaatgttcctaaccatcatcctaagacacccagactttcaaattaaactccgaggaacccaagcaggtggcctgtgcagtggccccagaagctgccctgggctcagacctttgtatgtgcagtgtgggaggctctggcaattggacctccagccaagagaaaaagtgaggccccagcaacatctggacacagcacagccctgcatcaggcaagttcgctcaggacagcaggagctgaaacctgagattctaatcaaccagagggaccaggtggactccattctcagaacagtgcagtcaggaaataatgtcggacaaaaacacaacacattttttatttgtaaaatcaaaatgactgaaatatttgctgtttgtcccttagccacgtcagatccatctgaggtggttatgggtttttcttgggcccggggctgtcagtcatttcagggtcattctagatgacttagattcgaagctccttggaccagctcctgaagacccaagtagggaggtgcctctcatccctggcgagctgcaccaaaggacgggtccaaaagtcccacgtcctactgcacctgcacctaccggtccccagatgggttccctcctacctcaccgtaaaacagggcaaaacacaaagacctggggatgtcacatgacagctgtaaatattaccttcctgtgtctctccaagtggtgagcctccaggtggacgtattgaaaggactgaatatacaagacacaggaaatgagagcctctttatcaaaactgtaactcagcaagaaacattaacgtacagataccaggtgagcagtaatttccaagaaggcaagaacaccaggctcactcagcagtggcgggactggcactgagaggcgtccccaccacaagacctggaagtgtctcgtcaccggggcctgctggctgcagccgtcagcttgtgcgcctaagtggagagcctacaccttcaggacacgtcggtgtgactgtctttcctgccttctgaactgaactcagtattccagctataaaccaaagtgctccagccaggcaacagtgagacccaaagtttcccaaagacccgtctctgaggtagtgttgttggctctcaaacaccaccacgggagtgagcccattcggaagcacacaaccgaggtgcggagaattaactgggctctgtgtgcaggcggcctcttatcaaggtcaagtgacattcagtggacaagtcatttgaaacatctaaaacctgtttataaccatagctataaattaaagtgctttacattttgcttaatatttgaaatcagtgattagaatcctatttcaaaatttgctagcatgagacctcgggagactgaaatgattttctataaaaaagcagaaaacttttctttcctaaagaaactccaaatggtgcaaatccaacatcccatgcttttttttaacttctaaactccaggttacctttgcagaactgtaacagaaattagagtagaagctgactacacgacagcacgtgctgaacttcacgcgaggtaaacacaaaatcctggagcaatcctgctggtcgccagccaacacaggcagccccacagtcttcccagcaaaggcagatacgtacagttactccagggaacgcaggactgccgacgccgcaacgtaatacagaagttcacatttaattcacacaaatgtaatgccctactgttcacctgtccaatgtcaacaactcacaagcatttcatgtgctacatgggaggtgagctttgcctctactgcccagaggacccaatatacatacatatacaagacaaaagtaaaaaatacgaccacacatttctctgtacatttcatgcaagctgggcactatgtgaaaagaacatatacaaagcaccctttccagggtcaaactctcacaaaaatggctgattaatacgcagaaaagcctgcacccatcaaaggtctgtgctggcaaacagtgaaactaagggctgccggtgtccttatttttcttgtagcaatgcagggatgttgatgttccaaccaatggcttgccggtcaaacccacaggtgaacagattgcacacggggtggtcttcactccatgccgagcagcataccattctcctgtggccctagtgatgatcaaacaaaccaaaatcagtgcattattcccgaaagtaagattataagacctcagcgaaatgaataaccacatcactcaaagtacgtaagttataggaaaacaacatggtgtgcaggatcagtcccatggaccaccgagcacggaccaccaagcatggaccacagatcatggaccaccgtgcatgggccacagatcatggaccaccgtgcatgggccacagatcatggactgccgagcaccaaccaccgccgagcacggaccaccgagcaccccatggaccatagagcatggaccaccaagcatggaccactgagcaggaccaccgagcatggaccgccgagcatggaccactgagcaggaccaccgagcatggaccgccgagcatggaccgccgagcacggcagagccgccaggacgtgcagccaggccagaatgagtgatgccgagacaccagtgagcacgagggttggtggaacccgcccaaaagcactgtatgagtccttctttaagaaaatgagtaagattacagtcagacaaaaaaataaatgatcaatgtgaaatttttgaataaatgaagctaggagatatttagaggtaaattaaatgatattcactcaaagacttcaaattgcattttaacaaataactggcttcagtaataatggaactacaaaaatacatttggtgtcatataaaacaaggataaataaatggccttttaggtagattcctgccatcttcagcaattccagttaaatatcagcatgctggaaaagttactgcaaaatatgtgacagagcaatagcatatcggtgtgtatgtacatagcagatgcaggctcttagccaacacttagaatatctgtaagcagtgccttagcacccatctgcattttctaaactacacaacagctctgatacgttgctgttacagcatcaggtacaagagtgagtcagtattaagtaaagttgacagattaagaaacactcaaagaatggcataaagttctcctgaaaatattcccccataaatatgctatttatacatctggagagagaaccacaatagctatttatacatctggaaagacatccacaaaaggccagaaaaataaaataattataagaaagaccacataacaaagggttacaaaaggcacaaaaaaggaagcagcaatgcatccactaactggaggcaaaaccaaggctgtgggcaagagctctgcacagtgaaactcaaggcattcgctgcagaagtgccaaagagcttccagaagaaagccagccaggctttcacctccggcagagctcccatgggatttccatctctcatgcgcccacagcattgccacccaggaagcagatgcacccggaagacgccccatgccgtcatgagccccagtgcacgtgatgtgctccaggacgctcagcacggggccccacgggcctccacatcacagggaccctcacactccgtgagcctccacgtcacagagacccttgcgcagggaccctcacgcccaatgagcctgctcttcacaggaaccctgaccccggacctcctgactctccaccaagctcgctttcccaaaactcatgctgggaagtgacacctactccagcactacagggaaatattttcaatcagtccctttcactccactacttaaaggctcaaataagtgttttgttttctctttttcaagtcagtcagctgaagaagtaaggacaatataagtcagtgatttccagcagggttctgtgacactgaaaaccacatttatttatctgaagaggtgttacaagttctaaataaagttaaatcacattcattaatcttaaaaataaatctatttcacataccactttaggagggaataaacccaggcacaacagaatcctacaacatcaacaaagttgaatgttcacagataactgaaaataaaactgtctacacagaattaaggccaagaagaaccattcagaattccgtttttctgagggaaaatactctcaaagtaataaagtcatagttcacagtcataaacaaatagttttcatgaatttgtgtttcaaaatgcaaactttacatgctgcacagaaattttaaaatccgcatgggcacattgaaaagagaacattctactgtgtctaagatgcagctgtgaggacacatgagtgatgctcagctgttaacaaaacatgaaaagcttccccaggacaagcaatttatggctgtgttaagggttgtgaagcatattttagtcactctaatttcatgaaatttttctactccactatttggatgtgtatcgaggagtaaaaactcaataattaacttcaaacagtgcactctcatgccaggaaggggactgaagagacacccggtctcagggaagctcatttccagaaagtctgtgctaccggaagaaaaggtgttgctgcgctgagagaacccccactttcgcacgtgcctccctgaccacccggcctgcctgcaggttctgaggctcacaccccgtgcagagcagctgcggcccacgagccatgagctggtgtccacagaaggagccacagaggcactgagggggccacccaagctgccggcaggcgtgtggccctgtgcagccacaggaggcctcggggaacaaatccatttactcacacaggtatccagacagtactccaacaaaatcaaaagaagacaggaaagagggatcctctgggggggcctccattacgcacaaggctgggcagacgctgcctcgaccacggggagtttcttttttttttttctgagacacagtctcgctctgtcgcccaggctggagtgcagtggcgcgatctcagctcactgcaagctccgcctcctgggttcacgccattctcctgcctcagcctcccgagtagctgggactacagacgcccgccaccacgcctggctgatttttttgtatttttattagagacagggtttcaccgtgttagtcaggatggtctcgatctcctgacctcgtgatctgcccgcctcagcctcccaaagtgctacgattacaggcgtcagccactgcgaccagccactgaccccggggagtttctgtgcatcgcagctgaccctgtgacctcccaggggagagccaacagcaaacgccacccacattatagtgaggcccggctgcagagcacagcagagccgccagggaatctgaacacgggcccccaggccccctgggcctctgcatctgtgcgggtgccatggagtctcgattctctttgcgccttccaggcaaccaggacgggtgggctgaacagcacatagcgagaaactccctccgccgtcttctgaagttagcaaggagcaacccttcactaacaagaaactaacatttaaatatatttcttcctgtcgcaacagcctgccatagaaacgtgttcttctggctggaggtggaagaggtcccaccttaaagacccccagcctacaaccaacccagcttctgcctggccacaatgcccactcaacacttccaatctgcacagacacaactgcagacatctaagacggcttccccacagagccaccaccactaacacgtgcaccaaagagctcgttccgcatgcctgtgaaacagaggagctgcatgttttctttatttgtaaactgaaaagccgatcatggtattaagaacactgggctgggcacggtggctcacgcctgtaatcctagcactttgggaggcggaggagggcagatcacctgaggtcaggagttcaagaccagcctgactaactaaccagcctgactaacaaaattagccaggcgtggtggcgcatgcctgtaatctcagctactcgggagattgaggctgaggctgaggcagaagaattgcttgaacctgggagacagaggttgccgtgagatcatgccactgcactccagcctgggcaacaagagcaaaactctgtctcaaaaaaaaaaaacactgaagtaggtgtggaataacttgagtgtacaactctacttcttcaattttaaattttatgaactctaaatacagctcaagcatttccaaggaaaacttagcatgcaaagacttagtaagaaaatgagaatgtaaaatatctctacccgtcctcctccactgtgccctgcatatgttcaccgaccgtgctgttacctgtcggctgctccggggaagccgcgccaggcgcactcctgacatatcaaacagtctcacttgtcggttgtcatgggggagggctatgattttttggccgacacatacattgatcctgcaaagaagaggtaaaagtgggttgtgcatgaaacagtgacactgtaagtttttgagttgacagataatgaagcaggaggttccatattattcacatttcaaggccgactacatgaacacactgcgtgtaccacctgcttacggtattcaaaagagaccaagttactcacacgtagctacaagatcacacagaccccatgcacatacacacaatacacacacacacacacacacacacacacacacacactgctcaatggtagaaccagacccacccagacacaagaccaatcctcacaagaagtcaagagaagccctgcatgtctgccacaaacgggtcattctcattctcacaaatctcactgatccaacctggttttaggctaagttagtttaagttttcatggaatactgaaactgcattagaggacaaaggagcctaaaccattgttcccggggttctatcaattaaacctccatgaataaaacatgaaatcacaatcaatcctttcacatcaaactaagccacttacttaaccaacagtttgactttacctgttaatggcagagtccgtgcgaatagttgcaatgggggatctcatatttttcaagtcccagactttcaccgtgcggtcatcgctgcctgaaaccacgttgtctcccacggtgaacacggcagaagtcacagtgctatgaacaaagggcacagagtcagatgcaacagcaggtgcaggacgtgacaccacaccccacacacaaccctgaccaagtgggtgggaaggaggtcggagaagcgcaaactcacagctctctcctctgcaaactgctcccgcctcccaaagcctctccaccagtgcaagaaaaggacaactgatttcttcccagtggatcagaaacacacagtccattctactctattccacatctacaggcaacggaacgaagagaggttacagaaagtagggttggacagaacatgcccaaatgtctacacatctgggtctatggcagagaatttaaaaaatccattccaacaacaactgtcaatcaatgtaatcataacatatcttggtctatagcagagaatttaaaagaaatccattccaacaacaactctcaatcaatgtaatcataacacaggagttaagagaaaaacactctgacaacaattcaaacacggacaaaggacttggatcaacattttcccaaagaagatatacaaacagccaagaagccccacacaccagaattcacagtagcattactgacaacagccaaagaggtgcaaacaacccacatgtccatcagcagatggatttaatgcggcgtgtacacacaatggaatattattcagtcgtaaaaaaagaaactctaacacgtgctatgacatgaatgaactttcaagaatccccctcatctaagatccctggactaggcaaattcagagaaacaggaagtagaacagaggttctcggggtctgggggatgggcatgaatagtttcacaagtgcagagtttccatttgagataatgaaaaagcataggaaatagtgctggtggttgcacaacaatgtgaattgatttaatgccactgaagtacacacataaaaacagttaaaatagtaagtttcatattatgtatatttaaccacaatctttatcttaaaaagtttgaggagaaaaattcaacatcacaaccactcttggaacctgcttctataaatccaaaataataattaatagttttctttttaattcaaatgtgttgaaatatgtggccctcagggagaggctcgaggaaccgaagaggccctgaaatggctaagatgggagacccacgccctaaagatgaaaagtaccataaaaacaagaagagagggggaagaaaggtttcatcagtttatgttaaactctttcataaacttttcttctgaaatgtaaaaaaaagtgtttgacatggtgctaagtatattaaatagtcttacccgtggtaaaatcggattaaacatgtaaacaaaggatgttatcacttgaattgcactgagaatcactgaagaaacccaggcaaaatctgcagaggaaatcatgtcctcaccagctgaggctgtgctggcagtggctggggtgattaccttaaccagtgatcaaaggaaagtctctggcacttgccagaaggtatttagaactcaaataataaaatgacatttgaagaagaaaattcaatcacctctttgctcactggcaaagttcagtaaaaagaatgtgataaaaaccttactttccccgtgagctaagggcacacaatccaggcatgatccactgctgtcttcagcaacggccagggggctgcgcgtcctgcctggctcagggctggggtgggtccccatgctcgccatgcagctgggcatgagtggcccacccaggaaggcatggtctgacttcagggcagagtgggcagatcctgagacgcaggggcagtgccttctcagagagacacaggcttgacccctacactgtctcccagggcacaaaaactggggtcactcactctgtacaggggctcaaaacccgcctcaccccgcactgaagcagctgagatacctacgagatgataagcatgtgaatttccacctatccatgaaggaagtgtcctcttgtcgtcacaaatcactaatttaatgtggaccaaaagcttggtttccacatctaccctcatcgaggtccagtccatcaaaattgcttggaactctggagtccagttaaatgccagttgtcccagccactgaagctgtaccgtgacatgggatttcatgctctatgcggccctggatgagagaagcaccacgcagtcacaaagcccatttatgaaaatcctcctcatttagtggacaccagctgagtcctaattacgtctaagttccactgcattaagacaaggtttttaaaaatataacatcaaagtacagcaaagctactgagaatcaaggtgcgtcaacaacacctggcaacacgctctgacaccgagaccccggaacacagtcaggatgatgcggcggcgaccgttttcacgtctgcattctcaaaggcctggtcgtggtgcccacagctgcggtgtggattgctgacacttattcccccgctaggacctgatgtctggtcggggcccttccctgtggtgcagcatcctggcctgtggatgtagcagccgccctgcccaggcacattagaaactagagcagacccctccccaggggtgacaacaaacactgtctcctggggggaaactgcccaactggaaaccacggcatcacacggggcaggacacaagcaaacgcccagcctgggtaacgagagcagcacgggttacgagagcagcatgggcagaggagagagactgcaaaatcaacccagtaactcctccagagtcttcatctaaaaaaataaagaacaacatgagagcttgactataaatcagacgctgccacgcttcagtgagaaggttacaatgaggcttagaggacttcggctgctgggggagcctggaagaatgagaggagaggtgcccccaacttctctttgaactggagtcttcaggaggtttggccaagttaagtttcagtgaacattctgctaaattaataggaaaaaaggctcaacaaaagatcgcctaactccatgttaatgaaatgctaaaagacattaggtttttaataaatcacaatcctgacaagtattgtcggacatcaaaagaaaaaagaactggcaaagaggcagcagtttccaaggcaccctcagcccacaggtcccatggggaggctggcgcgcacggccgtgcactggaaatggttccgacgctgccaaactccggcaaactcatttatcttgtcgtgtggggcagccgagcgtgctcctccagctgacagtgcagcacctcctcgccgcacaccactgcctggtctggaacattccgctccctccgcgggtctccatcagcggaaacgccgcgaagctggcatcctcattaggatgaacagctgtctcccagtcacacagagacacagaaccgcttctgcataacaatctgccgaaatttcactaaggaaaagacgacacgatgtggaaaacactgggccacaaagcgctgatgggagtgcttttccggcacgacatcaaacactgacgatcgtttcctttcctatttttaaaacgcagcttcctcaaggtaatgtgttcacatctgaggagcacgcctgtgtgtccacagagagggagtcctgtggacggcagccccttccttggaacccaggcttctcagtcaaggtaccgagaacagatctttgaaaatgaacagctgtgaaacaggcagcactgtggctttattactttattactttggcatgtcaactgttctgttacagcgctgatacaaaagtacaacacctgcgtcgccaacagtcctgactttaaaacagtgccctgagtaagtaaccaaaggacaccccaataagccagccaggacccccgggtgcccctcggaggcggcgcttcatagcgcaagggaagacatggggtagctgtgttgtgtttggagtcatcagagcccttcctgcaacttccaagctatctgcatgaaatccaactcctaacacattaaacaggtcttctcttcacagccaggcagcccaaatgcacactcggggtctccgaagctccatcccggcctttctcatcacccacgccttttggaattcaagaactcacacaagcattcatttgacgaactcagaggactgaccaagaaacggagaagtcacattcaaataagacacatttctcaatactccttgatggctacctccccaaaaagtggacccttcagataaaaatcaatcaaagcaaaaatcaagtatgtatcacatgtgattctttttcagaatttcaaattcaactgttccctggagaagtcagttctcctaatgcatagttctacctcagtagtctcatggggccatgctactctccaaacccctctcggcagaaataatgagagatttcccaactaagtcactgataagggctgcactacagaactgttcatgcaacaaatatttattaagcactggctgtgtgcaggccccgctcctcgtcagacagtgtgcagaagaggaggaggtaaagtcactccagtgacgcctccctcctcccagcgaagggggcaagtgactggccacttataatattataaggtcagcagtgttaggcgcacaacagcaccctaaggcctggaagtgctgccaacaggcaccacagcaaagctacaagaagcctctgcaacatctgtgtttaccatggcccacagagaagggcttctaaagtgacttcagactatgctaaagcctccctaagatttgactaactgaattagtaagaacctttccacagactattcaaagagaacatttagttcagtataacctgaccacctcatccggccaaaaataagattctaaagatgagatccatgagctatgggggcacagtgagaacactcttctgctagctgaagagcttcaccttggctatgacacaaagaaagaagacccattacagaaacactgacctgtggtgcctggactcagtaacagcactcagctctgtgttctcttgctctgctctgtctcgtgtactgatcttatcatcctagaacgtcaaggctaccaaggacagagaccgtttctcacaaccactgcatctgcaggagcctgtacagacgtattttccaaatatatgctcttgacttgttttgcagcacggccttctggtatacagaagaaattcctaacgccgatgcactcatgttttttcttcataggaatggcccttagtcttttattcagggttcattttcatttctacgttatcagttttagaatgttcaggagcagtaagtaagagaaatcagtgggattgagtgagaaacagcattagaaaccagcacaaaaatggcaaaaagcaacagctgacttccagagaagctgaaacaaaacactcaacagagacaaacagtaacgcccaggctgcggggccatcagggcagggagacagcgtggcagtgcgtgcacactcctaaagcactggtatgtccctctcttacacacacacacgaaatagtctttttttttacaaagtgttggttcttgagggatcattggagaaatcgcttctgtggaacatcgtgctctccaaagatggtgttaaatgaagtgtttctctgctctgctgctgagcaccagaaaccctgcagctcagatgcctgcagggacttcatgcagagctggctgagggtggctgagtgcacgcagctcagatgtgtgcagggacttcaaccagagctggctgagggtggctgagtgcacgcagctcagatgtgtgcagggacttcaaacagagctggctgagggtggctgagtgcacgcagctcagatgtgtgcagggacttcaaacagagctggctgagggtggctgagtgcacgtggctcagatgtgtgcagggacttcaagtagggctggctgagggtggctgagtgcacgcggctcagatgtgtgcatggacttcaaacagctggctgagggtggctgagtgcacctggctcagatgcgtgcagggacttcaaacagagctggctgagggtggctgagtgcacacggctcagatgtgtgcagggacttcaagtagggctggctgagggtggctgagtgcacgcggctcagatgtgtgcatggacttcaaacagctggctgagggtggctgagtgcacctggctcagatgcgtgcagggacttcaaacagagctggctgagggtggctgagtgcacacggctcagatgtgtgcagggacttcaagtagggctggctgagggtggctgagtgcacgcggctcagatgtgtgcagggacttcaaacagagctggttgagggtggctgagtgcacgcggctcagatgcgtgcagggacttcaaacagagctggctgagggtggctgagtgcacgcagcgcagatgctgataagaggctgccaggcgaccctcacatgccacccgggccctggctctgcagtggccatgcacacagcatggtcaccaccatcttttccaaacgtcagctgacgctttaggcagccacccctccccatgctgcccgctctgcgtatcatgctggtttctgctgacttgtggactcagacacccccacctgtctccggagtctgtcctgaagtacctcacagttaggaagttttgagtatgtgtcaatagcctgatggctgtcttacagtcatctcaaagaaaagtgacagaatctgacaggccgaaacaaagctgtccagtagagcgattcaaacgcaatcatttccttaagtccttatttatgagttcctgagtagcccttcttaaatgaggaactttaaaagggtaaaacagagatacactaaatctcctctcacttttaaaaacaatattctaacttggaagcgactttaaaatgcatcaataggcagccaggctcagtgggtcatgcctgtaatcccagcactttggaggctgaggcaagaggatcacttgcggccaagatttcgagagcagcctaagcaacatggtgagactccatctctacaaaaaatacaaacattagcagggagtggtggcacagccctgtagtccctgctactcaggagggtgaggtgggaggatcacttgagcccaggaagtcgagattgcagtgagccgtgatcatgccactgcagtccagcctaggcgagagggtgacgccctgtctcaaaaaaataaaccaataaaaatttaaaaacatgcatcaacaagggactggctcaggaagttactgttaggttcatatcacaggacactgagagaggaggatggaacggcagctctgcaggtggtggcacggacagcgctgctctgctggtaagagacaaggattctcctttgcacagaaagaaccactgggcctaggtgtgcccagctgcacactgtatctgctaacgtctccttggcagtttctgtggtcacaagacaaaacattcactaactaatacaaaggaaacacccaagaccacccctgaacatgactgctgcagtgaggttctgttcccgccaactgctgcccactacagttctctggaatctgcaccatactcaggccaaccagcaaagctccgaaaagctgtcacgggcgacagatggagtccttagtgaccctagcctgggttttatgataaccttggatatcagccagttattattaagagttgtatttatataaatctatacacttcctaaaaataaaatcacctttattaatttatgcagcaacatggatagaactgggggccattatcttaagtgaaacaatgcaaacactgaaagacaaagagcgtgtgtcctccttggcaagtgggagcaaaactacgtgcacacagggacagcggaggactgacagacagggtggagacccagggtgaggtgggtgacgggaggactgagagacagaacagagacccggggaggggtgggtgacgggaggactgagagacatggcagagacccggggcggggtgggtgatggacagggcagagatgacccagggcaggggggatgacgggaggactgatggacagggcagagacaacccagggtggggtggatacaagactgatggacagagtggagacctggggcggggtggatgacgggaggttgcctggtgcgtgcaacgagcatcactccaatgaggggtatgctgaaggccctggcctcacctgagtggagtacatcaaggtagcaaaactgcactcacaccccatgaatacatacaacattttgttaaagtactctaatgtaatctaattaaaaagacaaccaccaagctttcaggcatatgggtaggggatgtaacactgagaggagacacaggtgtgcttccaaggccccacagcctgcaggccgtcctcatctccatgtcacttccgccccagaggcccttccacagggccctgctgtctgcaaagtcaccacctggtagatggctggctctccaccttccccacagacaaggactcaaaagccatcaccaaaaagaaagcagatctgaaagtggaaagcaaactgatttagagaccacatgcgtcctttccaacacgcacctcccaggcggccagctggccggacagcacccagaggcccacacccaagctgacacctgcatgctgactgtgaccaagcacaaagttcaggtgcaattaaaactgcccatcatccagttaaaaatgtcgatttccaaacatcttttccctttaaaagcataaggaaaactgttaacaccatgacacaagctgcaaaactgtgtttacctttctgagcacatgatctagaactcagtgtttagtaccaaatctctcccccaggtgtttggaaataaaagcacacaaacatgtcatcacttcaaagtgatcattataatttctcaactgatcttttaaaattttgtttggttagatgtgtgttttgttttctttagaagaaagcaccaaagaccacattttgggaataaagttaaaatcgtttgcaaagaattaaaaaggaagaaaacaaaaaactttgcatcctcaaatattgcatccatgttgagatgatctcctgtttttttcaatgctaaagtttatccgcattgcaaacactgccagcccggcacaaggcagagccacctgccacccacagaggaggcttaatggccagtgacacctcgcctgtcagctcctttttatagcaaccaaaataacaacaacaaaaaaaaaaaaacaaaaaagggagatggggaggggaggaaaactctacgggattggggtgtgctgagggaggtctgagggctgaggctgagatctaaacaggcaaatgtcatgacagcaaaagcctcttgcaggcacgtctattcacccacggtctgcacagtgagggcccacgctggaatggcctgcgtgtgggttcagccccctgggtgtgtgcaagggaatgcagcagccaggagagggccagacttatggaattacactgccgggtgaaaaacacacgaacagaaaagaacttagttcaggtgaaaagcactgacttccagctgcagctcctggtggttaggacaaacacaggcaatctcggagcttctgcgggttccgttcattccagaacacgctgtgaggtgaagatcgcagtaaggcggatcacaagagctgtctggttttccggtgcatacagaagccatagccacaccatcctgtagtctgttaagtgagcaaccgcattacctctaaaaacgcaatgtgcatttcttaagtaagataaattttaccactaaaaaacactaacagtcatctgagcctttggtaagtcataatctttttgctggtggagggtcctgcctcgatgctgatggctgctgactgataagggtggtggctgctgaaggctggggcaatttcttaaaataggacagcaatggagtctgctatagcaattgatttctccttttacaaaagatttctctaccgcatgtgatgctgtttaaaagcattttactggggccaggcatggtggctcacgcctgtaatcccagcactttgggaggccaaggcaggtggatcatttgaggttagcagtttgagaccagcttggccgatgtggtgaaaccctgtctctactaaaaatgtaaaaattagccaggcatggtggcaggtgcctgtaatcccagctactcgggaggctgaggcagaagaattgtttgaacctgggaggcggaggttgcagtgagccaagatagcaccactgcactatagcctaggcaacagggcaagactcccatcttaaaaaaaaaaaaaaaaaaaaaaaggcattttacccacaattgaacctcaaaactggagtcagtcctctcaaaccctaccactgctttaccactgaagtttatggaatattcaaaatcctttgctgtcatttaaacaatgttcacagcatcttcaccaagagtaccttcccactcaagaaaccactttctttgctcatccataagaagcagttcctcgtccattcaaatttattgtgagattgtagcaattcagtcccatcttcaggatccacttctaatcctagttatcttcctgtttccaccacacctgcagtgactttctccattgaagccttgaacccctcaacgtctctcaaattcctgtgacattttgaccttctcccatgaatcacaagtgttctgaatggcgaccagaatgataaatcctttccagaaggtgctcaattgacgttgccaaggtccatcagaggaatcactatctatggcagctatagccttacaaagtgtattttttaaataataagactcaaaagtcaaaatgactccttgaaccatgggctgcagaatgggggttgtgttaccaggcatgaaaacaccattcatctccttgtacatctccgtcagagcccttaggtgcactgtcaataagcaggacaattttgaaaaaaaagttttttcctgagcagtagcctcaacaataggctcaaaatattcagaaaccatggtgtaaacagatgtgctctcatccagcctttggtgatccatttatagagcacaggcagagtaggtttcacataattcttaagggccctaggattttcagaatggtaaatgagcactggcttcaactgtaagtcaccagctgtactagcccctcacaagagcatcagtctgtccttcgaagccaggcagtgacttctcttctctagctaggaaagttctacgtggcatcttctttaacagaaggctgttttgtctacactgaaaatctgttattaaacatagtcatcttcatcgatgatcccagctggatcttctggagaacttgctgcagcttctccatcagcacttgctgcttcaccttgcactctcatgttatggagacggcttccttccttaaacctcataaaccaacctctgccagcttccagcttttcttccgcagctccctcacctttctaagccctcacagaattgaagagtcagggccctgctctggattaggctttggctaaagggaatgttgtggctggtttaatcaatgcagaccactcaaagttccttcatatcagcattaggattgtgttcttatcattcgtgtgttcactggagtagcagttttactttccttccagaacttttcctttgcattcagaacctggctgtccagtgcaggatgcccagctttcagcctctctgccttcgacacatcttcctcactaagcttcgtcatttccagctttcaagtgagggacacgcaactcttcatttcaacactgagaggctgctatagggatgttaattggcctaatttcaacagtgttgtgtctcactcatgaagtcagaggcattaggagaaggtgagagacgaaggaacggccagttagtggggcagtcggaacacacacgatttatcgactaagttcactgtcttctatgggcaaggttcccagggcctcaaaaccaattataacagttacagcaaaagtcactgaccaccctcatataatcacaatgaaaaagtaagaagtattgtgagaatgaccaaaatgtgagagagaggcaggaagtgagcacgtgctgttggaaaactggcaccaacagacctgctcagccagggctgggctccacagaccttcatttgcaaaaaacatcaatctacggagtgcaatcaaacaaggtgtaagaaatagccaccaaggcacgtgcctgcagtcccagctacttgggaggctgaggcaggggaatcgcttgaacccaggaggtggaggttgcagtgagccgagattgcaccactgcactccagcctgggcaacagagcgagactccgtctcacaaaaaaaaaaaagagagagagagaaatagccaccaacagctgaattcctgtgacacactgaaattttcaaattaagcctttttattatttctaataacaacacatactacaacttcacatttctgctatatgaagtatctaaaattgcttttcatataaatcagtacacgctgggtcactaacaaacagtcaaataaaaacagccacacagttacgccaactaagtactatcatggtaaaattcctgctataatacagagatgccacaacacagagtggaaagaaataagacacatcaaaaggaaaaggtgactggtccttctaaacacgtaggatcaaagccttcagcagctcacagcacggagctccatccccatccagcaaaggtaatgaccacacgtttcaggggacccatttcgctacacttttctttcttacagtgaagcattggaactcaaactccagtctttcaaaaaggcacagaatgcaagtaaaagtatggggattacagtaagaaaaaaaagaaagtggggaaaaatctctcctggaaactggatcacaaaactgggccagttaccttaagcctttagagctacttcttgccttaagaaaacccaatatacagcaattcaccttaactagacagttaattatttacattataaaagacattagattccaacatactatactaaagaatttacgcttagttcctacaagtgaaaatacgccctaagataaaactttgaaaagcacattccacatcatgttaatataaattatgtgagaaagggtatttttagtcacacatgttgaagaaatactgcctctgtttaaggggtatcactaaaaacaccatgcatataactttccagcctacatcaacaagaacagcaaacttcctaagaacacatgtctgacttttgctttcaatgctcaggaaaagaactagtgaaaagaactcaggatcaccctgtaaaaccggcagagctacttcccggatgagcaggcagtcctgcaggcctcaggcccggccctgggccaacattcccacctatcagggtgccaggccctgtgggtctgggcgctaacacgctggacacccatcggaggctcacggatgtccttggcgatgccgtggccactgcagagaagcccccggcgcagagggtccctcagaatgacatggtggcagggaaggcaggggacccagggtgtgctcttacaagtcatgttcagaacgtcccagacaagtgaccaaacggaacacacacacacaacctggccattcctctcaggaactaaacccgcaccccggacctcacccaggtgtgctggggcgcggacgcacatctcaggacctaaaccgcactgcgaggccctcaccctggtgtgctgtggcgcggatgcacagctctacacatttgtaaggatcacgcactctgtaggttttatttgtcgtattggctcgaacctacaaaacccatgccggagacaaaggcaagtgttactaagaagacacctcagatgaaacatttttgtaaaatgactcatttcctgcttttctcattatgaggcacgtctaaaggtttacagctgatctgatgtcaggaaggaagagtttgtgttcaataaaggcgtccacggctccacctgctgaccaagccctcatcctgcatgcgcacagctgagaaaccgccaggccggtgaggggaagctcaatgtccaacagcccagcggactcgccccgacacagcaacaaaattagcgccaaagagagatcttttcaaaacgtatttttggatgtacacatcaacaagatacgctagttcatgataatttgagtaagaaaaaagaaagcgtaaacgatctgagtaagcatggcccgggcaggtctggtccacgttcacctcacccccgtggttcaggtgaatggaagcacagcctacagcctggaagacccatgtgggagaaagggcacacgggaattacacactccaccttactctacccccacacctgattccaataggaagacataaaccctaggaaactgtattcataggtccacattagtaagaactttttcataacacttactacattcttcataagtacagctctctaaaaaactaccattgtttcatgtatccactagctgcaaaaatgtaccacaaattaaccagaatttttttttttctgagacggagtttggagtttcgctcattgcccaggctggagtgcaacggcgtgatctcggctcaccgcaacctccacctcccaagttcaagcgattctcctgcctcagcctcccaagtagctgggattacaggcgtgcgccaccacacctggctaattttgtatttttagtaaagacagagtttctccatgttggtcaagctggtctcaaactcccagcctcaggtgatccccaaagtgctgggattacaggcgtgagccaccgcgcccagcctaagcagatattttaaagatgccaccagcactgacttcacttcacagtcaaatggccaagaccacacggttgcaacagccttagaagcgaaaacatgcacttgcaatcaactctggtgatataaatacaaaaacttttctttttacacaaaacaaaaataaaatcttccagttaaatatggcaactgaacagagacaatacaggactagaagggtcttaaataacacaagaggcaccttgaaggcaccaggagggactgctctggaatgaccccctagagccaaaccctcagcaaaccacctggcctcctcatgcctcagtttctctctctgaactggggtgatgccaggggctccaacagtgcctggcacaaaccagcaactcaccaagccctggctccactgcgtcctcctctggacagaattcttcggcctttccatcctgccctcaaaggggacaggcacagcagggcacactggcctatccctgcaacccccatatcagaagcacataggaagctgccctgctctctagacacaaaactaccctcttcacccaattctcaaagctctgacagatttttgtgctccatacagatgaccagagtcaatgcagtgagagctgctgggtcttcccagcctggggcagggagctgtgccaggatggtggcactcagggccctgcaggttccacggggggggggggcatcacagaagccaaaaccaaagcaaccacagggatcacaaccaccaacaccaacaaagtgcaggtgtctatgctcgctaatactcaaaaaacacagtgccaactaaccagtgtagacagaagtacaaagatccccttctgcaggactcagcgtaacaatgagctgaagccctggaccgaggaaaggtcactggggaattaacatccatagaatagtgtcgcttcgctatttgaaacaggagagcacctctggcaggcagacctgcagacgccatcttaactgcaggagcgcttcagcacaccaatagcacagcagaggggcacttaaaggaagtcataagaaaaatgcagaatgaggggcgttctgcaaaagagcaggcttggattcttcaccaaaaaactcaatatcctaaaaagtaacaaaaaatgggggaaggaccattctagattaaaagaagccaaaggacataatatctaaatgtgatgagagaatcctgattaaatcctagctctaaaaaaagtatcaaagacattttggggagaactgagtaaatttaaatgtggaccagataaaggatgccatagaatttttactaattttcttatttgaacaatggtactgtattaggagaacatccttattcttagaaaatgcatgctggagttttcctttcaaagggctcagccaaagaaaatatacaagtgtgtgttatagacagaggtgtgtacacatctacagagacagcagtgctgcaatacaacaacaggtgaacctaggtgaaggataagtgggcgtgtctgttacagacaggtgtgtacacatgtgtaaatagagacagcagtgctgcaatacaacaacaggcaaacctaggtgaaggggaagtgggcgtgtgtttcagagagaggcgtgtacacatgtgtaaagagagacagcagtgctgcaatacaacaggcgaacctaggtgacagggtagtgcgtgttgtgtgttacagacagtggtgtgtacacatgtgtaaagagagacagcagtgccgcaatacaacaggtgaacctaggtgaagggttagtgggcgtgtgtttcagagagaggtgtgtacacatgtgtaaagagacagcggtgctgcaatacaacaggtgaacctaggtgaagggttagtgggcgtgtgtttcagagagaggtgtgtacacatgtgtaaagagacagcagtgctgcaatacaacaggcgaacctaggtgaagggtttgtgggtacactgtactactctgttggtttttatgtaggcttgaaacttttctaagcaaaaagcttaggaaagcactgcaggcgcaggagtgagaccatcttgctcctcccgtcctctaggcctccgactgcccttccaatgaattctcatgagaaacagcagggcagtcatgcgggcccctctgccccgccctacacagtggtgccaggtggtgggcccaggtccagccagggctttgctgtggggcccctctgcatctggtggacgtcggggagcaccacatccaagctaacatgcatgggaagcagcgctccccgagctgcagcatcttcctcaccaatgagctggcctgcagcggggtcaggcccatgtggcggagctcatgggggcccagctcagcgcctgctgcaccctgatgcagcaacaacacagtgctgcgttcagccactgaccaccgggaggtctgtattactatggctatcgctgacggagctggcagaataaacgctgacctgatgtcaggacggagcagtttaatgcgtgtgatgcccccagaacagacccaggctgccataaagatctctacgcatggtcgtgactgctgcctgctcccgttccagcctcagagtcaaggaattagctttccaatctcaagcttctttttaaaaacgttgtcctggccagacgcgatggctcacacctataatcccagcactttggtaggctgaggcaggcggatcacctgaggttaggagttcaagaccagcccaaccaacatggtgaaaccccacctctactaaaaatacaaaaattaaccaggcatggtggtgggcgcctgtaatcccagctactagggaggctgaggcaggagaatcgcttgaacccgggaggcagaggctgcagtgagccgagatcataccactgcactccagcccgggcgacagaaagagactccgtctattaacaaacaaacaaacaaacaaaaagtcctattttcctttccaacatcttactaacattttgaacattaaatctaaaacttagtaactaacgttaaacatataaaacagattttcatatttggagttcatttataaacctttcaatgcacactgcttatccagacgtcggggtggagagcagcactggtgggaggtagggggagcatggaggagcgaggagcggccgggaagatcccacaggcatggctggcaggagacttgccagtggaccacagtggggcatgatgggggaacggggaacagagattaaaagagaagaaccagggaacactctaggtagacagcccccgtgactgggcagacggtctcatcattgactgagcagggccagactgggggaaggagacggtcacggaaagaactgaagagttctgttaagaccttacacggctgggcgcggtggctcacgcctgtaatcccagcactttgggaggccgagacaggcggatcacgacgtcaggagatcgagaccatcctggctatcacggtgaaaccccatctctactaaaaatacaaaaaactagccaggcgtggtggcaggtgcctctagtcccagctactcgggaggctgaggcaggagaatggcgtgaacccgggaggcggagcttgcagtgagccgagatagcgccactgcactccagcctgggcgacagagcgagactccgtctcagaaaaaaaagaccttacacttgagttgccggagagaaacccaagcagagagggacacactggattgagggtctatgtctgtgtttgcgcgtctatgtgtataccttctcccagaatataccacgcagacacgtgtaataacaaaaactagatggaaaagatccaggagacaccccgtgggtaggagtaacagctcccgcggctcctatggtggcgtggccggcccctgtgctcagctacaggctctggcagccctgctcttctctaaccctctccacccactcccccattctgtctgcattaaacttcttgagagaacttcggagggtgccttctcttaatctcctacatcctttgaaatagccaaaatggagctaaatgtttagaaaaagaatagcagaatttgaaaggtagttatttttttgaaagatagtagagtcggaaatactgaaaattaaggctagaattaagttttcatgtcaacccacagaactttttcatgactaaggacagatgtctaaactaccgcaactcactccgtgtgtccctggaaaacattcaccgagtggatggaggggtccctgaaatcccagaggcggaaagtcgtgtcacgggaggaggtcaccacgagccgctgggtggggtgtgtgcagcagtgcgtcaactcctggtcgtgccctgtaaccaagatggcaaaacacaaggtcatcacctgaggagcacgctgagagagacgcttttcaacagcacaagaacccaagaagccgtctctctgagactgtgaacctgacctaatggaatcactcagcagcatgtgggtcacagtggggcaggttttccctcagaagctgaagtcctttcagccgtccatgtcaaaggaacagaaaaccaaacaggtgcataacccattttctgaccctaccagttagaaggtcaggcaaattaacaggttgaatgtgagaaccacttaaatcttgattctttgcttagaataccttctaatgatacaacgctatgggtcctcagtcaaatacaatctttaacgctcatgcaggaaatgcacttagagatagattcgcagaagcaacttcagcaggcagcatcccaagatggccccaagccacccccaccccgtacatgcctaacacccttcccttcagttagggcagagcctgtaaataggatgagattatctttctggtaattatgatacattataaggcaaaaaggattttgcagatgtaattaaggtccctaaatgagttgactttgacttcatcaaagggaatattgtcctgggtggtctggcctagcccttaaaaagggtcccagaagttggagagttcagagcagcaggggagctccagctgcagaggaaagcggctgctgtgtgggaaaggcaagccctgtgcaggggccccagggccagacacagcctctgcacgcccagaggagccccggctggcagctggcaagaagacagggcctcaaactccagacgcaagaaggagctcctccaatgaccagcaggcttggaagaggaccgcagccttggggaggtcctgaccaggcagcaccctcacttaggtctttgagggcccagggagaagagcagctaccacgggcccagaattactgacctgggaaaccatgaggccgtcaattcctgtcgttttaagacactaagattgtggaaatttgttacagagcaatggaaaactaatacaactaccatatgtccaatatctagatactacatgctacaatttaaaacccctgaagacaaaataaatttagctaccaatagttctattattaatagaaagaatctccaaaaattaccacagaagagccaagaacacagagactcattctggtcaagaagtaagtggcaaggtcagacataacccatggacataaactaacatgcacagccaggaggcggcggactcagagaacccaggcacctgtcagagagtgaacgagctcggacgtctccacgtcgtacaggtttgccgtccggtcccaggaggcagtcacagcctgcttccccccaaccagccagtcggaggcgatgaccacgccctggtggctcttgagggatgtcagtgggacgcggatggtggggcagtcgctggacacatccccatcgaggtcgggctcgtccttgtcagagcactctacttcatcttccccagatatctgctgccaaagggaaggccagaaaagaaagacatttcctggaaatcttgagtttcttctgacatagctacaaaatagatggttctcattaatctcttgaggacatatccatcatgatggtcaccactaggagcctggtgctggccacagtgatgagtatgtcctcctctgacccataactgctgcccgtgaacacccatcaactctacgaccatctcgtacagaaaaaaaagtggaatccacaacattgtcaaccgaactaccatttatttccacgcatcaacagaatggcaaataaaatgattttcaacatttaagctttcatcagttactagtagaaatgcaatataaaactaaccaaatacaaatgaaagtcagtaatttatcacattacaaaaaggcattttcattctcaagagcctatttaaaatatacttggaattctattgctatagtcataagagtctattttcctttgtaacatcaagccccctgtcaaaggccaaggctaaaacaaacacattacagccagctctgtaagaaaatctgtatattcatccaacaaatatttatcagggggtgacagagtgccagtccccacccccagcccaggtgctgcttacacaatgcagaagaggacagacggcttctgacatgcacacatgcaaaactacgctcaatctagcaggtaggaactctggagtgaggacccctggtaaagcccctgccctcagagaacttctgttctagcaaaagagagagaccacacacacacacacccgttagtatggagaggtatgtcatatatacacaagtactagtactggaactgataatttggaaatttgtcccagcccaaatctcatgctgaactggaatcccctgtgttggaggccgggcctggtgggggtgtctggctcatgggggaggattcctcatagcctgatgctgacctcacaatagtgggtgagctctcaagagatctggctgcttggatgtggggcaccccccgcccccgccttactcctgtttccatcacatgacgccttctcccgcttcgccttctgctgtgagtgaaagctccaagctccctgaagcctccccagaagccaagcagatgctggtgccacgcttcctgtacagcctgcagaatcagccaattaaacctcttttctttataaattaccctgtctcaagtattttttatagcaatgcaagaatggcctaacacaggcacgtcatgagcacatatacattactagggaatgcacgtcacagggacgcacagcagcacgggaacgcacgtcacagggacgcacagcggcacgggaacgcacgtcacagggacgcacagcggcacgggatcgcacgtcgcagggacgcacagcagcacggcaacacgtcacatggacacacagccgcacgagaacacgtcacagggacgcacaacagcaagggttcccacgtcacagggacgcacagcagcacgggaacacacgtcacagggacgcacggcagcacggaaacatgtcacatggacgcacagcagcaagggaacgcacgtcacagggacgcacagcagcaagggaaagcacgtcacagggacccagggcagcacgggaacacatatcacatggatgcagagcagcacgggaacacaaatcaacatggagacacagagtaaggtggtagtaacttctatgaagtaaaataaaacaggacaaggggcagctggatgggggcgctatttcacacagaattactgaggagggactctctgatgaggtcgcacgtgagtcggatgtgaggaaaggaaaggttaagtaaggctcgcccgggctgaggaacaacattcccgccatgtgcggaacagctacgggaggcaaagtcgggaacagctcctgtaatcccgggagactggaaaggacaccaggttttattccgtgtgatgcaaaatcaccagacggctgtcggcaggatgtgatgcccggtgtgtgctgtgtgaacaaactgcggagggaacagtggaaggggctgctatgggcagaactgtggacccaaattcctgtgtcgaagtcctcaccccaggacctcagaatggggctgtttggagaaaggggctttaaagagataattaaggtaaaatgagaccaggagagtggatcctattccaataggactgacatccttgtaagaagagatgaggacacagacactcccagagggatgaaggatccaggagaagacgccatctatgagccatggaaagacgcctcaggaggaaccagccctgctcacaccctcatctcgggcttccagcctccaggactgtgggaacacggatctgttgtttagaacacggatctgttgttcagaagtcaccctgcctgtggcactttgttatggcagccccagaaaacaacgggggagacggacaggagatgagagaagtgcagggagggcggcctggagcagggtgggaagaaagaactgaagcgccctctgctgcaggagtggctgacagggtgatttccacaggcagtaagagaacaatacaggcgttcagacggtggaaaggtgtttggtctaaagcactgggtgacagggacgtttcctgagacgggtggcacaaggaaaggaacacccagagacagcaagttcagggtggcacgtgcagctcagtcgggacggggggcccgaggctcacaaggctggcagaggcccccagacaggctgcagcaggggggtactcggtacgtcaccttgaaggcagggggtgatgggtgacagcactgcacgtggctgggaaaacggctctggagggagcacagcaaagagccaggagcagccacggggtgaacccctcaaagaagaaaaagaaggctgaggaagttaaacgagtaactcagtgtaacctaactcacatgtgacagtcattctgttggtctaagtctgtttccactacgccacccaaacgcttccttatcaacactgtggatgtcaagcaaaactcacagatgcaaattttaaaacacaagacgtttgcccaaaagctataatgattcaagatgaacacagattttaacagattagagtttgtgttaaaattgaaaattagaactgctaagcaaatcagagtcaacactggccggcaaaagcttcagaaaacaaaactgctttccacctaaggagcctcatttcatccagtagtgctggaaggagcctcccacgccatttctgcagggacctggccgtccacaggctgcactgcctcctccttattagggagggcccaacacaactgtgtgtgcagtgctcccaggacagctcaagtcacagcacatcacagaggttcatctttaactcagaacccccaacaccagccccaaatcttgaggtggcagctatcaatatgagaagtgcactcacccaacacaagcaaagtagtaaagaagaaaataaaattaagtgaacattctaagtaaactattaggtgtttttaatgtaagtactggacatgaatcttccctctcacaaaattagtgtttttcttattttatttggaaaacaatccatacattaactcctttgaatttcctgagcatcaatgctcaccctcctcacctctccaccacgcccaccatcagtgcacattttgaatttcctgagcatcagtgctcaccctcctcacctctccaccactccaccacgcccgccatcagcgcacattttgaatttcctgagcatcaatgctcaccctcctcacctctccaccatgcccgccattagtgcacattttgaatttcctaagcatcaatgctcaccctcctcacgtctccgccacaccatcagtgcacacgctgaatttcctaagcatcaatgctcaccctcctcacctctccaccacgcccaccatcagcacacatttcacttgtttcatcactaaatgtgcgtgttagtggacagtgttatgcgctacataatgaatagtctggcaattccacaaagagaacaaaactgtgttaatacacaatacatgcagttaaaaatgaactatgataacctctattaggactaaagaaaactcatttatcactggaatttattaactgcttaactatctccacatagaacagtgtttagaatgttcacaaagcagaaaactcaaggaatattccaagatgaaaatatcaaaactagattactttcatccttgcaacaatcacagcccaatacaaactgaaacttctagacgtggacgtcatttacactgtctgcctggcactgttcccacctgttcaggcaccgaactgggggggctgagcacgtgggaagatcacgccactaacatttatcctgtcattgaaactagggagataactgctctcagagaaacattcaggcctctttgtgatcataaacatagggcactgggctactgcagagagcacaaggcaaacagtaagtgaagaattttatgaatttatggtataaatacatgaattcattcttctcaatacacatcttttgttacctacgtttaaatgtgaaccacataaaattgatgtcataaaggccattagttgatgtgatgataaacgtccatgaaagatacaccagatgtctaatattaaacagatgaaacagtgagaaacaggatccaaacatcaactgtaagagagtggacggtaaatgtttactgtctgttgaaaggaaggatggagcagatgcatgcatacagaggtgaaggagcatctttctaggcactgtctcattcaacgcaggctgccaaaacacaagactacaggccaaaaggcttcaaaaacagaaattagtcatcttccagttctggagactctaagtccatgaccaacgtgtcaaccagtgcagcttctggtgagtcccctcttccggtgtgtggcaccgccatcctgccgcgtgcccacaggggctcttctattaatattagcacagagaggctgggcacggtggctcacgcctgtaatcccagcactttgggaggccgaggagggcggatcacgaggtcaagagattgagaccgtctggcgaacgtggtgaaaccccatctctactaaaaatacaaaaattagttgggtgtggtgacacgcatctgtggtcccagctactcgggaggctgaggcaggagaatcccttgaacccgggaggtggaggttgcagtgagccaagatcacgccactgcactccagcctgggcaacagagcgagactccatctcaaaaaaaaaaaaaaaaaaacggacagatggggagggggtagaaagagagcgtgcacacacaagggcagccataagggtgagctgtctggtgtctcttctgacaaggacacactcatcctatgggatcagggcatcccctccactacctcattttgctttaaccactttctcagaggccccatctccaaatacagccacactgggggttagggcttcaacacagatttctgggggacggagacattcagttgagaacatcctgtccctggcctcccccaaattcatatccttcttgcatggcaaatacagtcatcccatcccaacagccccagaagtcttattccagcatcagcgctaaggtgtgaagtcccaagtctcaacaaaacatcacctgaatcaggactgggtgggactcagagtgcgattcgcccaccctgaagctgagctcccctccagccgtaaaccacggaacccaaacaagttacatgttcccaaaatacaacagtagggcaggcactggacagacgctccctttccaaaagagagaaagaggcaacagggaaagggtggtggggcccaagcaagtccaaaaccccacaaggcaaactccacgagctcttcaggctccagagagtccctcttggtctggatgcgccaccctccaggcatgctggggcagaggtgtcacccccttggctcagcctggcaaccccacccccacagcactggaccatgggcaacctggccctgaaaccaaggaggctcccacacttcgaaaccaaggaagaaacaggctcttgtcctgggactgcagtgagagctgcagccctgccaacctcagaatcaccttcggggcattcttccctcatcttgaagggtggtaaaggttctcgcccaggcagctctggtttctgtgctgtggaatcccagcagtctgatgccttccttcattctgtccccaccatgtcccctctggttcaagctggcggggtctctgggtataatcccatctccagtcctggatcctgctgcggtgggtgcttaaagctgtggctcccacccacactcgcctccctgtcaactggctgttcagacaaaccctgcatgtgctcttcggaaccagctttctcttttttttgtcacagacacaggctgggaatttcccaaatcttacaagttctcgtcccctttcccttaacaactctttcggagtatctccgtcctttcacactttattgtaagcgaggagagcagccaggctgcacctttaacatttcattcacaggatctcagctcagccaagtcctcagccattttgtaatgaggatcactttcttccggttccccgtgacctgtccctcgcctcctctaagcctcagcagaaaggccttcaacatccacttttccacaacattctgtctatgatacctgcattctctgagatgctagaagctttctctccagctctcccctttcctctctgagccttcacccgagtccccattgatgtccgtatttctaccaacaagctcttcgccgctatggaggctttctccagcaggtccctgaaaacgtctgcagcatgtacccattcccggtcccgaagccaggtccacaccgtcggcatttctccagcagcccccgctctgcgcgcggtactgaaatctgtctcagttggctctggctgccgcaacaaaaggccgcagaccgggcgacgcataaaaaacagacatttattttctcacagtgctggaggctggaagtccaagatcaagccaattcaggttctggtgcgggctcatccttaaagacggccgccctctggctctgctcttacgtgacacggagagtgacagagagattgagaacacaggtgagctctccactgtctcctcttatgaggacctcacgcaacctcactgaaccttaactactaccttagaggcccaatctccaaattcaaccataccgggggtgaggccttcaacactgaacttggggggacacaaacattccgtccatgacagatatcataaatggattctcagattcgcagacatcagcatcctacacattcacaggtaaggaaaggtgcttacactagtgtcagcaacaggctggggtgtcggcagctgcaccgcgtatctccagatatgagcagtctgatctccagaagctgaagagagaaatcggggaaaattacccaaggcacagaccatggtaaaatgcgctcttcaccgccactatggctaagcagcagcagtcagacctttccagcttagtgaccacttagtgagaggaatgtactttttacttaaataactcttttctgagactgcataatgctattgaaaatagagtacatgtccaaaattgaggaaataatgattacttataaaactatttcacctttcattttagcatagaaagtcctggaagttcagagaaaatgtacaaatagtagattttcctctccatctatctaacctaagaaaccctatcatatcagaacttacagctgcaatcaactctgagacgttcgggaaagcgacactcatctccatccattcaacacacacgcggcctttcaatgggccaggcacctatcagcactgctcatgtgtgcggctcccgtcccactctgttttcagcagccagtttgcgaggaaacgctttgactgaggattggaaagacaaaaggacagcactgcggggcacagaacaggcctcggacaccagcatggccacctctcacccacacacgggcaggctggcttccaccttctcttcactgccacccagcttctctaaaggagctgctctgagctgatgcagcacatttgatgcaaatgaatgtactgcccggacttgcaactcctcctcaaatcaacatcatgcccaatcccagtctaactctcctctctccatgcccgttacctcacgtttcccctctaactctcctctctccatgcctgttacctcacgtttcccagtctaactctcctctctatccccattacctcacattcccagtctaactctctcctctctatgcccattacctccagtttccaagtctaactctcccctctccatgcccattacctcacgtttccaagtctaactctcctctctccatgctcgtcacctcacatttcccagtctaactctcccctctccatgttcattacctcatctttcccagtctaaccctcctctctccatgcccattacctcacgtttccaagtctaaccctcctctctccatgcccattacctcacgtttcccagtctaactctcctctctatacccattacctcatgtttcccagtctaaccctcctcgctatccccatcacctcacgtttctcagtctaactctcccttctctatgcccattacctcctgtttccaagtctaactctcctctctccatgttcattacctcatgtttcccagtgtaactctcctctctatccccattatctcacatttcctaatctaactctcccctctctatgtccattacctcacgtttccaagtctaactctcctctctatccccattacctcatgtttcctagtctaactctcccctctctatgtccattacctcatgtttccaagtcttcatcagttcctggatgtgtctggttccaccctcttttccagccctttggtttgaatctggacacgtctaattgccaccagtctccttgctcccttttcaatcatcccacaaaccgccaacttcgtaaggtgtaaactccttgtctgctttagtcttcatccacgtatgaaggtgaaagtcagctatgtggtctgggcctgctcaaaatgactctcaggctaaccctcccaccacatttctctctcacatagaaactccaaccaaaccgcatgactcgctgcatcccacacactggaagtacctgttgctggggctccttcttaaacaactccacctgcatgaaggggccagtcatctcaacctcagtgttctattcctgcgtcagcacaatttggcccataggcgaaacccagacagccgcccacttttgtgaataagtggacacagccatgtccactcatcagtgcactgtccgctgcttttaggctgcaagagcagaactcagtactggcgacagagcctgaatgtcccgcaaagatgaaaatattcactgcttactcctttacagaaaaatcataaggacctctggtctactgaaagcctacacacatccttcgagatcatcaccaatgtccctgggctatcatggggatctgtgggggtctgacaatctcacaggaaaagtcctcagtactgtaaggctaccctcgaaaaagcgaccaaggaaggcacgtttttaaaactactctgaaattatagcaaatccaagctaccacgggttagataaattacccagaaagaagtaaaaatgctgacattggcaacttgctgtgtctctgtgctacttttctcttttcctccatatcagatgcctacaatctaagggaacagaatggtaaccacagggcctcaaggagctccgtctacaggaactgcggggggagcagcaaacatactgatgctgtacggaaaggcttcgagaagaccgtgaagccatcttcatctcacaataaatccaactgcttatccactactgtctctagaaagtactgctcaatgtattttcctttatccatttctcatttaattcataaaatgtctactaaagattaactttcataaaagccatggattattctgctacgataagaaaggaatatttatagttgttttaagaccatctatcattttgttcaataaagaaaaaaatcaacataccagtgagagccaactgctctgagggatgaaatttgatagaatttactgcaaaataaaaatatgataaaaacaggtttaaagtgacaaaaacatgttatcaacatttattagctatagcgtgtatttcaaagtcaacattaaaagaactatgagttcaatatttgatcctccactcagttaagttataaataaatgtgtgaattagaacacaggcacaataaaaacaactaaggtatgaaccaccaaatcgctatagtttaggaccccaggaaaaggatattcatcatctagttctttttatagacaaagatgtcatttttagctaaaaataaatcaggattaaaaaaaagaaaacataattatgacaacgggtgaagacaaattatagtgtggcagacacaatttattaccataagccccgccccatccgccttccttcccagcctaaggaccccagtctgttctgtgactagtagagacgccaggaccccagagagtataacctctgccagcctcagagaatgaatcaggactgggttacacagtctatgatgtcctcccactttccttacaaaaggggtatttggcagaggtcttcttttttttttttttttttttttttttgtgagatagggtcttgctctggttgcctaggctggaatgcaatggcacgatctcagctcactacagctttgaccttcaaggctcaggtgatcctcctaccttagcctcccaagtagctgggacacaagaatgtaccaccacacctgactagtttggggtttctttgtatttttagtagagacagggtcttgccatttttagtaaagacagggtcgggccagacgcactggctcacgcctgtaataccagcactttgggaggccgaggcgggcagatcacgaggtcaggagatcgagaccatggtgaaaccccgtctctactaaaaatacaaaaaattagatgggcactgtggcaggcgcctgtagtcccagctacttgggaggctgaggcaggagaatggcatgaacccaggggggcagagcttgcagtgagccaagatccgcgagccactgcactccagcctgggcgacagagcgagattccgtctcaaaaaaaaagagggtcttttgtatttttagtagagacacggtcttttgtatttttagtagagaccgggtcttgccatgtcgtccaggctggtctcaaactcctgcctacctcggcctcccaaagtgctgggattacaggcgtgagccaccgcacccagccagaggtctgaggaagctatcattttctttttttttttttttttttgagacggagtctcgctgtgtctcccaggttggagtgcagtggcgcgatctcagctcactgcaagctccgcctcccaggttcatgccattctcctgcctcagcctcccaagtagctgggaccacaggcgcccgccaacacgcccggctaattttttctatttttagtagaaacggggtttcaccgtgttagccaagatggtctcaatctcctgacctcgtgatccgcccgtctcggcctcccaaagtgctaggattacaggcgtgagccaccgcgcccggcctatcattttcttgaaaaaggagcaggagaccctggcacttcaccttcccccttgctcctgtcttgaatgtagacagaatagcttgacatgtggtcagcaagaccacaagcacgcacataaatgccagcattgaacacagagcccggctccacaggcctgacctagtctggagcccacactgcccacctgggatgttcccaaagcaaacgacaggaattgggatggggtgagctaccatcagtcagcaccagtcagcagagcaaagagctgactcctgtcactctggggacaccaacccttatttccaccccttgtgaagaaaatgcatgtccctaacgtagaacatataggaaatttgaccaaatctgaataggttatctccttaacaaaatgttggtagctataccattagaattatatttttctaaggaactaaatgaaaaatgctagaagatagcctcattattaatattaaaatacagataactgtgggaaaaactggtggaaaccgtgtacacttataagcaataaacttaagcactcaatggagctaaaaccaaacgatcactagacccactaacaaatagtattaatgcttccaatttcgatgagaaattttggtaagatcaatcatcaattttcactttattatgtctatcccaaccctcagctaatcacaaacgaagctgggccactgtgaggtgtgggtggaaggcaccacaccacagaaggaggggtagggcaggcaggcacatggtgacgggagctgtggaggcagttgcttcgcagcactgctcacccactcaaaatagtgtgaaaactgacccctgatcttacaaaatcggcacagaatcatgttggggttaggatgaaaaccacgcctgtataacgaggccctcgagagagctcaatcacccccggtcaccttccatagtggacggtcaacaggccggctggagcaggaaggccggggcagcacgtgagccatgatttaaaggcgcagcagcagaatccatgggcacctgacccaatccacagtggccacgaggggagcagaaacggggatgccagccacggctacccttcatccagtgtcaaaggcactggctccttccatcacgtgcacatttaactgtcataaaatttaagctgaaatctaaagagagaagaacaaaggggacaacaacctctgccaccagtgtcacctctgcctctgagaggcgcagacacagtgaaactgggaccctcacccattttcctctcctgggggccagagcggggagtctgctgttgggcattgtgctcagaggacccaagaggaaagaggcagagtgtgattcagggtcaagaccatctccttgtagagttgtactgattcaactcccaccagccccaccactccctttagttaggtcaacttaagagatcaaaacatctccaggccgggcacggtggctcacacctataatcccaacattttgggaggccgaggcggctggatcacctgaagtcaggagttcaagaccagcttgaccaacatggtgaaaccccacgtctactaaaaatacaaaacttagctgggcgtggtggcatgtgcctgtactcccagctactcgggaggccgaagcaggagaatcctttgaaccagggatgcggaagttgcagtgagccgagatcctaccactgcactccagcctggtgacacagcaaaactccatctcaaaaaataaattaattaaaaataaattttaaaaaaatacaaaatttagccaggcgtggtggcgggcacctataatcccagctactcgggaggctgaagcaggagaatcgtttcaacgtgggaggcggaggttgcagcaaatgaagattgcaccactgcacttcagcctgggtgacatagtgagactccgtctcaaaaaaagaaaaatcccctagtggaaaaacacaaacacaagtccccaggaggaagaggagagacacacgcaacacgacaacgtgccagaaacacaggcgtcttctcccctctctgacacctctctaaatgcagaaggcatcctggaagaaacaggaacagacccacaaagaaagaactaaagagacgatgagcgaagagacgacaccgaatactggaggccagaagagcagatggtgacggtgagtgagtgaacacaggaaggttgaattgcgggtgagcacgggaaggccgaactgcgggtgagcacgggaaggccgaactgcgggtgagcacgggaaggctgaattgtgggtgagcatgggaaggttgaattgtgggtgagcacgggaaggctgaattaacctgcgtgaagaacggaaagccaataaaaaacacaagccaggcacaagaacaggaagagacttcttcctgctgggacaaggcagcctctgtggatccactcagaccccctagtggaattaattataaaagctgcagataaacagcaaaaaataaacacaaggcttgaagtcatcatggaagccctgaggcccccaggcccagaggccccagagggaagcactggaagccccactagctgacgcactccctcaaggcacagagaccagccggagcgagggtgcagtccagacgtgagcggccgtgacaggaactgaggctggatccctcagaagaggcagccaggaaggagcgggccagctgctcgcctcccccaggcactgacagcacctaaactgggcatgagggcggacaccaagcagaaagcagcctctaagagctaacacggagaggactggcagatgaaactaaagctcagggcctgtgaagacacacccttgaaggacaactcccttagaacaagggaaagcgagaggaacagcagaacccctaaagcctgaaacccaccggccaccaacccttaagtcaatcaaggcttgccgtccactctatctgctggccaagggaaaattaaatcccctctagagaacagaaatgactatgcgtgtatgtacacgtctatgtgtggatgcaggcataccccgttttattacccttcactttactgtgctttgtaggtactggattttttacaaattgagggtttgtggcaaccctgcgttgaacacctaattgccacgattttcccaacagcatgtgttcacttcacgtctctgtgacacacgctggtaattcttgcaatatttcaaactttttctttttttttttttaatttctttttgccagcaccttgaccttggatttttgcattattattatgtctgttaatagtgacctgtgatctctgatgctaccattgtcattttggggagaggcacaaaccacacccacataagaccacaaacttactcaataaatgttgtgggagttatgactgctccaccaaccagcctttctctcatctctccctctgctcaggcctctctactccgagacaaaacaatactaaaattaggccaattcataaccctacaatggcctctaagtattccaatgcaaggaagagttgcacattgctccctttaaatcaaaagctagaaatgattaagcttagtgaggaaggcaagtcaaaagctgagacaggctgaaagctgggcatcttgcaccaaacagccaacttctgaatgcaaaggaaaagttctcgaaggaaagtaagagcactattccagtgaacacacaaatgacaagaacgccgatacacaggaagtttgagtggtggggactgattaaaccagccacaacattccctttagctgcagcctaattcagagcagggccctgactctcaattccctgagggctgtgagaggtgagggagctgcggaagaaaagctggaagctggcagagagttgtttatgaggtttaagacaccgtctccacaacataaaagtacaaggtgaaacagcaagtgctgatggagaagctgcagcaagttctccagaagatccagctgagctcattggtgaagatggttactctaaacaacaggttttgaatgcaaacaaacagccttatattggaagaatatgctgtctagtactttcctagctagaaaggagacatccatgccttcgaaacttcaagggacaggctgactcttgttaggggcgaatgcggctggtgactttcagctgaagtcaatgctcacttgccatttcaaaaatcccagggcccttaagaattacgctacatctcctctacctgtcctccataaatggaacaacaaagcatggatgacagtacatctgatgacagcattgttgactgagtattttaagcctaccattaagacctacacctatcataatacaactggctcattgacaacgcacctgctcacctaagagctctgatggagatgtacaagatgaatgctgatttcatgcctactaacacaacatccattctgtagcccagggatcaaggagtcatttcgattttcaagtcttaagtttttaacctatgcacatatatttaatttttttaacgtttctgaagaggaaatttgaaggaggaaacagaatacagcactcgttcctgtaacagcgttttgctctacatttgagcaccaatcacacacacgccaggcactgctagaaaactgcaggtgacactgtggcaccccagccagtctgtgggatgccaggggaggaagacaggtaagaaggcagcacggaggagggggtctaacacgggaaaggcgccagcctgtctacacactaaggggaaatgtccagggcaagaaagagaagacactgtgacagcaggaatggccaaaggagaggaggtcctgggaaaggggaggggaaggctccacagctcatcagggccctgtggacgggcagacaggcgctcagagccacgggccccacccacacctgtccctctgtgcacacaggcgatgccacctctcagcctggcagcgtggaggtgtgagggagggcgagtgagcaagtgaagagggcactgcgggggaaggaaccacacagcacgtgcgagaggaaacagaaacaaagtctggtcaggaaactggtacacacacagctctaagtgaaaaggcagaaaagagctacgtgaacagcgttaactaactacatggacagcgttaactacgtggacagcattcactccgtggacagcattaactacgggcacgcaagcacattcatggagtatcctttattgaatacatccaagttatcactacatcaaaagtaaacctctaaaacagatatgtattttgtgaaaaataacgcacacatttcagttacaaaatttcctacatatgggttatatacaatattaaataaaatgcagactaacatgatatgtacattgtttagggagttaagcttttccctgttattgagcccatacaagctcaagacagagttatcccagtctctgaacagaccacactgtcccctgacaaccgaaacagtaaggcttcctacacagtagcagctggctttatcatgcacgattttaaaaacacactggagaaggcaacggcctctggctacggcactccttaggcagtgcttacctgagcccacgtggcctgcgtacttgactaggcacttccctgtctctatgctccacagcaaagccgtgtgatctgcaagatggaaatgaagaagtcggaacttagctatcatcagtttatagtttttcaaatgaaagaataagacaaatactctaaaaatgggaaattacacgaccactgatatctcttccacctttgattctattactctgtatgcttcaattgatcaaagaaaacatttcccaaatgggagaagctgtgacctgtctgaggccatgaagtcagctaacggacaaccagagactcgatttcctactttactatcaggctggctgcatcatgctggaaaatgacagacagaggtcgttcccatcacagtttcattattttattaaagtattaaaatgttccagaacatctcccagagttcaaattcaaacagcatccaaatccagttacaactgttgagataagcatgtctttggatctttgggtctttctcttatagccattatttttttaagtagatttaatgggaaaatctgagaaataagcaccaattagccaaatgaaatttcggaaatatcagaaaggacctttttattctttttttaaaactatgatttccaaagcaatccaaggcgctcatccatgaaaacagtttcaaaggagaagcaagaactttcttcgctattcaaatggtttatcacattcacttctgcctctaaaaagcagagtccagtgagtgattaacgtctcacaagctgggacggcattttcaatgagcatcatttgtaatttgagcaatttttatctcaaggggtattatgccaccttagatagctttcataaaatatctttttttagagaaaacaaagggtcactttccacactctgcccctgtgattctgtgggcaaacatctgctgggggaggccatcagcctccactgctggctacgtgcccaggtagtgttcactttcagtgagtaccaaactactgtccctcaactgcactccacttgtgggaaaaaagtcaaatacatccacaaatcagaaacacacttggctgtggataagaaaaagagggccaggcacgatggctcacgcctgtaatcccaacactttgggagcccaaggcaggcagatcacaaggtcaggagatcaagaccatcctagctaaacggtgaaaccccgcctctactaaaaatacaaaaaaaaaaaaaaattagccaggcgtggtggcgggcgcctgtagtcccagctactgggaaggctgaggcaggagaatcgcttgaacgcaggaggtggcagaggttgcagtgagccgagattgcgccactgcactccagcctgggcaacagagcgagactccgtctcaaataagaaaaagaaaacaaataattggaatactgattcctcaacacatttaagttaaatccattccaaacaagtatttctttcctcagatacttggttcactgtgagttgcaacgccctacccacggggacctggaaaagacagggtgcagatgcacatctattcatgggagcatggaatgcaggatgcagctggacacccacccacgggaccacaaaatgcaaggtgcagctgcacaccctcccacaagaccacggaatgcaggacttcaggccacaacactaagcatcaccaagggttaatgtgtggggggttccactgactcctccatgacgcttttgcatctagggttcctctgccacagaaaagtgaatgtccatcactcagggattaagcacagccatgcttccgcaggctggccaggtccgtgtgcgactcaccggctgatgcagtcccgagcaccactggctgtgtcttggccacgctgacatcccagatgccgtcccggtggccgatgtactccttcacgagctggcaggcagctctcgatgtcgtggtcttaaagctggagacaatctgaaaccaagatggggagtcttgtgaaacaatttactgaagtaaatttttctaagtcaagaaagagaaaacgaaaaagacgtcttggaaaatgcacaaatcactgactaggacagttaaagcatcaaggaacacagcgcaagtgtgagctgaaacgccctgcgtggaaagggtggcgggttcagctcatatcacagagaatgcgtgcagctctcgcggcgacctgtgcaggctcccccacctcagtctgacagccaggcatggaaggtctcactgcagaagggtggatttaggtgtttcaggtcctctcccccaaacccaaaccatgagacaaaatttccaaattcttaaacaaatcgttagctagccactcagatacaaaaaagtcaggaaggacatcccaaacccttaactttagctaatgacactgatcgctgtacatgttcacattttgctgtttttgagaatttacaccaaccacgtatcatcaagtgtaaaaaaagcctgtggtggggaggaatcaaaagacgacactaataggtgtgccggtttgcccgagacttggcgctcgctcagaacaggcaccagctatgaggatgcagggcagcgcggccgtaggcccctggccttttggacatgctcagcccagcaggagacaacgcgaacacatcacggaccacagaaaggcatcgtctcgaatgacgacacacacagcagacagttctcatgccctcttgtcaggaaaaatatgaagtgagtgaggaagaaactaattcaacacaacgatttctgcagagtttgctttttaaatttttctttggtaagaaaacagctgtccagctgttaagtaaatcagaataatgtagacttttcagaataaaacaaaaaaactaagtgaagaactaaaatcagtggcattacacaacttgtttcaaacactgatttggcatagccctgaaaaacacatctaaattcattcttcctaagaccataaagcacaacccactgtcacatggatttgggtccgcaccctcgagttattctcctcggatacagtgatataaaaggctgaggaagaggccaacattttcaccagtaacaggaagaacttccactgcaactggtcagaggaattgcaaaagcacttgttcaacctcaaacccatcattatcctcttttctttctgaacactaatatcctattcaatccaggaaaattatgcctccacaacatgggagatgcttttgcttacagaaagtgtcattcagatgttaaataacattgtaacattttaggagggagtgaaattaaaggacacacacaacctcccaccataataagcggtggtaaatttcactttccaagtctctcaccatttctaacattaataaccgtattgtagtaaatttcattttccaggcctctcaccatttctaacataagtaacagtattgtcgtaaatttcattttccaaatctctcaccacttctaacattaataacagtattataagaaacaaactactagagttacattcttcacctgctccattcgcagggtaagaacagagtggctccttcccagaggctctgactgcactgctgctggagctgtgctgctggagctgtgctgctggagctgtgcaggggatcatgtgccgttttcaaatattttctcatgtgttgcttccaaaatgcccactgcactttgaccatctattaccttaactctttttccttagaaaagctgacttagtcgtcattaccaagaggcccaacaaaacagactgaattacctagagggaacgttcataacagaaaagcagcagaacaaagccgcaaactgacgctcacgcccatcatcccagatcgtttgaactgcggcgcaatctaaagcacggttgtgaaaatgtttgcaaatatttttgagaagataagtgtctttctttgtggaaaaagccctttctgatttttataagtttctttaaagagggctgcaggttagacttcctcacttccctcccccgtaggcatcagaaatctcattagccacccaggaaggggaaaaacctcttctgcgttcacgtaacacacttttgtgttcccgctatcccaccaggcacgttacttgcttttcgtggctctgggtcagaaggagggaaagtaataaagctagactgtagcctttctcttgttgcattcatgcttagctttggcaccaagaatccacactgtagtacgaatcagaatatattctgttaccaaattatttcttcaatcttcagatgtcttatattttcatagttattttttacaatgggtatgggcagtgtgcaaaggctataaagatcattagtaatatgcttcttataaattcagatgaatttctagtacctaaaatgactgggctttaaatatctctaatacattttttaaagcaaagcattactatacatatccttacccttgtccaaatcttattttttactgctcatggtaaaggacaactttatataatcatttcttcctctacttcagtaataatgagaaagttttggaattccaagaccatacattgtatatatacaactgtacacaccagaaaaaacaacataatccaagataatgtaaaaagaaattaaatgaggaagaacataatttcacacttcattatgaagaaaaagcttcaagttaatttattaaaaagttcaaaacttgtaagtataagctagacattacatggccaaaaaaaaaatcaaataaattagcaacttacattctagatgttatcgaaggaaagtacagtagaaaataccaacaatttcagattttcttttgaataacaaagaattaccaaagactatcaagtgaggacaaacggcagaaggactaaatttgctctattaattgcagttaatcttactatagatgtcatgctaaattaactttaaactcaaggaaacaaattggaaaaataaaaagctaacaagaactacttacaccatcatagcaagatcactgaaaatttcaatttatctttgtatccttgaaatatgccaaagtacagatgcatacaaaattacctcaaaatatcacttgatagtaatccatcacagacaaatgaattcccaaacaattaaaccctttccactttaagaaggtcagcacgagatactttaagaaaatacaaaaaccatgaacatccctatttgccttagagacagaccttcacttcctgatcacacttaggaaactgaggaaaagaacataatgaactaaaatgtaactttagctcagaacataattttcactaatttgtacctatttattagcttcctccaaattcagaccctttatattaagccaattaacaagagaaattatatattccctctaaagacaatatatttactaatacatcatatattaatccctgtaggtactagggtaagctactatgtaaatgcctgcatagtgacattcttttttttttttttggagtcggaatctcgctctgttgcccaggctagagtgcggtggtgtaagctcggctcactgcaacctccacctcccaggcttaagcaattctcatgcctcagcctctcaagtagctgggattacaggcacccgccaccacacccagctaatttttgtatttttagtagagacagggtttcaccatgttgtccaagctggtctcaaactcctgacctcaagtgatccatccacctcagcctcccaaagtgctgggattacaagcatgagccaccatgcccagccaggacattcctttaaaaaactaaatttcccttaaaaccatttatctttttctgctatgcctttctaattggaaaataaacaacttaaagtacacatctgcacaccttaaccaccacatgatggctcaagagccagtggcctgcataccttgctggtggaagccttgtaagtggtcttcagtttctgggagagctggctggtgctgtgactggctgcagggacagagagtgacaatcaaacacaatcacacaatcaaagacctatagcctcacaaatgggtcttgtgtcttgcacaggaagaaagggggcccagaaaggctcgtttgaccctagtgacacagagccatggcagaacaggaacaagaaccgagctccttattctcctagacccacacctgaattagatagttcgaggtctgctgacagcaaaacgcaaaccagccagcatccttcactaaattccaaatttcctgcatgtataatctgcaggacaagactttcatgggattcaccttaccttttgttttgagttggcccttactcagctctgctccatcaatcgcttgtccttcagcagctaaacgttcattaagagtgtcgatttctctacgtactgggaagaaaaaagttttcaaaaatctaaagtatgtttttatgtttaagtgtactcaccacttccaaaactcgcacacagaaaaaatgctatatattagtgttatataaacaaagacatgaataatattctaataagcaagatcacaattcatagagttctcaaaaaactaaagaaaccattcgaggctgggtgaggtggctcacgtctgtaatcccagcactttgggaggccaaggcaggtggatcacgaggtcaggagtttgagaccagcctgaccaacagggtgtctctactgaaaatacaaaaaatagccgggcgtggtggtgcatgcctgtaatcccagctactcaggaggctgaggcaggagaattgcttgaacccgggaggcagagattgcagtgagccgagatcacgccacagcactccagcctggacaacagagtgacactccatctcaaaaaaaaaaagaaagaaagaaaccattagagataccattccaaaagtaaaagctcacacacttgctacactgtggaagacactgctatcagggtctcaaagacagcacccgcatttcaacatagtttccatagtgattgattctgcacgattaaaaacattattctgggctgggcacagtatctcatgcctgtaatcccaacaattttggaggccgaggcaggcagatcacttgaggccaggggttcaagaccagcctggccaacatggcaaaaccccttctctactaaaaatacaaaaattagccaggcatggtggtgggtgcctgtgatcccagctacttgggaggctgaggcatgagaatcgcttgaacttgggaggcggaggttgcagtgagcccagatcacgccactgcactccagcctaggtgacagagcaagattttgtctcaaaaaaaaaaacaaaaaagttgaaatgatttttccctctatgaattgtaaaggtggactctttaaaaaggagaatccagtattaacattaaaatttccaaaagcaaagtttaaatgacagaggattatattctcttcattattcatccaaccacaccacttagttacagagtgaaaaacagcttaacaatggaaatgctctttgttagtattcaacctttggaatcaacctgtagataaagcatgaaagacttgattgtagttacatttgtctagtacaaattttatagtttgggtgtggtggctcacacctataatcccagcactttgggaggccaaggtgggaagaccacttaagcccaggggtttgagaccagcctgggcaacacagtgagaccctgtctttatatatataaattttacaaacacaaaccctgaaggagaaaaactggaaagtaatagagcagcgcaaaggacctgtttatttcactgtgaagcattaacactaaagcggatagatctaaaaccagaagatgattacttacattcacaggactaaccaccaaaagaaccaaaagcaaaaacatgcagaaaatgtcttcctttgaagagtgcgatgggcttgaggggtaatggtagatttctttttatactgtctgataaatttttaagcacatatggccattacttccaaaataaaaaaaagataaattaaagccaagctaattcaaaattgttttgatttgtctttaataagtcagatatagtatatgcatcaattttcaaatgatggtatattaataaaaaagtaaatcaatgttttctcaatttatggtgtacttggtgtagggaaaatgataagatccatgtattttttattttttatttttatttatttacttttgagacggagtcctcgtgggaattataccagacccacagaactgcaagatgacaaatctgtgttagtttaagccactaaaataagtttaagtttgctacagcagaacagaaaactaatatagtgatgaatgtctattcataaatttgactatggataggtaaagctataaaagtatattaaaataggagatactcacattctaagttttcgatataaaggttttcaaattctctttctatttgaccaaacagttccagaagtgtactgcgaaccgaggaaggcagtttagaatcctgcagaagaagactttgtttaaaatgaatgaatgaatgaaaaactctaagtacaaatatgctttttccaaagtgaattatcttttattgtaaactcttattttgtattattacatatttttatatataaaatgcttaaagagtttaaagttccaaatttctgccaaggagactataaatcaaattgtataaatggctacctagtatgatatgggatttgaaaataaacactccttcaaaataacacaatttttccctttacaagagaggacataagcctaccttattttaaaacttccaaatttggagagaaaggcggcagctcccataaatgaactattataaacagcctctgagtgccatcatacgctatcctacaagtattttaatctgctagaccctcatggaagaggcacctttgcagagttcccgccacacccactgcactttaagcaaaagcacagtcactctcccatcactcgacataacacctaaaagagtgttgtgaagaggaaaaaaagaaaaatttcacaaaaaagagccaaatgtctattaattgagtgaaaacattaactttttatttcctgcccaggccacgctcttcatgcctgtgtgtttcccgcacccctgggaaggcgaagggaaggagctacattgtcaagtgtggtccagcaagtaagcaggtcctgagcaccaaacatatcacaggcactcactgcttggacccaccagtcaacaggagcctgctagatacagccatgtgccactccaacctccctgagggcatggcctatgcactatttggtatgtgtcccctactcccaacacccagagtaattttcaaaaaaatccccatcaaatatttctaaaatagtgtttcaatacttaccttttttttttttttttcgagacagagtctcgctctgtcacccaggctggagtgcaatggtgtggtctcggctcactgcaagctccgcctcccaggttcaagcaattctcctgccacagcctccccagtagctgggactataggcgtgcgccaccacacatgctggccaggatggtgtcaatctcctgacctcatgatccgcccgcctcagcctcccaaagtgctggaattacaggcgtgagccactgtgcctggctgatacttaatgggacttttcaaatttacatatagcataaacttttttattctgatgagtcgtaaacttttttttttttttttgagatggagtctcgctctgtcacccaggctggagtgcagtggcgcgatcttggctcactgcaagctccgcctcccaggttcgtgccattctcctgcctcagcctcctgagtagctgggactacaggtgcccaccaccacactcagctaattttttgtattttcagttaagacatggtttcacagtgttagccaggatgatctcaatctcctgacctcatgatctgcccacctcggtctcccaaagctctaggattacaggcatgagccaccgcgcgtggccgagttgtaaactttttaaaaagatgcactatatttattaaatccttctgagatcaacttaaaagacagaaattttagggaaaaatgacagcattttagcaatgtgagttttacagttatcacagatttctcacaaaaattttacaaaccacacacacacacgcacacccacatatatatactactttaaatactgaatctactgaattggtactatagcctctaaacatccttctaaaaccaatgaagaacacggaaaaaaaaagaaaggaaaatgtaactataaaaattaaaactaggccatcaaaaaggacatcccagccaggcacagtggctcacgcctgtaatcccagcactttgggaggccaaggtgggcagatcacctgaagtcaggagttcgagaccagcctggccaacatggttaaacttcgtctctactaaaaatacaaaaattaaccaggagtggtggcaggcacctgtaatcccagctatttgggaggctgaggcatgagaatcgctagaacccaggaggtagaggttgcagtgagccaagatcagtaccgcactctagcctggacaacggagcgagactccgtctcaaaaaaaaaaaaaaagaagttccaataactatgaaacataagcttgtgctgaactgagaatcactattagtattttccctgccctgtggcctctgcacgccccattcccactctgtgaacatccctccccacaagcatccctccccaaaagcccttctgactcctacacaaggccaatctcctcctacagaatcagttcctactcatctatacccatcatgttttaaggctcttattgttcagcaactaattacatcatgtcatatatacttgaatattaagtgcatattaatataaaagtagttgctaacacatggacacagggaggggaatatcacacaccggggcctgtcggggcgttggggggctgggggaaggatagcattaggagaaatgccttatgtaggtgacaggttgatgggtgcagcaaaccaccttggcacatgtatacctacgtaacaaacctgctcgttgtgcacatgtaccccagaacttaaagtataaatttaaaaaaaaaaaaaaaaaaggaattgctatggaaaagaaagctgagaagtcagcattaacctcactttataatcaagaaactaaatgcacagagaaatgaggacttgtcccactagagggcaacttgagcccaggaagagcgcgcttacaaaatgactttcaaccttttccatcagttctccctttctgtgccattcaatttcacagactctcaaacgagttgttgaacttttggtaccacttgagaaaactcaagacactactgccgtgactcagcaaagcttttaaatgaatttcttccatcacatcgacaccaacacacacctgaaagcacctgcacgcacgtgcgggaagcagccagctcttcaggccgcagccagcactgtgtgcacgtggacgtcgcagttctcggcaacgacagacctcctgcgcctgcgcgaacctggctttctaaactacttcagactggcaaatctgagatgtataaagttaaacctaacacgatgtctccctcagactcatctgccctctcttctatattgctgctcctcaacaactgaaagggcgtcactctacactgtctagaacgagcccactcctacgttaatcaacacctccctgttctgagatcgcccccctcacacctaccatgccaaacgcgtgcggcagacaccacagctctctcccgcccacggcagggggaaggcagagcacctcacgggggccactcacctctcccgcccagggcagggggaaggcagagcacctcacgggggccacttacagaacatgctgaccggtcccactccgaatcactgctcattgaacaaatgagctccgtctagggagcgagcgtgggagacacaggccaaaggtggagcagaggacgaggccgtgcggcttggagacctctgagctaccttcgtgagggttaccatgagatgcagtcaccgcctctgctgtgtcacaaaggagaatgggcattcagggcccagaaaagaacactttcaccccaggcaggagacaactctagaacatgccagcaggggaggctgcagggtttccactgctagaaatgtacgtgaacctacaaattaggaaaacctatcttggactgcttactcacactgtccaatagggtagccacttgccacatctgactatgtaaatttcaatgtaattaaaagttttaaaaattaaaatctcatgtcccgggacactggctacatttcaagtgctcagcagccacgtgactggtggttcccacatcagacagcagatacagatacagacactgcccccaccacaggagtcctgccgcatagctctgctgtctcctaagtgctgtgttgaacggggtccacaggcccaggacctcagcatgcgactgtgtttggaagcagggccctgaaagaggtggtgagagtaaaatgaggtcataaaggaaggccctccagtatgacaggggtccttgtaagaagagactaggacaagacacgcagagagggacaactctgtgaggacacagggagaagatggtgtcggcgagccacagacagaggcctcaggaggaactagccctgctcacaccttgatctaggacttccagctgcctggaaggaccatgagaaaataaatgtctgttgtttaagctgcccagtctgttaagctacccagtctgtggcattatgttatgggagtcctagcaaagtaatacactaagaataccaaagctatttttgtaatttttttgaacactaagttaaaatgtaatcactttttatagaaattagaaccaggtactggtttatttattcaatgcataatcatctaatttgaggtaaagatcctcttcgtggcaacagtcatgtcggattctgggttcacactgctgtattcagtgtagaggtcccggcctcgaagtcctggcataaagttacccacatggtcctaacaaaatccaatattcacagaagccaatttctcaggtttaagctttatcttcctacagcattatggctgatgaatttgttctaattgtgaaggaatggttgtaagtttacatatagttatatacatatataaccatatattagatatatctagagcttattttaatataaatatactgcgtctagacttcacaacactctttaaaaattctgacagaatttcatcagctataaatgaactagaaaaagtataagcaaaacttatctttatcaaaaataattagttcattttaatccaagaatgacatactcatggcggcagagacaaggataaacctaagcaaagtcactaaaagatctgattccaaaaactcttcagagaacagaaagagatcattaaaaggatatgatactcttcttttcttgagactgttagagacagaaaacccagaattgtactgtccgcaagcctgtacaaagaataaaactaatcccaactctcatacccactttgatttgttattacttagtatacatatgctaacccatctgtgtatgctgttgtatttgatagaagttttaatgagtttattttgggggaatttgggaggggtgatctttcttcttagtaacccaacccttttttttttactttggagacctttatatatttggctacttttataacgtcacagacacaatcaccatctttaaaataaggccttgatcccggggccggtggctcacgcctgtaatcctaacactttgggagggcgagacaggtggatcacctgaggttaggagttcgagatgagcctgaccaacatggtgaaaccctgtctctactaaaaatacaaaatcagccgggcatggtggcacatgcctctaatcccagctactcagtaggctgaggcaggagaatcacttccacccaggaggtggaggttgtgagcggagatcgcaccatcgcactccagccggggaaacgagcgaaactctgtctcaaaaatcaatcaatcaataaggccctaatcaatcgtagcttacttgtccttctaacatgtctcttggcagtcccgtcctctcctgctccgagctgttagttcttcgtatagaaaggctatgggatttgcgcttctgttttgtttggcgagcagtcgaacaacttgcgctttctgtgggcattacttctaggaggtagtgtcctggtcactcctgcaataagctaaaaacagcaagaaaaaacagtgtttctgatacagcgagttgaaacaaaagaaaaacagtgaagaagataatgatgacttctaattacaagcttccttactatagttaacattaactatataatttggaatatgacaaattaagatgttttaaggtagggaccacagcctttattaaagaagtaatttctttatcaaatttcattaacatcttaagtatcaaatggcaaaaaagaggtttaaaatttaaaaaaaaaattgctctcccttaacccaacggaattccccaggcacagtctactcccccgagggaaccaatgttaattgcatattctagactacacattctagactcatgctgtccaataggaatataatgcaagtcatggatgtaaattttccagtgtccacatttttaaaaataaaagcatatgaaattacttttaatgatttacttaacccaatacgtttaaaatattttatagtcaacataaaaaacaatgggatattttatgattacctctttgaaattcagcgtgtatatttacagcatatctcaattcaaactaaccacatgtgattaagttattcaaatctctaatttaaatattatgatttacccactttgggcattttctactcattccctgttattatccatccttcctcccaattatatcactacgttacttactacaatcttaggtaatatatttacacacatatcttctttcttcaactacagattttgctattttgaacattacctgctgattttttgctattactgatccctcctcccatgaacacaatcctatcatcaggccagctcagcacctcactgtcaaagaatgcctgacccatatgcagtcaaaggcaaagcaggacacgcccacgacctcccagacgccaacatgcctccatcatcttcttttagagaaaagactggcccaagtcccaagagcaggggatggttctgtgaatatatcagcgtaaaggaaaaatacgctaacctttaaaatacacataaggactacgtaaacatctaaattccaagtagacagttacaatggtgacttacgcaacagcaatagcctgagcctcaaggcaagaccttatttctggtgtgcccagccctcttcattatcaactccttagacattaccaggtgcagacacacatccctgaaatgctactcctttccttccaaatggctctcacttactcaatagccctaacacctccttactttgttatagaatgattccttttctacaatattttaaaatcactagcgttcccttctttttaaacaagtcagcctgttttgaaaaataagtttatctacacatagaagagagtattcttaacagagatgaaatgtattcacaaaaaatttagagtgtcttccataaaggttattaataacataaacaagatctttcctattcagtttattaagcattctaattataatcctaaataccaaggatgaaaatatttttctaagagaaaatattgtcacttataaaaattcacttcatttatttttaatattataaataaaacagtagaaatcaacatatttaaccttagaattcaaggaagtcgtagcatttttctaaatatctcttctaaatgtctttctaaatatgaatgtgagtatatacagtttagctttgtttcctgtttcttacatactatgcagaactctcatatataaattttgttattaaaacttttttaaaagccaagcataacccaaaaatgttagaaaactggaagacagtttgcctattatttaggacagtttttaaaagctttaacttaatcacaagcttctagtaactctcaaccaaaacagtcatgtgagttatgaagttcccaatttttttttttttttttttgagacagagtcttgctctgtctcctaggctggagtggagttgcacgatctcagctcactgcaacctccatcccccaggttcaagcaagaatctcgtgcctcagcctccagagtaactgggactataggcatgcaccaccatgcccagctaatttttgtatttttattagagacagggtttcgccacgttgaccaggttggtctcgaactcctgacctcaggtgatccacccacctcagcctcccaaagtgctaggattacagatgtgagctattgtgcctggcctcaactttgtattttgaaataactgcagattcacaggaagttgcaaagatggtccatatttccccagtggttacatcttacatcattacagtacaatctgttaatttgttagttaatttcactaaaccaacaaactgacattagtataatgtgtgtatagttgtcattctgttacatatataaattcctttaggtgccacatgttcaagatacaaaacactccactcaccatacagatcacccacactacccattagttaccccaactccctggcaccatccctcaactcctgataaccattaatctgtaaccatctctacaattttgtcattttgagactgttatgtaaatatgatcaaagagcagttaccctttttgagattcttttttccactcaatttaatggttacgatccaaccaattttctgcatgtatcaacagttttttcctttttattactagctagtgtccacagtatggacatttaaccatttgtttaaccattcacctgctgcaaaaaaaaaaaaaaaaaatatatatatatatatatattctttccaatttttttactattactaataaagttgccatgaacaataatatacagggttttatgtgaacctaagttctcatttcttttggataaacagcccaagaataaggctgctcagtcacagggtaaatgtatatttagctttaaaaaaaatcttgatatacgattcacacaccatgtaagacacctatttaaagtgcacaattcaatggctctcagtatactcaggaagttgtgcgatcattaccacaatcaactgtacatttttatcaccccaaaacgaagccccacacctatttgccctcactcctcatttctcccacccacttcccagctagccctaggcaaccactaatttactttctctccatatgaatctgcctgttctggccatttcataaaaatggaatcatacaacatacgctctggtctgtgacaaccagcttctttcacttagcacaacgatttcaaagtccatctatgttgtagcatagtggtaatgtattcccttttattgccaaatacaactgacagacatttggttgtttccatattttaggttattatgaaggttaaagtgcaaatttcttgtatgtgtatacttttatttctcttgggtatacctggaaacagaattgcttatgtttaatcatgtttagtttttgtggtttttttctaagagtgtcaaactatcagtattttccagggtggctgtttcattctacattatcatcaggaacacatgagagattcagttatccacatcctcaccagcatttggtattgtcattactcttttatgaaaatttgtcatacatgagaaattttgtgccaggtatacaacacagtcatcaagacaggctatttagggtgtccaccaccccagtaaaacactgtttgtttttttgtttttttgagacagagtctcgctgtcgcccaggctggagtgcagtggctcaatctcggctcactgcaacctccgcctcccgggttcacgccattctcctgcctcaggcgcccgccaccacgcccggctaattttttgtatttttagtagagacggggtttcacagtgttaaccaggatggtctccatctcctgacctcatgatccacccgcctcagcctcccaaagtgctgggattacaggcgtcagccaccgcgcccggcctaagatactgctttcttaaggatagtcaccctactctgctgtcaaacactgaatgtattccttctatcatactgcatgtttgtaccttttaactctcttctcatcctccctccgcccccgactcacacccttcccggtctctattatctatctatttttccactgtttacctccatgtgttcacattttttagctcccacatgtgagaacatgagacatgactttttgtgcctggcttatttcacttaaaataatggcctctggttccatccatgttgctgcgaatggcataatttcattcttcttatggctgaatggtattgcagagtgtgtgtgtgtgtgcgcaccacattttatttatctagtcatccgtcaacaggcacttaggttgattccatacctttgctattgtgaacagtgctgtgtatacctgcaagtgcaggcatccctttgtcactacttttttatttagctgttccgttaggtgtgtaatatctcactgtgatcttaatttgcatttccctgatggctagtgacactatcttttcatgtgcttgtcatccacatatcctcttcagtgaggtgtctcttcacacccattttctaacagtattattcgggttttttactgttgagatttaagagttctttacatactctatagtatgaattatatgtcacataggttaagctgcaaatcatttctcccaatctgttgctcttcattctaagagtttttcatgaagcaacacttctttaatgttgataattttttctatgcatcacacttttaaagtcatgacaagaacttttcatgaatccctaggggccaaacattttctcctgtttctcctgaattttttatagttttctgtttcacatctaaatttattacctatatggtactgacctttttataaggtgtaaaatttaagtcaaggtttttttgttgtttgttttcacctgtgtatccaattatcccagcctcatttgttgaagatgatccatcctagattgaactgctttggacttttgtcaaaaaatcaactcactgtacttgtgtggggttatttcttggttctctattctgttccaccgatctacatatttatccttccaccaacggcagtgatatggtttggctatgtccccagctaaatctcatcttgaattccaatgtgttgtgggagggacccagtgggaggtaactgaatcatggaggggcaggtctttcccgtgctgttctcgtgatagtaagtctcacaagatctgatggttctataagggggagttttcctgcacaagctctccctctctgcctgccgccatccacgcagaatgtgactcgctcctctttgccttctgccatgattgtgaggcctccccagccatgtggaactgtaagtccaataaacctctttcctttgtaaattgcccaatctcaggtatgtctttatcagcagcgtgaaaatggactaatacaagcagtttctattattgttctgtatgtcttaaaatcagttacagtgattcctattaaatctttctccattttgttttatctattctagtcctttgtccttccttttacatttttgaataatcttttacatatctacaaaaatcttgctgggatcttgataggaattgtgttaaatctgtacatcaatctggggagaaatggtatatttattatgctgagtcttttaatctatgaatacagtatttatttagatcttactttcctccatgtcaaggttttttctgcattagtcctagtatcgggctgggcgaggtggctcacgcctataatcccagcactttgggaggtcaaggtggacggatcacaaggtcaggacttcgagaccatcctagctaacacggtgaaaccccgtctctactaaaaaatacaaaaaattagcagggcgtggtggcaggcacctgtagtcccagatactcaggaggctgaggcaggagaatggcatcaacccgggaggcggaggttgcagtgagccaagatcgcgccactgcactccaacctgggtgacagagcaagactccgtttctaaaaaaaaaaagtcctacatatcttttctccattttagactaacatctctctttttattttttgtgtaagtttaaatgatactgtacttttattttggtttccacgttaattgctagtataaatacaactggattttatgtattaaacgtgtacattcttgctgaacctaaagttcaagattttttgtggattccttgggattttctatgtcaactattaagtcatctaaaaaaaaaaaggacagttttatttcttcctttgtggtttgtaagccttctatttccttttactaccttattgatttggctagaaattccagtactatcttaaattactatagtgacagcaaacacccttgctttgccctgaatattcgggtgaaaatattgtgtttcaccattaactttgatgccagctatagatttttttgtaggtgctgtttatcaagttgaaaacgtttccctctatcattcattttctgagtttctttcacgaatgagtgctgaattctatcatgtttttttcctagtagctttttttttttacctactgacaggaccaattacactcatgactttcaaacattgatccaaccttgtagccacaaaataaactgcacttgttcatggtgtatcattcattctctctccctctattctcttttttgccttctcgtggggtaaacattttttataatttcatatttatttacctacagtatttctgagtttgcctgttttgtataactttttagtggtagctctaggttttacattatacatttacagcttattgtagtctactgattatcaacattttaccagttcacataaagtatacaaatcttactttcctctatgcttctttacctttccccatttataacgtaatcacaaatatttcctacacatacactgagaaccacaccacggttatgcttcaaattccaaacacaatttagaaaataaacgaatactaaattgaccgatatttttgctgtccattctttgttcttccctcctgatgttcccacatttcttttgtcatttcctttctgtttggagaatttcctttatttgttattttcatagagtaggtcagctggagataaatcatgtgaaggaagttttcacttgatataaaattctgagttgatagtccttttccttcagcacctgaaaaaaatgtcctgccacttccttatgccctccacaatttctgataagatccactgtcaggccaggcacagtggctcatgactgtaattccagcaagcgtgagggaggccgaggcgggcagatcacctgaggtcaggagttcaagaccagcctggctaacatggtgaaaccccgtctctactaaaaatacaaaactagccaggcgtgatgtggcatgcctgtaatcccagctacttgggaggctagggcagaactgcttgaacctgggaggcagaggttgtagtgagctgagatcacaccactgcactccagcctgggtgacagagcaagattccatctcaaaaaaaaaaaaaaaaaaaaaaaaaaaaaagatccattgtcactcaaattgtttcccactacaggtcaagtggtatctctcttactatgcttctgtcttcagttttcagaagttggcctggatgtgtcttagcatctttgtgtttatcttctctgggtttatgctgcttcttacgtctgaaggtgtatggcttgccaagtttaggaaacatacagcagtgatttcttcagacacgttttccccccaccccgtccttctctctttctagacctctgatgacagatgttgcatcttctgttaaagtcccacgggcccctgaggctctgctcacttttttccagtctattttctctctgctgttcagattgggtaacttctattgttctatcttcaaattgacagcttcttttgtctgtcctctcctttctgctgctaagccatccactgaatttatttcacatattctatttttcacttttgaaattttgtgtttcttttttacatcctgtattttcttcctgaggctatttgtcgtttgtctcgaatgttaattggttattgaagcatttctacaatcgctgctttaaggtccttgtcaaataattctaaactctgtgtcatctctacgttggcatcagtggtcttttcttactgaggttgagattttcctatgagtgattttccattgaaatcctgacatcagactcaggatctgatgtaagtcttctgttagagcaggcctctgccaggtggatgtggacggtgaggtggaagttgagattcccactcagcctccacggacccctgcatgagaaggaaagttcagcctcctgccgaacttccactcccaccaccaaggctgaatcagggctgcctccgtgctgctccctatacagtctcccccacaccacaggggggtggcctcatgaccacagggcagcagtaaagttcctgagttttgcaaggtccctcttatgataccctagcagaaaggaggctgtgctctgtcaccacccagcagaagtaaaaccccaactcctcagccagtcttctctgacagcaaccctgcagagaggagcatctcatcccagcttgtcatgagtgggaatctgaagtacctgctcagcctctgattagcagggtgagggtggtgctgcagggtttcctgtgatatttagctggaggaaagtacttaccgccgaaaagttctctgattagcagggtgagggtggtgctgcagggtttcctgtgatatttagctggaggaaagtacttaccatcgaaaagttctgtgatttgtaggctgcccctttcctggtctttcagacacagagagcaggcttttcttgggccttgttttgtctgagtccttttatacctgcgctgctagcttatccagcacaacatatgagatacatgaggcaaaaagaaaactcacagaactaagtttggtgtcatttctgtggtcccaatgtacgaaggaagtctaccttcttttctccatctttcagtctctttttttttttttttaacagagtgtcgctctgttccccaggctggagtgcaatggcacaatcttggctcactgcaacctccacctcctgggttcaagcaattctcctacctcagcctcccaagtagctgggactacaggtgcccaacagcacatctggctaattattgtatttttagcggagacaaggtttcaccatattgaccagagtggtctctaacttgtgaccttgtgatctgcccgcctcagcctcccaaagtgcttggattacaggcgtgagccactgcacccggcccactcttacatttgttttatatatgtccagtgtttttagatgtacttcatgggaggaataaggaaaaataagtctccatctttccgcaagcagaaagccaagaatcatcttttattctcaaattgcatatgtgtaggcctatttttaaaggagaagtaagtcttgctttacaacataaaacagttactttgtagtttatggagtatgttttgtaaaggaaaaaaagaaaccacatcaaaagcctgtgaaagctgtcctgatatggcctcagagaaaaagggagactctatcttcagttaaatgaagcaaataaaaccagcaaagggtttcccttccctctcttaagaacttcatctgtagaaacattctgatgcattccagacattctacaagttcgttaccaaaaatgcagagattacaatatcacctttcctttctcatcaaaattataagttttggatcactgattttatctcactggctattccagcctctccgtaagttgcatggtgttctctttggtttagcttgctttcttcgccacttcacaaaatagtcaataccgccggcaatctttttctgctgatcaactacaaccaaatgtatgcatttcctacaatcacctccctggaacttggcaccaaatacagattttttcatactggagtaatcttatcatctctgtattcacaccctccacattttttcccagtgtctgtattggtcctatcaccacttccttcctttcacaccacatcctccatggaaactcagtccttggcccccccaaaaaaaaaaaagctcaagaccagaagtgtttcagaattcagatgctttcagattttggaatatccgcatatacatagtaagatatcctagggatgggacccaaggctaaactcaaagttcatttatgtttcatgtatacctcatgcacgtagcctgaaggtaatttttttttttttttgagatgacgtctccactgttgcccaggctggagtgcagtggtgttaacctcggttcactgcaacctccatctcccaggttccagcaattctcctgcctcagcctcccaagtagctggaattacaggcacccaacaccatgcccagctaatttttgtatttttaagagagacggggtttcaccatgttggcaaggtggtttcgaactcctggcctcaagtggtctgcccagctcggcctcccaaaatgctgggattactggcctgagccaccacagcaggcctcctgaaggtaattttattttgccctaggggatcctgaataaactatgttgcgcacccacattttgactacaacctgtctgtcacaaggtaaggtgtggaaatttccacttgtgtcatgttatggattttgaatttttggattaggatgctcaaccggcgtagcataaatcttatttaaatgtttaatcaccagtttagggggttttcaggttggtatcatgggaagagggacaaggaagtggcaggtgtttgtaaaactactgaaatggtataccatggaatctaaaatagacaggaagggaagtgaaaacagaaagaattaatggagagatactggaagaaagttggtggactggcagatctaccagaggctgaagagctactacaaagaattgctgtaaggctcaaatggatcaataaatacaaagagtcactaatcctcataacatccctatgagacagagttcccaaatccaattaagagcctttcaacacagtcatacatcacttaaggatggggacaggttctgagagatgcatcgttacgtgatttcgtcactgtgggaacatcgcagagtacacttacacaaagctaggtgcacagcctactccacacctaggctagatggcccagcctgctgctcctagcctacaaccctgcacagcatgttactgtactgaatactgcagacaactgtaacacaatggtatctatttgtgtacctaaacatatctacacatagaaaaggtacagtaaaaatagagtattacaatcttatgggaccaccatcttacatgaggtctgttgttgaccaaaacatcatttgttatgtggcacccgattgtatttaacagactaaacactaataaactgattatagaactgtaaagagaaaaaacaaacttcttcactccaaatataaccttctttaacctctatgcactgttttacctaaatacaagcaaagagaaacctgagattccaaaacgtaattattttccttcaaaatattcacatttacccaatattattggacagattaccatattacaaagaaggcttatggagattaaatgtccttctggttttcaataaaacattattttcaagaaactataaatagtcccctctaaaaattcaatctctttatcctaccatggatttaacagaataaacgctccttctgaactcctgactcatttagtctgtccagttcacctgcccttagtatatgttgccgtgtacgtaatacaccccactgcttgtaagcagtcagaacaacaggcacacagctgtgatgcagcacagtgctctacacacagcaggcactggccaaacattcgactaattaatgaaacccataaacacactgtgttagcaagctgaattcctcatctttagaaatgctgtaatattgggccaggcatgatggctcatgcccgtaatcccagccttttgggaggcccaggcaggcggatcacctgaggtcaggagtttaagaccagcctggccaacatggtgaagtcccgtctctactaaaatacaaaaatcagctgggcgtgatggtacacgcctcccatctaccctggaggctgaggcacgagaattgctccaccctgggaggtggaggcagtggtgagctgagatcatgccgctgcactccagcctgcgtgacagaaatgctgtaatattaaacagcatcaatgaacacttagctttctgctctttctcaaaagattcttttatatatatattttttgagacagagtctcgctctgtcgcccaggttggagtgcagtggcgcgatctcgacccactgcaacctccacctcccgggttcaaccaattctctgcctcagcctcctgagtagttggggttacaagcacccaccaccacgcctggctaattttttgtattttcagtagatacggggtttcaccatcctggccaggctggtcttgaactcctgacctcatgattcacctgacccagcctcccaaagtgctgggattacaggcatgagccactgcgcctggccagattcttttcaatatttccaatattaattaatttgtagctatagaaattatcattctcctaagtgtgtataatttgaggaaggcagataacataaccaaagtagcttgaaacagcaatacgacaaattcttttctttttgacacagaatctcgctctgtctccccaggctggagggcagtggcgtgatctcggctaaccgcaacttctgcctcctgagttcaagtgattctcctgcttcagcctcctgagtagctgggactacaagtgcccgccaccatgcccagctgatttttgtatttttagtagagacgggacttcaccatgttggccagggtggtcttggactgctgacctcaggtgatctgcccacctcggcttcccaaagtgctgggattacaggcatgagccaccacgccctgccaacaaattcttaatttacactttcatttgaaacaaaaaacacaaaacattactttcagtttcatatccagtaggattttaaacatttttctttcatcaaagcaaaaacacttgcttaagtggttaatttcacaaatgttaatcacatgcaaaagaatggttaaggaatataatgtccatgtggcattaaaaataaattggagaaataaattgaaaattgcataaaatgtgatggaatttccaccagaagtttaatcaagtttgtagtaacattttatcgtaataacactgttagacgaattcctagtgggctgagacaccaaattcaacttctgagcaatatcgaggaagagaatggtctctacaggcaacctcagaaatctgtcatcagtattaacctgcttaaaatgttttgtcattgacgaaatgaaggcatggaatacatacaccatcaattctgtggatgacaatcaattaggaaataccattaatcagataaatagccatcaagattttcaaaagatctcagtagttaaaagaacaactttaaaccaaggatgaaattcaacagatgtaaaatcttttccctgaaaagaataagacaggataaatatgaaaactctatcttagtttcaccttggggaaagggacttagggattttagttcagggcaaatgcccaaagtgaacagcctaacatagctacccaaaaagaggaggagggaaacacactcactcaagatctcctgtatacagcactttgcaaaaatggctggcatatattacataacgtaaccttcccagtaagaaaatgaggctgatatgaacaccatgttagaggacagggagtcgggacttaggaaggccttgcccaaggtcacactgctgttgagacgtggccagtgcacacgagtccctactctgtctcctgtgagcagtattaatagaaaggcagcgtctaaacccaggggataacagatcactccatttgttccacattggtgagttcatatttacataccgtgtttaactcctgggacatatcaaaagctattttgaaagactcgaatttgatcaggaaagtaaccagaacagtgtgtgtgtctgctggggttgggggaagttcagaagacgaagaaagttcctggagatataactatcttgagctttctcattcagaggtaaataattcctgcaatacttttatgaccgtaactcacaggccaacatactgaatttaagagaaaaacacttgaacttcaataaatgaaacttccaagcaattaacacttttctataatggtatccgcttcaagggacgaatgttttagcgtttaagttaaatgacaaaatctctaaaaacctggcagaccttaagctattttcactcacaacctggaaaaatgtatttattcaacttggtttagtaaatgagtacattattattgttgctcttgtgttattccggtgaacagctgtcttaaaatgtttccctccagcggtggctgctttcagggggaagggaaggaaaaggaagtcttcaaaaggggaacaatatcatggcgctgtgttaatcacttcagcatccgtcactccacactcaccacccttcttgaagccgaccatccccactctttggagagaagaaaggccattctcctctctgaagggcctcccaagtgcttccctggagacgcacttccccgggatgcccaggccgaagcaaagggggcggggagagaccccgggccgaacccttctgcccccaacccctccagcgccccgactcttcctggactccgacatcttctgcaccgccccgggcccccatccctcccgcaccctggtccctctggcaccgccacggactactcctgcgccccgacttctcttgcaccctgaacccttctgcaccacggcccttcctgcaccgccacgggtcctccagggacccgacccctcctgcaccaccacggaccctctgcattccaagcccacctgcaccccatccgccactatgccccgactgcccctgcacccccttgagccctgcagtgtcccgactcctcttcggggcatccggggaacgactcggcgcctgacaggtaggaagatggcggcactcacctgtcacagcagctgcgcccgccacccccggagccagcccaggtcgcgcaccgccagtgagtccctacgacgcggccccccgtactgacccgaagacgcgcaggacaccgctgtctccgcactgacgcgaccccacaaccccaacctggcgctaatgcacttccggtgtcgccggaagtcccgccccagtcccgcgccgctgggttctccggaagccgccccacacctccgccccacacccggcggcgccggaagtcacgccccggcttccgccccgcagccccgaggggtctgggcgcgctgaagaccccttcggctgctgggccaacgcccccacccttggtcacgtactcctgccgccgagcggttcgcgggaggtggcctcgggggtcgtagctactcaccggcggggcgctccgagtccatctgccccgtagcccggcagccggggcgggagggctgcgagcccggggcgcggtccgcctgaggcctgagacccggggccgcctgcgctcagggccgcggtgccggccgcgcgggagcctggcggggacggcgcggtcagtgttcggctcctccgcagtgactcaccagcgtcctgaagcttttgatcaccattggctgggaaggaaaaacagaatcagctgttccctgcgaaaggtgggacttgggccgcttttttcttagaatctaggttggaaacgtcgcatgatggtctttacgtaaacagccgtctcaacgctctacagaaagcgctaaccgcgcatttgaagcccacctagagtaaatcaagagcgtgaaagcattttttttttctgtgtaggttaacattcctgctccttcctttaaaaaggaagctcaaggccaggcgcggtggctcacgcctgtaatcccaacactttgggaggccgaggccgacgtatcacgagattaggaggtcgagaccagcctggccaacatggtgaaaccctgtctttactaaaaatacaaaaactagccgggcgtggcggcgcgcgcctgtaacccctgctactcggaaggctgaggcaggagaatcgcttgaacccgggaggcggaggttgcagtgagccgagatcgcgcctctgcactccagcctgggacagagcgagcctccgtctccaaaaaaaaataaggaagctcaagatgaagagtcagaagtggtaacttgtttgttgcacaagaaacaaatttagcattctatttaggggatccagattaccaaaaaaaaaaaagaagtgaagttatttctgcattaagtatattaataaaactttatcactaaaaacaattctgtaagaggaacgccaaggaaaaaaatatttgagtttttagagaagtcattttttaaacttttagaggttgtgacatttaagtaacataattttatttagtacctagtatgcaaagacattgtactgggcatggcagcaaatagaaagctttgtaaatcgcagtgtcccatctaattaacccgcattctaacaggtggttttatttttctggaccgcaccacagtcaggtaacaccaagaatatcgctaatgtaattttttaagttgatatatttaggattccataaaagtcactgaaaataactgagagcatgacatgtcacaaaacaagggaaagaaatcattttgaggatcagtcgctttacatcttttgtaactaatttaatccccaaaggaatccaataaagtaaaagttattctaaattgaattttaagcatgagaatgtggaaattactcgtcaaaagtcaaaaataatcgtgcagcagggcaaagactaaaggctggcatcagaatccatattcttttcactgttgatgtgctagggctgcaggaacaaaatactgcaaactaggcagcttaaacaaatttattgtcagaggtctgactggaagtcccaaatcaaggtattggcagggttgattccttctgagagctgtgatgggagcctgttaatgcatctcagcgtctaggcattccttggcttgtggcagcatgcccccgccagtcttcacatgacgttttccatgtccgtgtctgtctgcacacttagcgttctttttatgaggacatcagtcatattggagtacagtagacgctactttaatatgacctcatgttaactaatcatatccacaacaaccctgtttccaaataaggtcacattataaaatactggaagtgaggtctttaacacatgaatttgaaagggggacacaatttaacccataacacactgtatcctgaaataactatccaatgtaatttttttaaaagacacaaaactagccgaaattataaaaggttatgattgcaatcctggtatccagttacattctccctcctgcagaagctgtggagaatcctgtctcagaaaaccaatttctattttgtcacatgtccatctatgcaaaatacatgtactttgtccctgacatagggcaacaatgctgaatttactaagactcatttttgcgcatggtttgatagggaattaagatttactaggtattctgtcattgtcctcattactgattattttaactgtgtctcaaacacttggatagtacactatagtgttataagctgtttgacatgtcgcttcctaaattctcaagttatatatatgtgtgtatatatgtcatgtaacaggcacaactgttttcatgtgtatcactttattgcacttcacaggtatcatatgtttcttacaaagtggaggtttgtggcagccctgcatggagcaagtctgtcagcaccatctttctaacagtatgtgctcacttcatgtctctctcacattttggtaattcttggaatgtttccgttattaaatcagttatagtgatctgtgattagtgatctttgatattactgtcataattgcttggggggcaccatgaaccacccctatataagacagcaaactgagtcgataaatgttttatgtgttctgaccactgcactgaccagctgcctccctatctctctccttctgctcagacctccctatccttgagacacagcaatactgaaattaggggccaggcatggtggtggctcatgcctgtagtcccagctacttgggagactgaagcaggaggattgcttgagcctaggagttcgaggctgcagtgagctgtgatcacgccactgcacttcagcatgggcagcaaagcaagaccctgactcaaaaaaaaaaaaaaatcaggcaattaatagccctaaaatggctactgtttcataaaagaatgagttgcacatctcttactttaaatcaaaactagaaatgattaatgattaagcatggtgaggaaggcatgttgaaacagctaagtcgtgaatgcaaaggaaaagttcttgaaggaaatttgaagtgctcctacagtgaatacacaaatggtaagaaaataaaacagctttattgctgatatggagaaactctgagtggtctgtatagattaaaccagccacaatattctgataaagcctaatccagagtaaggccctaactctcttcagttttctgaaggctgagagaggtaaggaagctacagaagaaaaatctgaagctatcagaggttggttcatgaggttgaaggaaagaagctgtctctataatacaaaagtgcaagataggccaggcatggtggcttatgcctgtaattccagcactttgggaggccaatgcaagtggatcccttgaggtgaggagttcaagaccagcctggccaacatggtgaaaccctgcctccactaaaaatacaaaaattaactgggtgtggtggcacacgcctgtagtcccagctactcaggaggctaaggcaggaggatcacttgaacccaggagttggaggttgctgtaagccaagatcacaccaccacactcctgggtaacagagtgagactccatctcaaaaaaaaaaatgtgcaagtgcaagataaagcagcaagtcatctaggagatctacctaagatcactgatgaagacggctttgctaaacaataggttttcattggagttgaaacaaccttattttgggaaaagatgccgcccaggactgtcataactagagaggagaagtcaaagcctggcttcagagctccaaaggacaggctgacccttgctagggggctagtgcagctgatgactttatgttgaagccagtgctcatttatcattctgaaaatcctagagtccttaagcgttatgctaattctagtctgcctctgctgtgtagatagaacaacaaagcctagatgacagcacatctacttacacagtgtggtttactaaatattgtcagcccactgttgttgagacctactgctcaggaaaaaaaaaagatttcgtttcaaaatattactgctgatttacagtgctcctgttcacccaagagctctgatggagatatacaaggagattcatgttgatttcatgcctgctaacacaacatcccttttgcagcccatagctcaagaagtcattttgactttcaagtctcattatttaagaaatacattttgtaaggctatggctgcccgaagatgtaactgaatcactgcactagcataataaaacatgaatggataagcagttgcttcttgtggatgaacaaagaaagtggtctcttgagatggaacctaatcctggtgaagatgtgaacactgttgaaatgataacaaaggattcagaatactccatagacttagtttatgaagtagcagcagggtttgagaggattgactctaactttggaagttttcctggccgggtgcggtggctcatgcctataatcccagcattttgagaggccaaggtgggcagatcacaaggtcaggagttcaagaccagcctggccaacatggtgaaacccaagctctactaataatacaaaaattagccgggcatggtggcacacgcccatagtgccagctactcatgaggctgaggtaggagaattgcttgaacccaggaggtggaggttacagtgagccaagatcgcaccactgcacttcagcctgggcgaaagaacgagactctgtctcaaaaaaaagttttcctgtggtttaaaaaaaatctttcatgaaaagaattgtcaatcaacgtgacaaatttcattattgtcttattttaagaaactgcaacagccaccccaactttcaagcaccaccttgatcaacagccatcaacattgaggcaaaaccctccaccagcaaaaagattatgactcattgaaggctcagctgatggttagcagtaaaaaatattaactttaatcatctcgaccattcagtactcatctaatattctctataacaaaatgggaaatgcacataaagcacttctgctacatgctgaattatgattgttgtctccaggaaaagaacttgtgggaacgtttgagttgtaagctgaactaactagctgcttttttcatgaaataccgcttttactggaaagaactgacagataaactgaggtattcaaacctagatatttggcagacattttcgtgaaaataaatatgttcgtgccacttcaaggaacataattctcagtacttgttgccaataatgttggaattttcatgcaaaaattcaaataaaaaacaaacttaaaaccatcaagaacttggtgactttatgtggaagccagtgctacaatactttagcttcccaatacttaaaaacttttctgatgagattactagtgatattaacaatgtgattgatattgaataatgaaatgttttagcatttggaagatctgtttaattcagtaaatcagtattttccaaatgaccaatgcatgacatttcaacatcacgcacaggaaaataggcattcgaggtacagtcaaaaataatgagttttaatgtaacaagtacaaaatgtccattgaagtggtttcaaattccaaatagtaattggaaaatccaccactcgtgttttggggtagtagtatcgaaaaagaataaccaagataatttgaaaaggctattaaaaaatacttctcaattttcaaactgcatacagcaggtgctcattcatttctttgtaacattgatgagaaaaagactcccagccaggggcactgtctttgtggtgtttacgtgttctcgccacacctgcataggttttctctgggtgctgcagttcttgccacatcccagaggtgtgcacgtgaggtgaactggtgtgtcttcactgtcccagtctgagtgtgggtgtgtgagtggccctgtgatggaatggcgtcctgtccagggctggttccctctttgtgccctgagctactgaaacaggcttcagctacacatgacccagaactggaataattaagtaataattatctttttattcatctttcttaaatgtatgtatagctcacatttatttcaatgtttaatattagaatactttggcctttagaagcttagtgattttttttttccttggccagaagtatgctttaggaacttaatccttattttttagcctctggtaaaattggttttgctatacgttgtttcacttaaaagtcctgattcccaagaacgcactgacagcagtgaggacttgctgcgcatgcgggaggccagattttcttatctgtgtgaagccagacatgaaagagatctgtcaacacataaaacaaaatcaaagtctgttttttgtctggaaaagatttttaataaaaatataacttatgttagtgtcgtgtgttttttaagtgaatattttaatatgtttaatttctatgttagtaaatagcagtagtaaacaacagtgagcaaaagcttttaggtgtcctcagtacattttaagagagtgcaagcgtcctgtgaccaagaagtttgagaactggtgcccaccaggttcatctcacaagttcagtattttaaattccacacaaaaggtagaggaaatagctgaattcgcttcagctgcgcatacatttcacgattatttaaaagtttagagggctaggcgcggtggctcacacccggaatctcagcacttcggtaagctgagccaggtggatcacttgaggtcaggagttccagaccagcctgaccaacatgcggaaacccgtctctactaaaaatacgaaataagccgggcgtggtggcgcatgcctgtaattccagctacttgggaggctgagacgggacaattgcctgaacccgggcggcggaggttgctgtgagcggagactgcaccattgcactcaagcctgggcaacaagaatgaaactgtctcaaaaaaaaaaaatttagaacgtagtcatgtacctcgaaagcgaacactcccaacatagcgtggaacaccccacacccccggcgactttgctccgccttggtcccggtcgcagacaccgcagaaaggccatcgttctagacatacgagaactccccgtgcagccaaacgctgtagtcccagcggcggaactcggggggggggaggggggggagtgcccaaccagccagtcagcagtgacgtcccgcctttcctccgtttccattggtccagccatgcggaggtcgctcccatgggacgccgagcttccggctgcagggcttggcgcccgggcgctttcggattgggagggcttcctccatggaacgcgagcctcgagacgtctgacgttaggcaccgttcgcagcgcctcgggctcgcacggcaggatcgaaagcgtgattggctggcggcgtctgtggtctcgggcaccgcccagtcgcgggacgctgcctctgcggaactgggggtggggcgtgttgacccccttaaaggcgccagagcccgcggtcacggctcaggttcccggtgcttcgcgcgtctgccgttgtcacaggccagggaggtggcaccaccaggcgaagcttggcgagattgtgtcgtcaagcgcgtacgggcgccaattggccgggcgatgtggcgtggactggcgctggcgcgagcgattggctgcgcggcccgggggcggggccagtgggcggtgcgcgccgcagactgtgctcaaagcgggcgccatccgggaccggcggttgtctgtggccggaggctgatcaggtactgtggacgggcggcggagttcgggagacaggggcagggcggcatcggggagctgcgggacggggcggggaggaggcccgaggtctgagccacccgtgaggtctcggcgcggaggcctggacagctgggggtggcggcgttggtctcccgaactggagggaggccgggccttcccgggctgtggtgggcgcccgcgccccgtggaaggcggaggcgtgagtcggggcgtcagagacgttgccattctttgtcagcggaaaagatcgtcgtctgcgcacagtcacctgaggtttaggaactcgtggaactggaaaccgagtcgcaggagactaagagttgcgagtctccccttagagaattcagaaacaagcgtagacagcatcgtcagaaacacgagcgtgacgacaccggcctccccgtgccgagtccacgcgtgtgacgcgggtgcatacacctgcgtccgtgcaagagggtgacagcaacacactcaaggcgcttctcctgggaatggagcaggagaagagatggggagcatcgcatagatggaactagacctttttcttgggttggatgatgtgttcccgcgtctactacatggtattctttaaacgcataaatagacgtattcattttatcttgtgattatgcagcttagctttaaaatctgaattctgaaaatcctgaaagagcaattgtcattacagctgggcggtggtgcacgcctttaatcccagcactttgggaggcggagtcgaaggctgcagtgagccgagatcgcgccactgcactccagcttgggcgacagacatagcaagacccagccccatccccccggaaaaaaagtcatgtcaaaaagtctagtaattatgtagtaacgaaacctatcttagtgatcacctaatatacagttggcctactgtatccttggggtccatatccatggatttaaccaactgcacattataaaatatttggaaaaaaatttcatctgtactgaacatatacagacttattctgtaaacaatacagcacaactatttatgtaggatttacatgttttagatactataagagatcatctacagatgataatttaacgttcggcccgcatcacttaacagggatactttggagaagttcattgttaggtactttcatcattgtggaagcagagtgcgctgacgcagacctagacagtggagcagctgggctgtgtggtgtagacagacggtggagcagctgggctgtgtggtgtagacagtggagcagctgggctgtgtggtgtagacaaaggaccagacagtggagcagctgggctgtgtggtgtagacagtggagcagctgggctgtgtggtgtagacagtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggctgtgtggtgtagacagtggagcagctgggcggtgtggtgtagacagtggagcagctgggctgtgtggtgtagacagacagtggagcagctgggctgtgtggtgtagccagttgctcttaggctgtttttcctgttgcttcaggcctaaatttggacagtgtgtgactgtgctgaataatgtgggcagttgtaacacaacagcaagtatttgtgtatctaaacatagaaaaggtgatgtgttgtgctccgatgttacaatggctacaacatcattagcaataggaatatgtcagttctgttataattttatggaaccactgtagtatatgcagtctgtagtgtaccgaaacaccatcatgtgacacatgtatgtacacagtggatatacacaggtgatctgcaaatattatgccattttatatctgaaacttcagcatcctcaaattttggtagctgtgggaggtcctggaactaactcccatatataccaaaggatgactgtatataaaactagcctatagaagttggaaatctttctaaaattgaggctaactctgaagttgacttccttttcacattattttccctcttgatttgttttaatcattaaccttatttcagattttttgtattagatatcaatatctccatcatcactgactcctgacacacgcattcacacacacacacacacacacacacacacccagaccctatgtgggtctagaactttgtattaagtagctgtttaaacactttgtgtacattctgcagtatgcttgaactctgttgaaagtatttcagtggtccccgtgtggtggctcactcctgtaatctcaacactttgggaggccaaagcaggcagatctcctgaggttaggagttcgagatcagcatggccagcatggcaagacttcgtctctactaaaaatacaaaaattagcctggcgtggtggtgcacgcctgtagtcccagctacttgggaggtcaaagcaggagaatcacttgaacccaggaggtgggggttgtagtgagctgagattgcaccattgcattccagcctgggcaacaaaacgagactccctctcagaaacaaaaaagtatttcagtaaaatctatgtatttgaaatagagtcacatagaaagtagagcacatgggatcttcaaaatatattgggtagaaaaatcagaaaacaaaaattattattcattcagaaataaaggagaagaaaaaagggaataaaaaacttcaaggtcagactatgtaaaggtgccctgaaggatacaaagattagaaagcttagacgctgctggatacagatatgtaaaagtgtgagtcagaatactgaaagtaccctaataagtgctttacgttgtaatcacatgggagggataaatgggggttcagaaaattaatgtttgatgcactaaggtaggaatgggccaactatggcctataggccaaatctggcctgctgcctgttgttacgtcctgtgagctgagtgtttttctcatatttaaacggatggagaagaatcaaaatattttgtgacacatgaaaattaaatgtaattcagtgtccataaatattggcatgcacccacactcagtttacatactgcccagttcacctattgcctgtgactattttagtgttacagaggcagagttcatactctctggcccttcacagaaaaaacttgccaagcactgccttaaagcatctattgaatataacgaattaagtcttctcctgtttatctagaatgatatcagctaagtactgtcctgggggaaattgacaaaactcatacaaataatttttctgataacccaggagcttgggttgagaaaaactggattaagtcttactgtgacattggtagaaaggttattgaatgtctggcacgagttgtgccttgaaaaaatggatttcaaccaagattggcctgtggcaatcttgagcaactatgcagagacaggcagtgggaaaaacaattcaggatggcaatgggagcacattctagagattacagaagctggtgtagaaaagcaggatgaaaagttaggttggggccaaaaaccagagaagaaaagtacactggaaaaaggattgagtatcaagtgctgcagaggatctcagaggtcaagaatttagagcggaacgttgagcttggccttcaggagcatgactgtgataaaaggccagctgtgaaacctgtaggagaaatgatgacccagatagtgctgagcagccggctggcagcgttcttggggtccctgtggggatgcagagtggtacaactgcagatggggaagcagcatcattattaacctgtgtttatatgacattcagaaaaatatatgatggcctttctttctcttttcctttaatattagtgttctagaacagatcagacattttgtaatgatgcctgaaataaacactaaccacctcgacaagcaacaggttcaactcctggcagagatgtgtatccttattgatgaaaatgacaataaaattggagctgagaccaagaagaattgtcacctgaacgagaacattgagaaaggtgctgctttgaaacagtctttcttgtaaagcgatttgtgtaggcatttccgatttgctgagaagagcactctgttcaaggaagtgcagtcttcagtaataccgtattttctcgttggttccagttcgttaaatagtgtggtcattagcatctgctttgctgtcttcctgttacagcgatttctcttcacttcatgcctgttactcggcttcttcagagttattctggattcatagaagagggactagccctgacatacagcagcagcctagcctctaatatttctagagagtggagagaggcgggcaccatgcagggaagcatgtgccttcaccactttccgagaactgaatgtccttgatagggaacttgactgccggaaaggggccaccagcatcaccatttccttcactcgacggccaacttccttgcccagtgcagagctcttcctcaccatagccatgcagagactatgcatgtggataaaccatgggaaaaagcaaaagcagcagcaagttactaatgttattctgaactgcagggagagaatttggcaaataactggtacttaaggctaaaataattgttatttcttttgctttcaggattattgcatcgagcttttagtgtcttcttattcaacaccgaaaataagcttctgctacagcaaagatcagatgctaagattacctttccaggttagtacacttttaatgtacaatattgtgtttgtacattaatttgactttttatcattctgaattcttggagccaaggtcacaaagggaaatcctgtgaatggcataattttatattctgcataaagtgagtttacacaatgagtgcaacctaatacaacagcaagaaaaaataagaactagtaagcaattgggcaatatgtataatttacatatttatctttaatctgtattatctacactttgatcttttttggttaaagaagtattaataaggaacctacctacaaatgtagtctgtttcacaacataattactgatagcccattataaccaattttaaaatccttaaaataattactgatagcccattataaccaattttaaaatccttaaaataattactgatagcccattataactgattttaaaatccttaaaaatcatttcatttttcagttacttataaaactttttcttgatctttcagacctactttgaagaaaagttgatctgtctctgtattaccattttccaggttgttttacgaatacgtgttgtagtcatccattaagcaatccagccgagcttgaggaaagtgacgcccttggagtgaggcgagcagcacagagacggctgaaagctgagctaggaattcccttggaagaggtaaccagctctcctacacaaccatacaagctgaaacctaaacatactataaaaaggtttttaataaaatttttaaattcaaatgtagttctctgcttggtaacctccggagttatgagttagccccacaaaccatcttgaataaagattatttaaattttaatttcttaatatcacttgtcaaaacttagctcaatacggggatggattgatctgttaagcactatataaggttgaatatttctataattgatcaaatctaagatgagtattttcaagtgttacagctcttgtagaatttaactgacaggttttccagttctcacctaaaactccccacctacaaaaaaggtgaagattttctgatggaaactcttaggaatatgaaccataaatctcattggtttaattgaaatcattttttttcttggaattgtcccccttaaataagacctggataaataaagtatttcttatctatattttccaaaaagcaattttaaaatatgaaaaagaaaaatgtcgggccggtcgtggtggctcacgcctgtaatcccagcactttgggaggctgaggcaggtggatcacgaggtcaggagttcgagaccagcctgaccaacatggtgaaactccgtctctactaaaaatacaaaaactagctgggcatggtggggcggcacgtctgtaatcccagctactcaggaggctgaggcaggagaatcgcttgaacctgggaggcggaggttgcagtgagctgagatcacaccattgcactccagcttgggtgacagcaagactccgtctcacaaaaaaaaaaaaaagaagaaaaagaagaatgtcacatttctagtttgagtgactgcccctttttttaacattaaaaaaaaaaaaacttatctgatcgggaaaaaaacgcaaacacttgaaactaatgatgtaatcatttttccatatataatattaagatttccatataccattgataggagattaatgctttaaccaagttctaatcctaaaactatactgctgttcgagatatcgctgtaatacagtgagctaattttagattttttttgttacggtggccgatgttttaattacttttttttttttaatgtcttaggttcctccagaagaaattaattatttaacacgaattcactacaaagctcagtctgatggtatctggggtgaacatgaaattgattacattttgttggtgaggaagaatgtaactttgaatccagatcccaatgagattaaaagctattgttatgtgtcaaaggaagaactaaaagaacttctgaaaaaagcagccagtggtgaaattaagataacgccatggtttaaaattattgcagcgacttttctctttaaatggtgggataacttaaatcatttgaatcagtttgttgaccatgagaaaatatacagaatgtgaatatgtaggtaaatgattacagaaaaatttatctgcttaacaaacttagaatgactttttccttttaaatttagttctatcattaatttatcattaaatttagttctatcatttggtactatcattaatgtattatatacactgatactttaaaacttgtgtggaaaaaactaacttataattttgtatcacacaccctggatatgtgttctgtttctaagcgacatttgtgagagattattgtaaaatgagagcgagcaaataaaacttaatttaatctttgcagatacatacttatgggaaatttgaacaaatgagtgaaactctgtttttagtaggctgtgataaacatttccggagcacttgcagaggacttgctatttgccaggtgctttatgtatcattaaatttttctcatagttcagaaaaatgtgcaaaggaaactattgtctcgctccttcaaaacagtcttaattaactttcatattagcagattaaactagcagagcaggttcaagggaaattaaatgatatggaccctaatttgtatcattctgagttgattgtgtggtttattcattctggaaacatgttgatacttacagtcagccactgcttttgataagtgatattgattaggttgaatcttcttgtaaatagtatttaccagttagcaaagtctgtgttttcagaattacagtgagcacagaggtgttcataaaatgggaattgagtcccactcggtaagagttgcttaaacttgacactgttgacatttgggctggataaaacccctgtggtggggtctgtgctgtgcattgcaggatggtgagcagcgtccctctcatgtgacacccacagttatgccggatgttgccagatgcccctaggggacagagtcaacccccaactgaggaccactgtcctacagagtcaggaaatattgtagggagaaaaaaataacaacaacaaaggcctgtgttaatgttaaatagatgagattatggaatgtgtatattaatgttaaaaattgtaccttgatcaatgtactttttataaacttgccatagatatctcagatttgaaacctcaagacagatttattattcttaaatgctgtatgataatgaagaaaaataaaaatttatttcttgcaaagttaaatgtttgttaaattcaatagaatgactcatttatggttaactttgggcaatttataatttcagacaagactgtttagcaagtattttattgaaaagtaaaaaaaattgcaatttaatactgtgtttagtttgttaaaattttgatacactaataggatattgcctgtatagtttccgttgcatttataatattgtttctaatttttttagttttattttctaggaagttttaggctgaaagccacatataattagttatgtgataactatgagttgccatggctactgaattggacatgggacccttagactgctacccagcaccttgttaagtacttagcaagagttagatactactgttgtaatattactaggatgccatccagaaaatgtaaggaatgtcttttgacctgataaactccttagaactccttcatcttttataaagaggagtatccctctcctagatatagctgcttctgaccccaaaggcagatgtgttggttttcaactagaaagctaaatggtacctataaattttttttttcttaaactgttttaaactcttaatcttcaaaatatatacttctttgattctggtcaaaccattgccaactcctttaaggacaaagtagaggtggccttctaataattgctgattctgtttccctacctatattatcaagagaacaagaccaaaacagaaaatggtataataggaaggaaggcacattttcttcttacttggccctggcacctggggacaagtccaggtcgtacccgcagtgcatccctgtgggaactgccctccacctgctccctggggacacgtccaggtcgtacccgcagtgcgtccctgtgggaactgccctccacctgctccctggggacaagtccaggtcgtacccgcagtgcgtccctgtgggaactgccctccacctgctccctggggacaagtccaggtcgtacccgcagtgcgtccctgtgggaactgccctccacctgctccctggggacaagtccaggtcgtacccgcagtgcgtccctgtgggacctgccctccacctgctccatggggacaagtccaggtcgtacccgcagtgcgtccctgtgggaactgccctccacctgctccctggggacacgtccaggtcgtacccgcagtgcgtccctgtgggaactgccctccacctgctccctggggacacgtccaggtcgtacccgcagtgcgtccctgtgggaactgccctccacctgct

SEQ ID NO: 36635 - DNA, 56140 bp, Homo sapiens
gtcagagctggagggccgggcaccgcggccatggagggtcaacgctggctgccgctggaggccaatcccgaggtgggcgcgcttcggggcagccctgggccgtgggcaggtgcagagggagccggcttgctgccgcgagtccacggtggtttgtctctaaagcgtgttctctgtttcgttttcaggtcaccaaccaggtgagtgaggtgtctgtcgctcgggacctcggagtcttttctgtctgctcggtccgcttccctgctggactccacctccacgcttccagggattctgggatttaatttcttgagggcccctcttgttcggctttacgcgggtccgcccctttcagaaagggccatctcgctgccacctggctcctgaagattctcccaccactcctctggtcccattctgcagtcaccacgtatcttggggactccgggtctgaggtttggagggacttttaccctgtattcctattccccttccttcttcgttttgcctcctgttagtgccgattccataattttcctaccggtgtaccttttggatgactaatttgcccacacttcctgactccaagctttgtaaactcgcccacccagtccttgtaatttcatccaccgcctgcactatgaaatcatcttccaatcatctcttgccccatgaagtcacttttcttccccgccacgccccctttatcttccagtcttttaaagctggacatttagttgctgttgtatcaaagaaagctcagtttaatagttcccacgccattctttgcaatctatagcaatttaagttccttctgggtgttggaggttgggggttggggagggaggagggaacatctcccagccactcagaagagtaagtgctaccaggtataaacttttgatctgctcaggtgtgccttattttaccctgttttttttttttttttcattctcaacagctcatttcttttttactgctctcctagtttatcatactccctttacctccactatcttccttctcatcaccaaggaacaattcaccgtgttcttaaaaatattggtttttggttttcaaagcttgtagcaaattccctggacaaagagacatcctctgtcttgctctctatcttagggaggaaacatttgatctttcaccattaaatatgttagctttaggtttttggtaaatgttttttaaatcaggctaaggaagttcctcttttccccctagtttgctgagagtttttcttatgaatctatgttgacttttcgcaaatgatttttctgcatctcttgagatgatcatttaaggaagaaataataccaattctacataaacataaaagaggggagacggccaggcgcggtggctcacgcctgtaatcctagcactggcgctctgggaggctgaggtgggcggatcacctgaggtcaggagttcgagaccagtctggctggtgaaaccccgtctctgctaaaaatacaaaaattagacgggcgtggtgatacactcctgtaatcccgggtacttgggaggctgaggcaggagaatcgcttgaacccgggaggcggaggttgcattgagccgagattgtgccactgcactccagcctggatgacagagcaagactctgtctcaaaaaaaaaaaaaaaagacacttcctaactcattttatgctagcattatcctgacgccaaactagacaattcatattaagaaaactgcaaatcagtatcccttatgaacatggatgtaagaaatcctctacaaaatattagcaaatagaatgcagcaataaatatataaaaagtaacatatgaccaagagcagtttatcctggtgttgcaaagctggttcaccattcaaaaatcaatgtaattaaccatatcaatagactaaaaaacaaaactttttagatgatgttgattgttttaacaaactaagtttgtgtaagtaggaacttacgtcctgtgattcagctgctagtggaccttgtttctagggtgtcttgaaaaactatcaaacacattaatattttaggggcaccttttttaataccagtaatctgaacaggagctggtgattctttggtgattaaaatattcatggttttctgcttttcaatccagttgaaagacagtaaacaagcaaacaagtcattagcatttattataagtacaataagaaaaagaacatagtgctttgatagagaccatcagggaaaatgtaatacatggaatagtgacaggagacctttctgagatgatataaacagacaaacaatgttatttagtatatgattgtacattatatctggcatgctttggcatgatttagtttgttttaaattgattttttaaagaaataatgtgcttttagtgggagaatgggcaagtatgtaagaaacggttataactaaaaattttgtggttgtttctttattctctatgttttagtggcagaaccaagaatagaagatggatagaaatttagttaactgacttagaatttggagaatgaataaaccctaacagcaatatccatcccactctcttttatttcctcaacctaatggaatggtaggatcttgaactcactctgttaccatctggtaattgcatgtgttgttattataatcaatgtgagcaaatactgctttaggctctgatgatgcctagtgttgtataagaatggccatcacatgtctactatatgcagatgagtattaattgttagacattagctagtaaccatgtgtctcagcagatgtggtagacagtgatttctcttgttggttagtatgctgtcagcccttttaaggatactgtgttatgctacaggtaggacttaatcagaataaaatgagttaagtgatcaaaaaaattatttaaacattttaaactctactttatttacctatgcatttaaaggggtaaatgcagcttgcagctgaaagttacagataattaaacatcaagaattacaacatttatagagtgtgatataggcaattattattatttatgaccgtactaaatcttcattgtgattattttttgtgatttgagtacagtacaaccacattatgtatattttacatattgttgtgcttcagaactaatgatttttgtttatatggacccctctccaccccaaggattattattcctactcgtgattttattgaggaggcaaaatattttctagcgtaataccgaaagggaaataaatttactttagcataactattctatttagcctgtatgcttagagttagaaaaagaattagaggtcatctgctggcttattgccttaaataatcacaataaataaatcatataaattctcataagaattctctaattagtagataccattttaggaaaaaaatctttgttatcctgtcctccttgagctgctgccttacctgttttccttctttgtaaactttccacaaagaattgttcatagctgctgcaactgctacctcatctcacattcttttccttattcattcctgtgtagcttgcttctgtgtgtaccatttcgtagtaactttttttgtcaagttcactaatgattgccactttgccagatccagtgatcacttttctgtcaccatatttcttgacctttcagcagcatttggtagaatagctcactccatctttattgaaacattatcttttcttggcttctgtgagaattctgatggtcctctattttcctaattgcttcgaagagtctctgttgctagatcatctcccttccaacttctaaggagcgcctcagccacttcatcctagactgctcatcttttttatgtgttttcttgccctagtaatgttttctgttgtatagttctaataccatcaattgtcacatagatgaccccatgttccttgaaaccctaacattgccaccaaattggaaacctgtatattcagctaactctttggtatctccatctggatgtcttatagataccttaaagttaatatggccaaaaaagaaatatgggttttcatcttcccatctctgctctaaacccttttcttccccatcttccaagggcatagccatccatgcagtgtttgaggtgatgagttgatgccgttgattcttctttcagattgccattccagagaggccgtagtatcttgatttgattcttggattgtaatctctgctttgctatctaccagctctgagaccatggacagttatctaacctctttgtgtcttagttccttaatttctttctttcttttttccttttttaaagacagggtcttgttctatctcccaggcaggctggattacagtggcacaatcatagctcactgtaaccttggaattcctgggctcaagcactcctcacacctcagccttccaagtaggtaggatacaagcttgcaccatcacacccggctaatttttgtattttttgtagagacaagatggttttactctgtttcccaggctggtctcaaatgcctggcctcaaacaactagttccttcatttcttataatctcttctaatcttgtaagatcactataaggatcaaattactacatataaaatatgtagaacaatgtcttgaacaaagcatgctctccatgaatgtcggctatttttaatattctatttctcattcctcagatctaattgatctgcaactcttatggactcttcttgcaaaggctattccaaatacggctattccaaatatggctattccatttcagctgccacagtgcaagccaccatccttagcttggacaactatagtaggctcctaactagttcttctgcttctccttttgcttccctaaaatctaatttccatatgcacccaaagtggccttaaataaatgagaatcacatcttatgacttcctgcttatcatactctactggtcttccaatgcttgtccttagaagatacttgaaacttttttgtttttttaaacttttagcttcaggggtacatgtgtagatttgttatataggtaaactcatgtcacagggatttgttgtacagattatttcatcacccaggtactaaacctagtacctaatagttattgtttctgatcctctcctcagccttcaccttcaggtaggctccaatgtctgttcctgtctttgtatccatgtgttctcatcatttagctctcacaagtgagaacatgcggtatttggttttctgttcttgcattagtttgctaaggataatggcatccagctccatttcaagcttttatcatggctgaatgaggaggtactgcccatctctgacccgctcatgctgtgctgcagtcttcgaatgtggagtctgttcctgcttcagagtctttgcacttgctcatcctttgcttgagtcatccactcctgtttgtttcatggtaggttcttgtcatctgtggctcaagttcaagtcatctcatcagtgagtctttgagtacacagctaaattagccccccaaatctgtactgtcatcctcacttgttttattttcttcacagtacttcccactttgtgaaattatcttgtttatgtgtatacttgtttatcatgtgtatcttaccactagaatataagttctgtgagagcagggatgcgtctgaagtatgagaacggtgccaggctcacggggccatcaacaaatatgtagttgtcagatggaagaatgaatagatcttataaagctgctttcctgctccagaagatctcccaacattatctttaatgcggtcatgaatcctttgcctagttcaatgagcagcattctatctcttaaagtggtttaattttttattataataatatataagtagaagaattatatttcttttattgaaacaaaatctgctttcccgtaactttctccagttgtctatcattctcattgaaaccatagagtaaatctaattgctctttaaaaaactctttaaattaaaaaaatttatttctttttgagatggaggtcacactatgttgcccaggctggcctccagctcctggggtcaaacaattctgccacctcagcctcctgagtagctgggactacaggcatgtgccactgtacctggctcccaattgctattttatgatattactaaaaatatccagggacagggatcatagtaatttaagtcctctctgaacatgcttagaaactttagctgtgatgtcttccagaaccttatcatactggtcacctgcctttgggctttcttttcttggtcattgactttcataaaatatgcctcctataggcatattttctgctgagtaatctatgtcgagtacagtgggctattacattatcttaaatgatccttcttttaaagcaaactaacattgtatcacctttgttggcaattttgtagttagtccatattgagcctgcagtgaagtaaacttcattttttcttaatccacacataaagtgttttcagtgtttcctcattatgtactttaataattattctgtctcattaaaatttatttttgctagtttctacactgccattttctcatttaactaatagttattctacttctacatttagcagttaatactagtttactggcagtaatatcaagtaattgctaggtaagtataattttacatcataattcaaatcattaataaattagtaacagggcagaatctctggctgccctgaacagaccattaaagaccagaggaagtggctttaagaacaaatttgaaaggaaagtgaattttatctatttttttaatttataaaatcagagtttttgttatttgactgtcacctaaagaatgaggaagaatttgttataatttagggacaggaacgaacaggtttttaagactcgtttgtgtgtctaggtttttaagtctagtttgtatgcaaaaacctggagggaagagatggttatagacagtttgaaaactctcaggagttcattgtggccaagttagagaataaagtaccaaaaagatactctgggcagagagaaatgaagctggaaaagtaaataggtgccatagtgttcagatccttgcatgtgagttctggcaggtggcctcgaaaaagcacttaacctcccagacgtagttttcttattggctggtaaaaggatacactgggttgagtgcagtggttcacagctagtgagcactttgggaggccggggccagaggattgcttgagtgtaggatttcagaccagcttgggcaacatagtgagacgtctctactaaaaaataaaaaaatttagctggctgtgatgatgtatgcctgtagtctcagctatctgggaggctgaggcaggaggattccttcagctcaggaattagaggttgcagtgagctgtgattgttgtcactgcactccagcctgggcaatggagcaagaccctgtctgaaaaaaaaaaaggaagataaaatgaaacctgccttgccatggcagtagaggtgaagtgggtactgctcctagctcctcacatacaagggtctcaaaacatatttacaaataattttaaatattctttatctagtgaaaaatttgtcattggaccatagaataaaaagaataagttgactgaagattttttaacagccaaatactataatttattaattatttttctcaattggccaaaattttagaggcattgtgaaaatttgttgagttagtcagaggtttttttggttattttattactcaatatttaagtttgaaaagccagaagactggtgatagaggttatgaaaccttttatcctgcttgatgtaaatgggatgcttctaattaactgtgtagagatggctttgcaaatgcatgtatagataattatctttgtgagcagtctggaaaaatatttttggtatagttttaagaccatcattttgtgttttctcccagttttgtaaatttaaatagaatacatatgtgtatcagttctatagatttgtaacttacagctacatataattattgtaaaactaatgcttttataaaatactagaaaatagaaaggtggattcacaccacccaagctaactgctaacattttagaaaatttccttcctatctttctgtatttgcatatgatcatttcaaacacagggttttttttttttaattgtaaaagtaggacattttaatgattttttttttttttgaagacgtgagtggtaaaagttgaccctcttctctaccctttctccatttcccagaggtagtctttatagctgcttttattctttgtattcagatagcttctggtgagcctgactcatggcaatctggagtcaggatctaacaatatattcagtagatattagttgcattgaatttctttatatctatctcatttaattgttgatatgagtaagaagttaaaaagcatgattctggttaaaatttaatcaagttatgattttatctactattggatcattcattatgtcctcagtttgatactaattggtatcactacagtggctgcgtttggttcctagtactttttgtacttgttagctttggctgacatagagtagatttgcagtgaactgatttacagtacttgctgattttgtccagacctttcactaaaatattctaactgtgacttttagtttgcagcacagatgtaaaattgctctgttgtatgtaccatcgtgttttataactttataacaggatgactttgtgggtacataaaattaacaaataaatttaaattctcttatcagggttcatgatacttttccttaaaaggcaatttaggtagtcttctgatttgattaatgaatgctagggttttagattaggagccaaaggtatcttttctacttcttttcctcattatacagaggcttcactgatgtatatagacatacagatggctaggttatctactaaagtagagatgtaatctttagtcagttctagaaatataccttgggtgtctgtgattcagccatgtacagtgctaggcaatgagattaaaaacattgaataagacacagttttttcccttgacttggcagttaatttttatcctttttggtttttagatagaattgaatactgaaaaagcatagactaggaagcttgcaggaagtggagaaaggagcaggaagtagttcgaagtgctttagtgaactataaatagaaccaagtaagaatggatataatgtagaggagcccattgatctcctcagccccggactctttttttttttttttttttttttttttgagacggagtctggctctgtagcccaggctggagtgcagtggcgcaatctctgctcactgcaagctccgcctcccgggttcatgccattctcctgccttagcctcccgagtagctgggaatacaggcgccagccaccacgcccagctaatttttttgtatttttagtagagacggggtttcaccgtattagccaggatggtctcgatctcctgacctcgtgatccacccgcctcggcctcccagagtgctgggattacaggcgtgagccaccgcgcccggccctcagccccggactcttatagggcatgtgacttgttccaagaatgaacctaatctttgctgaacacattcttctaagaaagtttttataaatcactacgtttcttattaaacatacctagaaccttatttttgaccaatgatatcattagcaagtagattatcttctacaagcagagaaatgaagggataaggatagttgccctttaaacaggaaggtcttgtcttacaaaactcaaatgcatgtgagatgaatagcactgtttatatacgtgtcatggcttccactggttttgcaagacctcatttgatgatctaagtacatgtgatcattcttcagggagaaatgcctatggcaccttttttgtttgtttttaatttcaaaatttcagatgttagaccagcaaatactataatgtgttcttgaggtaagatatagtgatgcatttttaatatgatttttgtttcctctattccttttttctatcatctaaaacttattttgtaatgatgtacttaaaaagttatcagcttctttcgatataaagttattaattgtgaaaatgacattctcattttttctctatgtgatagattaaggtctgacattttattttcctgtgacatcttaagaattgtaaaaaaaacactaattttttgttacagttattttgccagatataagagaggcaatgaagttaagtaggtttcattgtgtagtagaggccaggaagccagtagtttacttcctatatccagcattttctgttgttcatacaatgcattagatacatttttggcttatattactctttgctcattgatacaattcatggctatcaatctatctttaaacctcagacatcatttttggtaaataggataaactatgttgattttctgataaaatatttatttactataacttaaatgcctctccttaaaaaccaagtgctggaaatgagtttaacatatcaaccaagccaacttatatgtatttgatgaagtccaggcttattaaattcaattccaaagaaatggagtttgaaaaaagaggttttatttcacatgttatgaatgttaaatgtttgttatgtgctataaataaattgctatctcttctcaccctattcatagaaaatctgctttactaccattctgcccccctagttttactgaagtataattgacaaaaattgaacatatttagagtgtgcattgtgatgttttgatatgtgctgctttactgcattcctactgaatgtcagttacatttgtattttatccctttataggtattagatacagagtacatatttgttgatcatttcccttttaacactatgtatagtatactagttttcttttaccaactaatgttccattgttttttttttctttctttcttttaccagtttcttaaacaattaggtctacatcctaactggcaattcgttgatgtatatggaatggatcctgaactccttagcatggtaccaagaccagtctgtgcagtcttacttctctttcctattacagaaaaggtaattgttatgtaaaatagaaagtttctggtaaatacaatttttgttttattctgtcttattttttgaggcagtatctcgctctgttgcctaggctggagtgcagaggtgtaatcatggcttactgcagtctcaacctcccaggctcaagcgatcctcccaccttagcctttcgagtagctgggaccacaggcatgttccaccacacctagctgatgcttgtgttttatttttgtagagacagggcctcaccgtgttgcctggtctggtctccaactcgggctcaagtgatcctcccgcatcggtctcccaaagtgctgggcttataggcatgagccactgttcccagcccaatttctttttcttctttttttaatttacaaagtttttgataaatacaatctttaagaacaaatgatccccttcttgcataaaattaggcaatctagtcagtaaagaaatcttaaaactttttattaaagagatgatatttctattttgatgacagtaaagtcctaggttagtgctttaagctttggtaaattttcttctttaataaaaatttggttagtttgcctcagctgtgttttgatgtcacattttgatttatctgttttagaaattttaagtactagaataaacttaaatacagttttttcaatatatatatatataaggaatcttctttgcttattttaagttggtaggggaaactgataatgtaggttacattattttcaaaataaacttgaatgggaatcactaagcttaaatatattttaattggcagctttagggtgtgttggggattataaatagctgttctttgagctctgtatttaaattcaagtctacatattttagtctttttttctagaatgatatatgtgtatgtttctgtgtgtgtgtatatatgtatacgtatacatacgtatacgtatatacgtacgtatatacgtatacgtatacatacgtatacatatatacatacgtatatacgtatacatatatacacacacatgcacatatatatgtatagtggagccagaacttttaagtgcattttataatagattttgaggctatatccttctgatttttatttttaaaattagaaacagtaggatgattgcagtagttatgaaaaatgaagaagtaaatgggaagatgtgagagaaatatgttgatgatttgtcatatttgtgctcaggtcatcctattcttcaggactaaatggagccaaatcccacaggatttaagactttgcttagtcctggaaattcctggatcattttctttatgctataacaaattagcctcaattcaagataaattaaataacattgaaaattttttctcttctacttaagggttctacaaaacaaattattcaataaaagaaatgatatttctttgcatttactattcataatagagaaatttggagttaggaatttcttactgattgtctagtattagaccaaacccctacacaatggtaaggttatgattactgacatttgtagaagagttgagacaaaaacttaagtttactctcttttaatacaatgttacttttaccttttttgattacaaaaataagccaacagataactattccaggaccccagttgtaatgaacagtaaataattgaaaaaaaaatcagttgcctaaagcttagggtttcttagctgaggtgatacaaataggagtttttttgtctgaattggaaatttccaaaccattgattttttatgactttttttgtaaaaaataaattagatttgatctctttcatttagtgagtcatcagcattaaaaaggcatattatccttatcaataggatttaatttagtagattatcagagctaaaaacttgtccctgttgaaaggaagaacacagttctaaagtatttgcgtaagtaaatttgtacttacataagtagaaaatgatgtaagtaaatatataagtaagcataaatactttacttatataactataataacatgtaagtagagaatataaatagcatgtactacttttagatgtcttacagttttgtagatccctatttcagcttataggtgatatattgcaaagttattaagaggatatctagtgcattctttaggagctgcaaagtgtttgtctttgaagttccaatttagaaattgaatatgtagttgtgaatgacttaagcatactaatagcaaaggaactgtcatgggtacctcattatcctttatgtatgtatgtatgtatgtatgtatgtatgtatgtatatatatgtttatgtttacttattttttgagacagcatctcactctgtcgcccaatctggagtgcagtggtgcgatctcagttcattgcaacccatgcctcccaggtacaagtgattcttctgcctcagtctctggagtagctgggatttcaggcgtgtgccactatacctggctaattttttgtatttttagtagagacagggtttcaccatgttggtcaggctggtcttgaactcctgattttgaatgatctgcccactttggtctcccagagtgctgggattataggtgtgactcattaccctttaaagtcaatcatggtgggtttttaaaaataaattttattgtgtatatttgaagtttacaacatgatattgggttcatatacatagtaaaatagttacaatagtgaagcagattaatatatctatcatcacatagttactttttttgttacaagagcagctaaaatcttatttaacaaaaatttctaatgcaatatgattttattaactttagtcttctacttgtttttcctatacatctgctattttgtgtcctttgacctacatcacatcacatccctgctaacctctgtttcgttctctgtgtatttgagcttttccatgtatcagtgatattatacaatatttttctttctgtgtctggcttatttcacttagtataatgtccttcaggttcatccatgtagcaaatgttaggatctcccttttttaaagccgaataatatttctgtgtgtgtgtgtgtgtgtgtgtctatatctatgccaccttttctcccaaccaagtactaacaaggtccaaccctgcttaacttctgagatcagataggattgggtacattcagggtactatggtcatagactataccatgtttttatccatttagccatctatggacatttggtttgtttccatatcttggctatcctgagtaatgctgcagtgaacatggaagtgcagatatctttttttttttttgagatggagtctcgctctgttgcccaggctggagtgcagtggtgcgatctcggctcactgcaagctccgcctcctgggttcgcgccattctcccacctcagcctcccgagtagctgggactacaggtgcctgccaccacgcccggcttattttttgtatttttagtagagacggggtttcaccatgttagctgggatggtctcgatctcctgacctcgtgatccacccgccttggcctcccaaagtgctgggattacaggtgtgagccactacgcctggcctaaagtgcagatatctttacaaggtagagattcatctcctttacaaggtgattgtctcctttggatatgaattgctgggtcatatggtagtctattgttaatttctttagaaatctccatactgtttttcataatggctgtaccaatctgcattcccaccaacagtgcacttgggttcccttttctccacaccctcaccattatttattatctctttttgataattaccatcaatgatagtgttgtgttgttatcatttgttttgagacagagtcttgctctgttgcccaggctgtagtgcagtggtgccatctcagctcactgcaacctttgcctcctgggttcaagcgattctcatggctcagtctctggagtagctgggattacaggcatgtgccaccacacctggctaatttttgtatcttcagtagagacggggtttcaccatgttagcctggctggtcttgaactcctgacctcagatgatccacccccttcagcctcccaaagtgctgggattacaggtgtgagctactgcgcccggccagtgatagtgttttgaatgtgttctttgtgatagtgcggtccagccagtaaatcataggcaaagaggctataaattttatttctctctgatatttatgtctcttggccttattttttttaattttttgatctaccataatttctttttttcctttagttgctttgtatcattttaggaatttttcctacacattacatcttgaaattatcaaatcttattttgctttgtcatcaggaacattaacaacagactaagctgtagaactgtaaacttttcagcataagaccttaacatactgaacctttccagttttttatcaatcgaacttacatgaataatgtccatttattctgatagtgttacttaaaatgtaatttagaagcacaataataaaattcatattttgagcacagatacatttgttgttagaagcagtctattatttttttcttccataggcaagagataaaagaagcagtttcttaactacttgtaggttttctatagacatcgtttgtttcttttattgcaggggatcaggaaaatgtttctgtaaaggactagatagtaaatattttcagctttgcaggcctttaagtgtctgttgcaactatttgactttgccttgtaaacagccatagacaatacataatgaaattttacttatgaaaagaggcagtgggccagatttggcctgtaggctgtcatttgctgaccccgctctattggaagcagaaagttatggaaaaactataaacaaaacaataaaatcatctttctcctccccacctcaccgattttttaacctttttgctattttttactctttcttactattaggaaactgagatacagagacattaaataatttgctaaagtcacacagctaataacagctgagccaggacgtgggcccaggcagtcagctatagagcccacatttttgatgcttattattataccctattgcttttacaaccagttattatagataatggttagtgtcagttacagattatataatgtgaattttataaatatgctatgattttccaaaaggaaaaatatttttgccaatgataaacaatatagaaacgtaacaattagcaagtaaaagttctccagtaatctcttggcccaaagataacctctattaagtttttgcacaccctttcagactttccaatgtgtatatacatattttaaaaacataaatgggaattgttattaatataaactgacctataaccacacttagttgtggacaaagttctaaatcagaatatgtaaatctattatgctttatagtattctattacgatatgccataatatattttaaccaaatctccattgatgtcttagaccaatctcctacaaaggaaattgcttattggagtgtatgagaatttaaaatgttaatacatattgccatatgccctgtaacgtgatcgtacaaatacatacttttaataacagcataggagaatgcctttttccccataccttcaccttcactggctactgctattcatttttcaatcttttgtcagtctggtaggtgataaattaattcttttattttaaaccctttctttcataataatattttttatcatttgcattttttcttttacagactgagttttttaatatgttattttccacaaatacactgttgactttttttttttaatagtatgaagtattcagaacagaagaggaagaaaaaataaaatctcagggacaagatgttacatcatcagtatatttcatgaagcaaacaatcagcaatgcctgtggaacaattggactgattcatgctattgcaaacaataaagacaagatgcactttggtaaatgatttttcattactgcattttttcccccttaagatacaagttaattgcattgagcagtaggtggtgctctaattctttcttcaaactataaaataaagcattccctgcttccttgatgatgggaatgtatatactgttagaagaaatattaatccttctcattcttttatattgttgactaataggggttaaacaaatggacaaatattaataatgtaaggcttatcatttataacatgatccttacatttctaacctaccaatgaaagaatttaacctgaaaaatagtagcatacttctagtattttcatatattggtctctctgctgtatcaagcctttttaattttatcttctttcatattctcagaatctggatcaaccttgaaaaaattcctggaggaatctgtgtcaatgagccctgaagaacgagccagatacctggagaactatgatgtcggtaccttctttccgttttgatctcatgtgggcaaaagtttgtgggattgtagatgtgtttgggggttttgtcttgaaaccatagttttgagcaattatggattttattgtatccattaagaaaagccttttgtacttttcagataactttgaaatatccacaaatgctgataagttgccatttcttttctatgttcagagctgactgaatggataaaatcagtttgatttacaaattttttttttttttgatatgcagtctcgctctgccgcccaggctggagtgcagtgatgccatctctgctcactgcaacctctgcctcctgggttcaagcaattcttgtgcctcagcctcccaagtagctaggatttcaggtgcgtggcaccacacctggctaatttttgtatttttagtagagacagggttttgccatgttggtcaggctggtctcgaactcctggcctcaagcagtccctccacctcggcctcccaaagtgctgggattacaaacatgagccaccgtgcctggccctgatttacaaattaataaaatatcttatgattgactattccttactattccctccctaaaataaataaatatatacctgccagtaccctgtgtatcttttattgggaatttggaaccaggctgaagatgaaaggagaaagcaaaggtttaaaggtagacattagaccatactgtagctatttcatcagtgtaataaaggccacataaactaggctatatatataatataggttatatttaattcagatgatagtgattttaccacttcatataactgttctgaaatggtttttaaaatttattgcttttggaatcaatttttcttttgaaatcttttgaccttttaataacattattaaatagattgtaagttctttgaaattaggcgtataatctacaaattatttggttagaacaatgccttatgtagaatttgtgcctgataaattaattggtttgattatgttgttatgcattccaatatactttgagaattttaaattgtttttttctttaaaaaaaaactggagacttcataaaacatctttattatacataaaaataaacatgaaaatcagtactcttactaatgagaggtagataaacattaatattttttagggagtgtatatatatatacacaattttttaaacaagaatttgatcatactgtaatactgttttataacttgcttttttcacttatcagaaacgtattacataccagtaagtatatatttgatattatttaatggctgcatagctttccattatgtagtattgtatttcaccaataaattattgttagaaatttaatagtttttcttctttttcactattttaataaatactgcaaggtacatcattgtagctaaatctttgtaaatatccttaattatatataattatgtacaattatatgtaaatatataaactcctagaagagaagttgctggataaaatagtttgcatgtttttaaggcttggatatttatttattgccaaattgctatttataaagattgtactttcacctgtaatttactattgtgcccatttctctggatgtttgcaaatagtgggtactataagagtggtttttttttagttcaggaaactaaattctgtagcttctgataaatgcatgagttgtgctccacatttctcaattgctgactgaaactgcatgattaaacataaatacagccagagctgcagaggagcatggaacctggagaaacagatgagataagcttctttagtctctatctgtgaaatgcttactttattctagtctcaattgaataaagtgttaagtgttagttctaacaactgaataagttaaatggcccctacttagagcctggaaattacaaataatcagatattcaatttcctaagttttcagagatttacgggttacacagtacagcaattcatttgattacccagatatcattcttaaatatctagtactaagcttttcttaaatttccttcaatttgttgtttctttagaagactttaggtgttaaaatttagctttgttgtcttcatttaaaaagttgagtataggcattttttccaatgaatacctttattcttattacaggccatccgagttactcatgagaccagtgcccatgaaggtcagactgaggtatttcacattttttctaaatttttcttgctataaatttaaccatataaatttcttgctgtaaatttaaccatagtattattgtaggacataaagttttagaaagttacttggctttttgttttttcctttgagagaatttgcttaagcaaaagcagtcataaagtagcaaaaggacatgttttgacaagctgttaagatgctgctgtctgctgtttcagttcatctaatcatttagagataatgcagattgtgtgctgtttgtgcggcttggtggcctgtgtcttccctatcagattcctgtgaggtccaactattttgagaaaaatacctgcactgttgtacagttaaatagcctgtgtctttattgtgtcctgcttccagcagaaaaccacatcattttctttgctcaataaatttgtttcagggtaatgtaatgatctttaccatctttaccctgttagctagttcagctgggttgcttttcctttccttctcttgcctcttttttcattttttggtttcttcatttttccttccatcttttctttctttctttccttccccccagccctgactgtatcactctaagaggaagtttgtcagaaggtattttagtcaaaaagaatttaactaaagctgtttggtatgtttatatcacatttaagggttaataccagagaattagaggttttcttctttcttatcccatatgtgacttgaaaccacacttttttttgttttttttgagacagagtcttgctcagttgcccaggctggagtgcagtggctgatcttggcttactgcaagctccgcctcccgggtcactccattctcctgcctcagcctcccgagtcgctggaactacaggcgcccgccaccatgcctggctaatttttttgtatttttagtagagacggggtttccccgtgttagccaggatggtctcgatctcctgaccttgtgatccacctgtctcagcctcccatagtgctgggattacaggcgtgagccacctcgcccagccgaaaccacactttttcatgtaaaagatgacattgcctttatacttaaaaaaacttgaaaagaatacttgatttaaaaatcattgattttggctgagcatgctgactcacacctgtgcagtcccagtgctttggaaagttaaagcagaaggatcgcttgaggccaggagtttgagaccatcctgggcaacatagcaagactctgtctctacaaagagtaataaaaattagccaggtgtggtggtgcatgcacctgtagcactagctactagggaggctgaggtgggaggattacttgagctcaggacttcgaggttatagtgacctatgattgcaccattacactccagcatgggggacagagcaggaccctgtctctataaaatatatatatatattggttgctctaggcgctgctttcaaaggtgtggattattgtttttgactaagtttatccatacacagacacataagaggcccgtctaaaagtttttaacaccagattggaaattaatgaaatgctgttttgtattgctttatatgatcctgaacatattcataatcttcactatgctttgattttttgtttgcaaatttatagtgttaaaattggtgatgatgaggatcagcgtaagtttattgttaagatatgaagacagttacttgtaataaagcaattaaatgctttaatacatattcactacaaaaaatatttatttttgccatacttctcttgccccatttttggagtttcatccaaattatggatttacatttaaacttctttttaaatgatcttcatgtctcttttttcagacctaaccgccttcattctttccagtcttggatgcctgttagacatcatctgaatgacctcactgtattttagaatgcatttttatttgtttgagcttattatctatgtcttaaactttttcttccctttattgtttctgtttcttacaatagttccaccatactttttcccactgtaactatctaggacaaattcattaacttctggtttagaagatctgctttttatgcagattctcagtttttattccagttctcattcattttcacacacttctgctggattccctttcctgaaatgtacctgaatcagttggctgctaaaatttttctaggggtttcctagtgtgtagagcagtgattctcaagatggagtgcagatagaagttaggattttctggagggcttttttacactgctgtgtactcccataagaattaatcttttctgctcctttcccatctcccacagtttagaaacactactggagtgagcaatattttttatgtatattataaccctaaaatgtgttggagtgaaaaaaaaaatgtttgagaatgattcctcaagcctgtgcagtcagtttcaggctctttaacccagctgtattcaaagttttcctaaccctgtcttgtcttgtcttgtcttgtcttgtcttgtcttgtcttgtcttgtctttacttttccttccttccttccttcctttctttccttccttttctttaacttgtctttctaactttaattatttctttttagccatcccttatttccttattttattatttctattcttcttgcagtactctctttctgaaaatattctttccctcaatctcttgcacttcttctatccattcttcaagactcagcttagtacgatcttcagaatgaagcagttcctgattatcagaactggttatattttatcatttatatgaactctttatatgactactccaactatttgcattttagctatttcatattctctttcattttttaagatgtactttttttcacattttaaaaactctaaaattaggatgtatcttacagttgatgtcatagtttacttggcgttattcccatcttagtggttcacaaaatggtgtgtcatggaaccaatggcgccttagtgtgatgaagtatggtatcttatctccctttctgtggctcttaggcctagcattggcatctgattcatttgtgcatgttccaaattatccaatactgttccttacacataagtacaacatatgtgtattaattaaccagaattagctcagaactgtccttggtagtgtaagaaataaaaaaaagtagggggttaggggtggcaaatcttagttttctgtagtcccccgagtaaacaaaacatatccattagccattgtttccaaataggacagcattaacattttggaaagggttcaattcttttttgtgcgggactgttttgtgcactccagggtggaatatactgacctctagttgccatatgttagtgtctcccagttgctgagagaacaaaaatctgtatgtttcaaaatccagttgccatctggctttaaatccctgcttcagggacttttaatatttttctgatcatctcatttaagattcatctccctgccgggcatgggggctcacgcctgtaatcccagcactttgggaggccaaggcaggcggatcacctgagttcaggagctcaagactagcctggccaacatggtgaaccccgtctctactaaaaatacaaaaatcagctgggcgtggtggcatgtgcctgtaatcccagctatttgggaggctgaggcgggagaatcgcttgaactcgggaggcggaggttgcagtgagccgatatcccaccactgcacttcaggctgggcaacaagagcgagactctgtctcagaaaaaaaaaaaaaaaaaagattcatctctcatctatgggcttaagagtgttcggtgtattattatctccattgctgtttgtattccagcctactgatttttttgtcagttcctacaaaatacataggtctttgctgtctgtattagtttgcttgggcattcatcacaaattgttaccaggtgcctttaacaacagaaatttattattacacagttcttggggctggaaatccaacagcaaagtgtcagcagggttggcttctactgagatgtcccttcctggcttgtagactaccaccttctcactgtagccttacctggcctgtcctgtgtattcatatggagggggtgtggagagagacggggagagagagatcaattgatctgatgtctcttcctgttcttataaggataccagtcctgttggattagtgccccattcttataaccttagttaacattaactacttccttcaatgccaagttttcaaatatagtcacgttgaaggttagggcttcaacgtatgaatttggcaggggggacacaattcagtccataacaccgtctttgtgctttctaacaacccagtacacttccgggtataccgctgctctttgcagagttggagacttctcatctttcaggtctcaccttaaaagtcacttttcaggctgggcgcggtggctcacgcctgtaatcccagtactttgggaggccgaggcgggcagatcacaaggtcaggagatcgaggccatcctggctaacacagtgaaaccccgtatctactaaaaatacaaaaaaactagccaggtgtggtggcgggtgcctgtagtcccagctactcgggaggctgaggcaggagaatggcgtgaacctgggaggcggagcttgcagtgagccgagattgtgccactgtactccagcctgggcaacagaaggagactccatctcaaaaaaaaaaaatgtcacttttcagagaagccttctttcatcactgttaagtaggtccttctgtatttttttttatgataaaatcctgtttattttcttcctggcactttaaaatagtcaataataagttttttcttccttgtgtatatttgtttattctgctaactagaatgtaggtcccatgaggaaataggccttgtttgtcttgttcgctttgaatccccaagacaaactggacatatataggcatgtataagaattacatagtttgaaggtaagagcacaggatataggtttgtatactgactccactgcttattagcttaggcaggatactttcttcagcacaaaatagaaataatggcatttaccttatgggattgttgtgaagactaatgagttaattatataaactgcttagaatagtacctggcatttaatgggcattcaataaatattaggcggtaattttattttactaggcatccagtaaaatgaatctgaatggcagaagatgaggctgaagtaatagggtgaagccatatctggggggcttggattttatagatggagaaccaccaaagatggtacatttacttttcagcctactgagtttaaggtgagtttttttgggtcatatgtgtaggagtctagagctcaggcgagatatctggagtctttggtatttgggtagtagttagaaccctgagaattctacagagggagaatagtggtagaccaacaataaatccttggggcatgtaggtgttgaaagagtgggtagaggaagaggagccaataataatatagtgtaataacaagtagcttcatcactggcatcactggtactctctatcagaacgttttcatgggaatggaggaggcaggagccttattgcatgctgagatttgtagactaaatgaaaaatctgtaagttgagtcaccaaaatacagtagtctttttcagaagattggccatagcatactgctctagagtaattgtttacctacttttctccatcccaccgtgattgtctggtagatcagctaatacagaaatctgaacagtagccccacctcacttatgcttcattaacttacactgaaaggtattgctttcatctttcgcttaagattaaaaacataaaagaagaatgggatatgaggaaacaatgaggaaattaaattattagtggcagagagtgttttctttttttccattgattttccacttgctacaaccaccattttgtactttattctagatagaataaaatagtgttattagagttgctacagaagtttgatatgtgtcatttaattccagtaccagccctatgaggtattaccattgtcctcatcccccttctatagatgaggcaattgaggcacagaaggttttagttacttgccccaaggtcacatatctgctaagtgtagagctggaatttgagctgaaaccgtctggctgcagaatctagtcctagttcctctgtcctcctcctgtcacccccaccttcaaacaaacactttctttcttttttgttttttgagacgtagtcttgctctgtcacccaggctggagtgcagtggcatgatctcggctcactgcaacctctgcctccctggttcaagcgattcccctgcctcagcctcccaagtagctgggactacaggtgtgtgccaccacacccagctaatttttatatttttagtagagacggggttttgccatgttggctaggctgattttgagttcctggcttcaggtgatctgactacctcggcctcccaaagtgctggcattacaggtgtgagccaccgccccagccaaacactttcaataaaagtttgacagctaattttgtagcagttctgttaagaccagtgttttatattaggcttaatgtgactatttatatcctagcttgggataggaaacagattgtgtgagaaatagtaaattgatagcttttcagttactcctgaattttatttcttttttctttttcattattattatttttctgatgtgaagtctcgctctgtctcccaggctggagtgtagtggcgcaatctctgctcactgcaacgtctgcctcccaggttcaagcaattctcctgcctcagcctctcaagtagctgggactacaggcacgtgccaccacacccggctaattttttgtatttttagtagagacagggtttcacagtgttagccaggatggtctcaatctcctgacctcgtgcctcagcctcccaagtagctgggactacaggcgcgtgccaccacacccagctaattttttgtgtttttagtagagacagggtttcacagtgttagcaaggatggtctcgatctcctgacctcgtgatccacccgcctcagcctcccaaagtgttgagattacagtcatgagccaccgctcctggccctgaattttatttctttaaagtgggttcatgattgagttttgaagcactgtgttacaaaaattaataatagacatataaagctaagctttcaattgactaatgtgttggttgtgtgtgttattgtaatgtgtagccctaaatgaaatacggttgaatgttctactagaaaaatagttactgattttaaaattaatataacctgatatatacgtgcccagttaagaaatttaaaaatgaatgtatacagttggcccgctgtaatggtgggttccttacttgtggattcaaccaaccacttaatgaaaatatttgaggctgggcatggtagctcatgccagtaatgccagcactttgggaggccaagaagggaggatcgcttgaggccaggagtttgagaccagcctgggcaacatagtgagaccctgtatgtacaaaaaaattagccagatgtggtggcatgcacctgtagttccagctactctgtagttgggaggctgagataggaggatggcttcagctcaggaggtcaagactgcagtgagctgtgatcatgctgctgcactccagcctgggtgacagagaccttgtctcagacaaaaaagagaaaaaatatttggaaaaaaaagatggttgtgtctgtactgaatatatacagacttttttcttgtcattattctctaaacaatatagtataacaacaatttttataacatttacattgtattaggtattacaagtaatctagagatgatttaaagtatacaggaggaggtacataggttatatgcaaatacaacactattttatataaggcttgtgagcatctgtggattttggtgtcttcaggggggtcctgaaaccaatagtccgtggatatcgagggatgactgtgtattcactccaactgagacctttctgaataactgtagaatagtaagattggcaggaagttccaatttcatatggtttgggcttccactaaagtgtctagtagattagaagatctccttattttaaggcttttctattcacaaaagattctaataagtgtttttaaaattgtgaagaaatatcagtgatgtaatagtggaaacagtctgcaagtcaaatgtgaagccaagaaagaaaaatccaaaagggtattttatttgccttcagaccctacttttacttcattgccacttaactaaaaagtaattcctaaaatttgtgatttgtccatattaattgaggagccagcccagatatgggtagagatcaccttatgatttattgtttaactttttaagtttgttgtactgcccagaacccccccatgtaaattaataataataatgaaaaataacagcagtattgttttctgtttttaaataaacataccagtatggaaaaaatagcaaaagacactttttgcatctatgtatatttgctaccattctttttttagtacattttaagaacagttgagatcaagcgattttatttgacttttttcttaacatattaccatgaacattttttttgtttcatcaaaatttcctcattaaaaaaacctttgctactgtatactatcatgtgagtaaaccacaatttatttttcatttccttaacttttgatgtttagattatttttagtttctcaagttaaaaatataacttaattgaatatccctgttatctaagtattcttttgggtagcttcttgtaggtgggattactgattcaaagggataaatatttttatgattcttgttaaataatgtgaagttgtctttctttcatttgttcaatcagataacctgtttgagcacctactgtactaggcactgtgcttataattgtacatacaaagataagtgagacataatttgtgtcttcaaagatcttttacttcagtggtgactgcagctttgaaaatcgcttgccagtattgaattccatttctaaatttttgcttgtttaatagggggaaataacatgtttgattgctaatgatacttaaaagatctttagtaaaagtttttgaagttaatttaaatcataaaatatgtaattaatttacaatgaaatattaatatgtaatctattttggttagtgttgacctataaaagagggattatttgaccactggggtaaacagtgcataatttctgatttcaagtatgtcatcataaatatatatacataattaaagatacatgtgtgtgtttgtgtgggtgtgtatatttttaatttaagaaaatcctctgtttagaatctactgggcttttttggcccagccagtacagactgtcagtggcagtaaatagtataaagtttcatcttcattagatgtatatgtatagttgcatggcttcattttactctgaagtatagtttttagttatttttattattttgggattacaaagagataacagaaatcattccaataagccaaaaatgatttacgcacaaattgaggtgctcacatatttatttccctccttttggaatttatttcctcttccttcattttgaaagaatctgaggatattaggaagaagcttagttcttaaataatataaaatttaagttgccgattatcttgtaagaatcaggcggaaacaatacatgtatcatgcggttcaagatgtagagtccagttttgtcaaaagtctgaaactgcaactttctgatctttgtttttctttacttttcatacctcattttctttatttcaacatgacttaatcttttggaggcgattttattttattttatttttaaaaccaaaaatgctctgggactccctagcttgtctctgtctctcttctatctttttttgtttcttctgaacattgcttgaatagaggccttccctttccccttttctctccctccgtctgtcttcccttctttttttcctctccatttctctcctttcctccccccttctttcttcttttctgatctcagaattttagaaatggagatattaaattattacttattttaaaggaaaattcttagaccgaacttaccagttcacacttccagatctgactagatgaaactcgtctaagaatgctttcagcaataaaaatagaactgatgttgtgtttggtgatggtgaaagttttctgttagttttgttttatatcacaactttccagagtagagggtaatgttaggatataagatttttttgatttgtaataaaggagaactttatttggggctactctcaaactgtaaagaaaataatttctgggaattagtttgagaagtttaacaatggtaagcttaggtttaatgtaacatttagatgtacaggtattatattaatagatatttctaacatggagaattataaactgaagggagagaaaacataattgttaaaccagtcagggaaaaaagtctttttagaatatcttgatgtctgtgggcatcttgatttattaggtgagcaaaatgaagaaacttaccattatccagattttccatggaatatgtagtggtattttgtgtattttgatatctatcccatatttaacttgtgacttctttgccaaccgaacatggatactctgtaggaaactttgcatcttttgtatggatctggctttaatttcctttttaaaatttgaaccttaaatttactgtaatccaatgtattacactgaaatttactaaaaaatctacagaaatccatttagaattaatttataattttgattttaaactcataaagttatacatgtatgtgttctcatgcatgcgcacacacatgtccttacacatatgtgtacacacatttataatctaattttcaaagcatttggtagctctagagatgttcccaattattttcttttccatgtgccatattttagactcagcggtcttgtcctctccctctccctctcctcaaaattgttcgaggtgctcaccagctttcaagtattctcaccttcttaattcttactccttttgaaagtatgtctaccatattattataatgatggttaccattttctgaattcatgttatggggcaggctaactaagtgctgtatctaccctagtttgatcctctcaactccgtaagatagctgttaccccattttgcagatgggaaatctaagaagctgctaatatattcaaggtcacacagctagtaggtactcctgtgctcttaaggcaacaaaacgtgtaggtaatacaaattgctgaaactaaataaaatgaggtttttaaaatttgaatttctgtttttgccttaaaagcaaggctattcacagctagtaatttaaggcaaatatgtaataagttacaaatagtcattcagagttgtgccgaatactttgttcttttttgccgttaacatctaagtcagttcttattcagtacactagatttttttttcctattaaccggaaatcttacccataaaccagccacagtcttttggtaatcatgttaggtatattttagaaaacagtaattattttaactatctacccactaatgatcccttcatgttcaagaaattacatggttataaggatatttttcataataatagtatgtccatttaaatgagaaaatgctttggctgtaaaccaaaacccacttactttattttagaattttaacataatttagatttaagcacttggagtacccaccaaactaaacacttgatttcttttttttttttttttccttgagacagggtcccattctgttgctcaggcggcagtgcagtgggtcgatcttggctccctgtagccttgatctcctgggctcaaaccatccttccacctcagcctcccaagtagctgagaccacaggcatgtaccatcacacctggctaattttttttttttttttttttttagtagggtggggtctccctatgttacccaggctggtcttgaactcctgggctcaagtgatctttctgccctggcctcccaaagtattgggattacaggtgtgagccactaacaaaacacttgacttcttcttaggcagaccctctgctttgtttgattttttttttttttttaagtctggatcatttctttttagcctttacagcatttcaaatacgttggttattttatttaaaagtttaaagagtaatttattcattttttgctgtataaaaaagtgcatgcacactaactgtgaaggaaaagtaatttggcctttgaggacgtaggtggtgattgttgttgttttttgaactggttttaagtttgacaaccagaagatagatttggattatattcaggaattcagatagaaatagtaatagatgtgcccttatgaatcagtcaaattagttgacagttgatgggcgagtgaccttgcaatggaaaacactgaaattggagctgggagtcatgagtctgcctctggctttcacactcactagttatgtggctttgggcaagtcaagtaggtccttgtgcttctgaaaaaaccaaaactgtcatgcttatggtctgtattctcatagctcactttctctgtgtgtgtaagtgaatgtgtgtgtgtgtttaaactcagaggatttaaatcagaattaatgcttaaaaatctcatgcaacaattacttattaaatatcttggcattcttcctgaagagtaaaacatttaatctgcattttaaaattcctcaggtttctgaaaagcctagtctaggtttttttgaactataatgaagagatgagtttatatttcatgtaaagtggtgtatctacagtcacattatactgttgcagtgcccacatagtcagcagtgagggcacaggttcactgttaatgtcctggcaaacattggtgtcgttaatagttttgatgaaataaataattgttagtgattttggactcttcaccagaatgaaaaaactgaggaagtgagttctttattcagactatctaaaaagtgaactctctttaagacttttatgaaagattcaaaaataaactgtagacatttaatcttttccaattagtatggaagacaatgtgaaaaattagccatctagctcaagattcagctcacagtttaaattttcatatttgaaagcagagctaaaaattaggttgctttaacaattgcattaacagttaatattataaggatttaaaagttggtgtatgtatctttaatctttgtaattctaagaggaaagcctgtgaattttacgtttccataatagcacactttatttcaaagtccttccatctcttgaaatgttattgcttgaaagtctttttctgaattagatcaactctttgaaattgaaaatatatatgatgtacactgttatgtctatattatgcattatctctggaaattatacagttggagatatttgtatagtgcgttcatttagcatgaggaggtaaaaataagtctgactagagtaaaaatttagaattattgattctaatgttttaacattttgacatacttgttagaaacaatctttagtatgctatcataggagcagtaaggtagtagacaaaagctttgcctgcccccaggccttacaaagtagtttaaaaataaacaattacaatatattgatatgctatcctattttgaatgttgtaaaacattagtcacatacaaacacacacacccacaagctttgacatatgggactcatttaacagagtgtacttttagactcattatccttttcttattccttcctctgttatataagtttttattagaaaacatgatgctcaaaaagaaggctaaaattactagtgtgataacatttggggaaaattattctttgtctttaaaatagaaataattataatatgtaccttataggattattgtgaagatctgtagcatctatagtttagaacatctggtaaaagatagtaagcacttgatattagctattatggttgttgttttataacatcattttggataccaatattattactgttgactgatgcatatatagatacttgtgtgcacattttcactaaagcgtaattgtagaaaaccagaaacaaactaaaggtgcagtattacatttatggtatgtctatttaaggaataatatgttgccatgaaaaatgatgtagagatatacttactgagatgaatagaagcccaaaatttatgggtaatgaaacaaaatagctaaaaattttaacaaattgcttaaggtcaaaagtaggctaccataagactataaaattcctgtaaacagccctgaagggagagctcatatccactctctgcagacctcaatgggtgctcatgagattaagtggggacaagatgggagagaatctttaagtgcaggcctaggggaggagagcagttgctgctgtgggaaaggcgtgaagcctggattcttctctcctgtagaacaaagcctaaagaccttgagacagaaaacctttcctggggaagggaagagataaaaccaccccttttgcgggaggggcaggttcttctaccactggaggaaaagacccctgagaaagtcttgtccttgatatccagggacagaggctgatctacaacaacaaagaatgcctccacaagcccaccattagactagcaagcaccaagaaacaggtctcaaatgtgtggggatgggtcaataatatggagagagaccttctctgaggcatagcctctgagcaaaagcctaaagctgagagtggaacaagagcattgaaaaagaaaacatcctacaacccaacttccactctaagcacaaggttatgccagataaattttaaaccaatggtattctcaaggtaatcatagcaacaataaaacccaaacagtaaactcttgactaggttggcttatccccatacactaagttgtagcagaagatgagacacgcccatttttaggcatacatattatttatcacagtctctatactcctagagaaggtgtctggcttttaaccaaaagcattcagcagagctagactcatatatgatctagatgtcaaactatcagacagggaatttaaaataattaaatgctcaagtggaaaagatggaaaacatgttctatcacatgggtaatatcagcagaattggaaactattaacataagaaagaatcaaatggaaatgccagtaatgaaaaatacggtactagagatgaagaatgccattaacagattcaccagtagactcaacaaagttgagaaaagaatcggtgaatgtgaagataaatcactggaaattacccaaacttactcacaaaggggaaaaaaatagtggaaaagagggggaaaaaccacacaaaacaaacagtgcatccaacagctgtgggacaatttcaagtgatgtaatatgtgaaaatggaatcccagaaggagaagagagatggaaagatatgatgggggtgggagtgggtgaggggtggggtcttgagacaaaaagtatttgaagggtaatggccaactattttccaaaaataattacagacatcaaaccacagcttcaggaatctcagagacactaggtaggatgaatacccttatcctccaaaaaacaaacacacatatatacctactgagatacattaaaattcaaagataaatggaaaatgttgctgaagaacaaagataaatggaaaatgttcaaggcagccacatgaaaaagacagagtagatactaagaattcataagaattacagcagactccttactagaggttatgcaagccagaacacatagaatgatatttttagaaagctgagttcagtggaacaaaatatcttttaaaaataaaaactttgagacagacaaaaactgagagagctcataccagcttacttacactacaagaaatgtaaaggaatttcattatgctgaaacagtacaatgccagacagaaacttggagctatacaaagatttaggaagcattgaaaatggaacaaatgaaggtaaatataaaataaattttattcttgttttacatttcagtaaaagatgattaggattactaaatcaaagatagcaactatgtactataaatttatagcacatataaaaataaaataagacaatagcacaaagggagggagggagaaattgggataatactgttgtgaggttcttatactacatatgtagtggtgtaatactgtttgaaggtactccgtaactaaagatatatcttgtaaatcctcaggcaattactgaaaagcttaaaaagtataaacaagaagcccacagtacagataaaatagaataataaaaataatgcaaaaagcagaaaagtaacagagcagatggaaaaaataaagaactgacaatgtagatttaaatccagccatataaaacatcacatgaagttaatgaaatgtcagtataaagactcaaatgtctataaaccctcaaattgaaagaaagatcagtttagtaaaaaagcaagacacaattatatgctgtttacaagaaagtcattttaaaaaacgtaagaagataacaatcaaaaggatgggaaaagatgaactatacaaacactaaccaaaagaaagctagagtagttatattgacatgaagttaagtagacttcagaacaagaaatattcccagtgttgaagaaggacattacataaggataaagaggttatctcaccaagaagacatagcatacacgtaacagaaagtatgtgtatgcagctaacaattagagcctctaaatgtatgaggcaaacactgttagaactgaaaagagaaatagacaaattcacaattatagttggagatgtcaacactcagaatcaataaaaagatacagaacattactaaaaaattgaagatttgaacaacattgtcaaacaacttgacccttttgatatttgtggaacacttcagaaatttggaatacaacagttgaatatacagtcttctcaagtgcacatgggttagttaccaggatagaccatattctggattaaaaaatcaaccttaaatttttttaaaaaatttaatttatacaaagaatgttttctattcatagtggagttaaactacaaatcaacaatagaaaaatatctggaaaatcccccaaatatttagatattcaatagtacacttctaaataattcatggatcaaagaggaatcacaagagaaattagaaaacattttgaattgattgaaaagaaatataccaaaattgacaggatacagctaatgcaggggttggagagaaatctatagcatgaaatgcttatagtagaaaaaaacaaacaaacagaggttagagggaaactatagtattacatgcttatagtagaaaagggaaatggcttcaagtcagagatctaagtttttaccttaaggtagcaaaaaaaaaaaaaaaaaagagcaaattaaatccaaaatgcataaaaggtagaaataacaaaggtaaaagcagaagtcaatgaaattcattactgtagtagaggtcctagccaatatagtagggcaagtaagggaaataaagggaatattgtttaaaaaggaagaagtaaagcagtctctaatcacagagatcatgactttttaaatagaaaatgatttattaaaaaatggagaagggcttgatgtttaaaatataaaagataaagactgttagaaatgttccaggttaaaagatactaaggagacatgatgaataaatttaatatctgtgcttagattagatcctgggggaaatgctataaattacacaactagataactggcaaaattaaaatatgggagattaggagaaagtattatatcaatataaaattttgagggtgataactgcactgatattaatgtaagttaattcccttagtcctaggaaatactgaagaatttaggattaaagggccatgatatatgtaacttatcttcaaatgattcaggaaaaaaagttatgtagaaaaaggaaaagagtataagtgcagatgataaagcaaatggaagtaaaatgtcatagtcaaatctgggtgtttcctgtattatgcttgtttttgtaactctgtaaatttgaaattatttttttaaaaagaagttttcaaaaaggttcttcaaaaatgacaaaagaagagggccatcatacctgaagttggaaatcacatttctcacaggtgtgtttggagtaagcaaccttaagggatgaggtaatgtctttgcctctggaacaaagagcctgtttgcttactgcttgctgtaaaccagtggtttcccccagctcagtattcctctcttgtaacacagcctattcttttgcaaccatccaccctagctctgtctgttgctctcatgtgaattgccacaaacgtattgatgatcatgctccttgctgtgctataagtaataatttttttttttctctgacccaggcatctcatgccttttgccaatacccatgaaaaagtaagaggctaactgattaaattgaaagaataaactcaaatttcagatctgacagattactcttctaaacatgtcttccttatttctatttctgttcttttctcacactgaattctttgccaagaatattttcccatttcacccatcccaactttatatattctttcagtatacaatgctggtttagtaatatttccctctctagattcttagaaatttttttctccactatttattagtcacctctccttctatctcttcctttacatcatttatttcccctttttattcattgcctctttcttcttcccctattctttccttctctctttcctgttatttgaacataaccagattgaatgtgacaaatttcttattaaactatatctgtgagagaagacattatcatatacacttttgttcccatatagaatcaagtataggattcatttatgtatttttgattgactgattcttattatgagccgctaaaatgttcaaacatattttttaaccccgcatcaaaatgatagctttttttaaaggttagtatattgtatatttagattgaaggtactaagtaggattagagaattttcacagttgacaagagttttaaaaatcattcggaaagtaaaactcatgttccttaagagaaatctattatggttgttacggttagcaaaatctattatcaccaagcaaggatttatattaccattctttttatttcttctcactatgattgtagtgattgtaattttgtcatactccctcaaattttttattttatatactggtgttattaatccaatgtgacaattatgaagtcatttggattactactattatgttatcatacccttgtatactttgtagaaaactcttggctagattttccttttgtggtacaatagtgtttgaaaaggtgttcccaaaatacctaaccttatcagaattatttctctccttaacagtatgtgtcccatgttagcattaacatatttttcttggtcactttgggtttacaccacagtgattaagatcattggactctagaacttgatttcctgggtctgaatcccggttctgttacctactggcaatgtgaccttggttatgttacttaacccatttgtgctctgattcctcatttgcataacaggaatagttgtgcctgtgggttactggaaggttaaatgaacctatatatgtcaagtccttaaaaagcacctggcataaaaaaagatgcgtattatatttaatgatattgtttcctaaaagatagctaagaggccatgatattttccatgtaacctgtcagcctaagtaggaggatagtttattcagatcgtcagctttggaggaattaatttcactcttgtttatattttaaagttggctttttttttcttcttggagcttattccttttaaggaattcttttttaccaatgcctatcaccacacagttttcttctacccgttattctttgtgcattttatatgcgttacatggtttttgtgtgtgtgttactttttaaaaacattttgatgtaataattttagtggcttttacatattaatttccatgagtctgtgctatgcaaatgaggatatgtgaatattatcaatgtacacatatagaactatggcatataacctgatacttggttatatatttccactttacctgcttttaaccaatattcatacatgatcctttgctagatagattatggttattaaaaatagtagaccatatgaattacaagcatgaccatacgttgcttttaagaataaatgatcacccagtaacgtggtctaagtaaaatattctcttttttaattatgtagtcctcctcgccatcctcatcacagcctcattctagccactgcagaacgaaggcctcatcattgtgtcaccatgcatccctgccctgggtcaaacgtaaccatgtaggccctgcaaaggctaccagtccatctctccgtcttcgtcgctggcgacccttcttacgtctaccatctttgggtctccattctgttgtaagtttagtcaatcttccgtctcttcttccagtgacaagggctgtcttttttttttttttttcttaacttcggtcttcagagtgcttttctcttggttcactcaaccattagctttttctcccccaataagattgcaagcatatctctatgctttgcattctagcttgacttttgccagtgcctcagaacatccatctttccactccatatcctgccaacataacggcacctgccttttgatgagcactgatccacattcatgataatgtttaagtctggttaattgttaaagtgaatatgtgttctgttacccttcagctttctgaattcatttagttgactcaggtcaacaaatgctgtgtaccttctgagttctttgccatctattactttattattattatttttttatgtttctgagcatgactttagtctcttgccatgctctggggttactttacttactctattctcaatctaaatccttcatggtgtagggtgtttcatctaagctattattttattccctgaggtggctcaggtacttggtttaatcttgatctgatctttcctgcctattcagtttctaaagatcttttccaagtaggaaatgaagattttctccttgtgtattgatgtaggcttcccacaaatttatgatttctctttcataggctaatgatatctgcaaactattaaaaatacatttttcttataatcttgctaattatcttaaatgttgagactgatgatgcaattctagtaattatcataattgagatacactacagaattaagcaactacagctcttgtctttctgatgttttggactattaaaggcaatgactgtggtttggcagagcctccctagaaatggaatatcttaaagctttggtgtgtgccatacatttataagaaatttgacatttctataaattatgatggcttttgaagccagaggaggaagtctgattacacgtacatttaatgcttaagaacaattaaaagtcaatggcaagcattctttccttccccttatttacccttctagtgttatactcaaactgtgaagtggtatctttccttaaatatttgcttccaccaaatatcagtatggtcatcaaatacttttccatttctgctgagtatcaacaaactcacatctctttctatttcattatcctcattgggtcacgacattcttcatttttattcgttcatccatttgatatttgttgcttctctactgtgccatatgccatttgacacagtgagagatacaaggtgaactaaatgaccagggtagaatcctaaaggtgtaaattctgacatgagcacaattgatccaattctaatgtgaattatttcttttctacttaaaaatgttccaaatataaatgaacatataaaatttggcatttcctgttttatatgcttttatataatgttgatcttggctccatattagttccattgccttatagctttaaatgtttttgtagcttagtagtaaagaacatggattctagaagcacactgctcgggtttgaatccagattctaccacttactagctatatgacctacagcgtgttacttaatgcttctgtgcctcagttttctcaagagtaagatgggtataattatattacgtaccttattgggtttatacaggttgagtatctcttatccaaaatgcttgggatgagaagtgttttggattttggttggattatttatattagacttacctggttgagtatctcaagccagaacatttaaaatccacaatgctgcagttagcatttcctttgaacatcctgttggtgctcaaaaagtttgaggttttggagcatttgagatttcagatttttggatttgggatgctcaaccagtatgatgattaattatttgatacatataaaacatttagaacagtgcctggtggtatgtattaagtgctatacaattatacattaaatttagtgtatattttaatgtgacatttatatttagtatttaatttatatctaattgatttgttatcactttttaattctttgagttaactaagaagtgttgcattctaaattagggatatatatatcaaaactaattgattggaagtcaatggtactatttatactaaaagagtaggatccttatcagtagatagagacatacaagaatagtcatactacatctatgaagtgtcaatatcaggcagcagcttcaaagccaaaatggtgtttggatgtaaagtggaattttaatttttccttcatatatatatatatatatatatatatatatatatatatatatatatatatatgaaggaaaaaagatcccatctatagccttttttttttttttgccctttgtgtagttatttcttggtcattttttgaaacaagacttgctgaaatttgctttttatttatttttcttgtttttagtggaataacttttaagcaattaaataattacagatttttagactctgagactaattgaagctgactgaaggaaagggcttatcacaggttctgaggttttgtggaaggcttagaagttttgagctttgcttatcttttataatagtttgaaggcttttcataccctttttagaattttgtatttttagtatgcacttttagattaaaggtgcaacgatgcacaattttgagtcactacatttggtaattgcttacatttgcaataatgtagtattgttattggagtaatacataaggtttatataacacttaacagtttacaaagtactttcatgcagctcatttaaacctcgaggtggataagaaacccaaggcttacagggattgggtccatattcagttctctgactccagttgtactacttttacctctagcatggttgtatttactggcacaatataaaaaatagaagctataagatgtgtaattcttaagaagagatggtgttaaggtaactaataatttatgaaagcataaagtttaaaagatttagagtatttcatatcctgttggaaaattgtcttaaaatgagtaaaaggaagactctttcctaggtgaatgaataattcattatagccttttttattatagaattaaagttacagtttatataattgcctaggtttagccttaaaaaattggactctcttctgattattgataaatggagatattagactgaggtggccagtaatattttttgattctctgaccaggaaagtaagggaactcattatcactgtcttcacatatttaaagaaatatgttcaggagggattagacttttttctaagatgatggaaaatacaaggagacatatttagcctcagtatgagggaaaattctaacaaaactgtctaacaatggaatggactgcctcaaaacctagcggaggagcctctggcattagaggggctaccacaggatggagaagtgcagtactggagcaacaataaaactagataactctgattgctaacacctgtggaattctgtagttctagagtgaagctagaagagctggcttgccacatcagtttatgttgaatttcttccgttcataatttgagggaaataacctctgaagaataatgtgagattaggtgaaacactatatataaatgttttagaaacattctgtatatccaagatagtaatgtttattctgtacctttcaatatctgcatcagaaaacttcatattacaactacttgaaaatatatacttacttgaggatgaaaagaatataattttttatttaagatactatctgttactgaaaggatattaagtaatctgagatataatttgatttatgccatttgaaaacttttcctttaaaatttgtgctctatttgcatttttaacagtgattgtatttcatttcaaaccatttagatttgatgtatagctaactcatattaatattagctgtatagttactacatatcataggaagtgccagttaatcaatgtatcgactttgcatatgttatttgaatgccttagaaatgtagatattgctcatgcaaattgattggtaagctaaagaaatgtagatctagtcttaatttcaaattgtttgttaagcatcaaagcaagagaaaaatcacaggctactgtgaattgtactttaatttgttcttatcttttttcccttccttttaatcgcctaggctattttcctgcattattcatttttaaacttttaaaatccagagtgggttaaaatgcttattttactcaaagactgtttacactgcactgttgaaacatcagattatcaagttcaagtctttaagggaacatctcttttgacatcttaaaatttaactcgaaaagagtttctttaagctgttaggtgtaaaaatattttaactttcttatttcaaattttaaaaactcatacatatcagttcatgtattcatttcattcagtaagtatgcaatgtgcatatactgtataccaggcattgtgctaagtgctgaggcttctaaggtgaacacaatttttggtctttagatagttgagattaagaaagttgtgcttttagtcactgttttctttgccgataactgagcacattgtcacaaacacaggcatggtcactctttgtccattataccaaacattaagccttgaattatattggataaatgttctcttatataatttgatgttatttgtatgtgtttatgtatacatgactgatttgtttgactactaatgtatataatacctatttttccctcctattccaggcaccaagtatagatgagaaagtagatcttcattttattgcattagttcatgtagatgggcatctctatgaattaggtaagaactattttaatttgtcctggggagagaaatggtaaatgggaaagtctctacttatgataaacaggactattgatatttattgtgtttacttaaattaactggttgcctataaaattgatttgacatagcgacagttttccttttaagacagtttactagaaaaatgttattttatgtttaagcaacttataattcaaaaatgtttgcataccatcttcgcattttagcaaagcaagaaagtaaaaaccattacagggaactgcttcaaatctctctggcaatcattacaaaattattgagtgggttatcatcaatatctggctgaacaacctttagttttaaaagatagtgtaatatttgggaggctgaggcaggcggataacctgagctcaggagttcaagatcagcctgaccaacatggagaaaccccatctctactaaaaatgcaaaattagcccggcgtggtggcacatgcctgtaatcccagctacttgggaggctgaggcaggagaatcgcttgaacacaggaggtggaggtttcagtgagccgagatcgtgccatggtactccagccggggcaacaggagtgatactccatctcaaaaaaaaaaaaaaaaaaaaaaaaaaaaaagagcgtaatagttgtaatgattgggctgagtgtcactagttttcagggttttgtaatgttcctgtgattttttaaagactttacaggagcctttgttttcttcaggcatatgtcagagtacccatgattagttacttggtattttggcttatacctgtactttttttttttttaagtttacctttcagtggactatttcatggcatgttggaggagatcacataatttactcagacagaataaacttcttgtaattttttcataattggtatacaatacttattatgacttcttcttattcttttccataagaccttctcgagttttaaaaaagccaaataaacaacaaaaaagagaagttcttttcagtaattctagataccgtgagttttggttctattacctctcatttgctgtctatatattaccttgtcacattaattttaagttgtataaagatagaagattttgaaagaacacagattgtgactgtaaatgtgatccataaaatttaggtggattttgtgtttggaatattagcaacagatcgcatactttattaaaaagaaatggccctatcaaaggggacaaggaaaagaaagaacatagtatttataaaaatgtgcaaccctgagcgttgtctacaatactagagtgatttgaggagtaataaaacttaaatgagaagaagtcattattttggtagtatataatggacctccaggacagttttgaagatgtgccttgctaattgagtctacaaaatctgcagagataaagtataacagtgattggggacttcagatgtctgggtggttgctggaagcagattttctactctgaattgtgaatagtaaataataactagtggaagaggaaataaagagtgctgggacttaacagacacattctgttaacttcaagaaagtagatttggccagagcaaacatatgtaggattcataaccagagactataaatctgattgtgactttcagaatgagagacttacagagcaaacaataacatctaaaatatatttaaaccaaaagaaaacctctctaatgatctcaatgggaaggaaagagttatcttaaaaaaaaactcggttttactagttagagagctgtcttggctcagaggctaaaagggcagttagaaggaaggacatatatcaagggtaagctacatatgaagaatgatgctcttttggagcatgccaagatcaacacaaaaggattttaaaattggtttgaagtaagaacttcataaaacaaaggcagaactactgaggtcttgtttggtttagatattctttatcaagaagaatgatctgatggaaaattagaagcctactggaaattagattttttaaatgagtttaaataatttcagagtggtaaagaatagccataatctttgagatgtcagagcaataataggtacattacaaagatggacagttgctgattcattgcaaaggaaactggcagtaactctgatgcagatctaataaattcaaaaggaatattgagcaagaagagtattgagttagtgagtagaaaataatgattaagagattagcactgggcacagtggtgtgttcctgtagtcccactttctgtagtgggaagctgaagcacgattgcctgagcccaggagtttgaggctacagtgtgctatgattgcacctgtgaacagccactacacttctgcctgggtgacatggcaagacgtcatctcttaaaaaaaaaagaaaagaagacactatataacttttaagaaagaagtcatttcaaagttcaatttgctctctgtgggttcttgcattggtagattcaaccaactgtggattgaaagtattagaaaataaataccaatacaacaataaaaaacaaattttgaaaacaacataacaactatttacatagcatttatattgtattatgtatgataagtaatctagagatgatttaaagtatttggaattgtgtaggttatatgcaaatactataccatttaggtagagtatgtcaaggggcttgaacatctcaaaattttggtatgagatggggccggtgtcctggaaccagtcccccacagatatggagagatgactgtaactttatttttaaaaataaggctgtatgattgtagacattgtgcaagttaatttctataggatatctatatttaacagagaatggtggtagtctttaatgtattaattccctactctaataaattgtaaggttaaccaatgaaaaggactgagttatttctcttttgttatcaccctcccttttccttggggcctcatatagtttctggcatatgtaaaggggaagaagtacatattttaaaatagataaaatgactccttgtggatatagagtagagcattgggatttagaggtggatttggaactgattgaacaatcagattaaaaaaccattaactaataaattattgtctacctgaagtaacaggaatactttgaagcagttttagaaattttattttgaagtaacttaagatgtttgtagaagttacagaaatagtatacagagctcccatacatcctcccacagattacccagattcaattcatatttctgagccatttgaaaataagttgaagacatgatgccccattatctttaaaacttcggtgtgtattttctcaaaacaagtggatactctcctacataactatagtatgaatatcaaaatcaggaaattattataacattgatccagtattatctgatccacagaccccattacagttttcctgattatcacaataatgtcctctattcaggagccaatccaggattatgtgttgaatttgtcatgtttctttgtcttctttaatctggaacagtacctcagaatgctttcttgtctttcatgactgtaacatttattttaagagtatagggccagttactttgagattatcctccaatttaggccatctgatttatcctcatgatttatgcatttttggcaggaataactgcagaaataatgctgcgttcttctcagtgcatcatatcgagaggcacatgatgtcaatttgccccattactggtgatgtttagtgacttttaggtagtttcttcacaataaagttaagaagtatgtcatgcagttgctcatcaagcttttatcctccagattttgcatccattgattattcttgactggattatcattatgactattgccaaatggcaattaaaaaaaaattcccccaacattagaagctttccttttcctctcatttattcatttataatcagaatggactcatggattcctactttacttgaatgattataatccatgatatcatgtatttttatgctcaaattactgcagacttggcctttgaaaggaaccccttcaaactgcagccttgatgtcctgggctccagcaatccccttgtcacagcctcctgagtagctgggactgtaggcctgtgccaccatgcctggctattttttttttttttttttgtaaattggggtctagctatgttgcccaggctggtcttgaactcctgggctcaattgatcctcctgctttagccttccaaagtgctgggattacaggcatgaggcactgcacacaggccatagttttaatttttaagagttcttctgttctctgagtttgcatagcatttgaaaatatggcattctgttcttttatgtatgtagaatttcctcattttaaggatagtaataatacaggaatacctcatttgactgtactttacatatatttcattttttacaaattgaaggtttatggcaatcttgctttgagcaagcttattggcaccattttttccaacagcatgtgctcactttgtgtttctgtgtcacgctttggtaattctcccaacatttcaaacgttttattattatatctgttatggtatctgtgatcagtgatctttgatattactaccgtaattgttttgggatgccacaaactatacccatatatgctggcaaacttaattgatttcatgtatgtgttctgactgctccattaaccagccatttccccatctcttttcctctctttgaacttctctattccctgagacacaataatattgaaatgaggccagataataaccctacaaaggcctgtaagcattcaagtcacacgtctctcactttaagtcaaaaactagaaatgattaagcttagtgaggaaggcatattgaaagccaggatggtctgatagctaggcctcttgtgcaaaacaataagccaagttgtgaatgcaaaggaaaagttcttgaaggaaattaaaagtgctgctccagtgaacacatgaatgacgagaaagcaaaacagtattattgctgatatggagaaagtttgagtggtctggatagaagatcaaactagctacaacattttcttaagcctaatctggagcaaggccatacctcttttcagttctgttaaggctgagagaggtgaggaagctacagaagaaaggtctgaagctagcagttggttcatgaggtttaaggaaagaagtcatctccataacataaaagtgcatggtgaagcagcatatgctgatggagaagctgcaagttatccagaagatcaagctcagatcttccgtgaaggtggctacgtaaacaacagattttccatgtagatgactagccttctcttgggaagaagatgccatctaggacttctgtagctagagaggagatgtcaacacctgccttcaaagcttcaaaggacaggctgattgtcttgttaatgcagacggtgactttcagttgaagccaatgatcatttgatattcagaaaattttagggtccttaagaatgatgctaaatcttctctgcctatgttctataaatggaacaacagagccgggatgatagtatatctatttatagcctggattactgaatctcttaagccctctgttgagacgtactgctcagaaaaagattcctttgaaaatattactgctaattgacaatgcaccttgtaatccaagaagtccgatatagatatatttacaaagagattaatattttcatttctgctaacacagcatccattctgcagcccatggatcaaggaatcatttagactttcatttcttgttatttaagaaatacagtttgtgagactatagctgccacagtgattgctttgatggatctgagaatagtaaattggaaacttcctggaaaggattcaccattttagatgcccttaagaacattcatgatttatgggaagagctcaaagtatcaacattaacatgagtttggaataagttggttccaatcctcatggatgactttgaggggtttaagacttcattggaggaagtaactgcagatatcatgaaaatagcaagaaaactagaattagaaggggagcctgaagatgtgactgaactgctgcaatctcatgataaaacttgaacaagtaaggagttgcttcttaaagatgagcaaataaactgatttcttgagatggaatctactcctaataaagaggtcatgaacagtgttaaaatgaccacaaaccataaaggatttagaagattacataaatgtagttgataaagcagcagcagaatttgagaggattgacaacatttttggaagaagttctcctgtgggtaaagtgctgtcaaacagcatcacatgctacagagaaatctttcataaaagaaagagtcaaatgtggcaaacttcattattgtcttattttaggaaatttccacagccaccccaatcttcagcaaccgccgtcctgatcagtcaggagatatcaacatcaaagcaagcccctccatcagcaaaaagatggcaacttgctgaaggctgagatgatcattagcatttttaggaataaagtgttttttaattaaggtatgtatattgttttcttagacataatgctaatgtatacctaatagactacagagtaatataaacataacttttatatgcactaggaaacaaaaaaatttgtgactcattttattgtgatacttgcttcattgtggtattctggaagctaacccacagtatctctcaggcatgcctgtacattttttagaagttttaatttctgtatagtctctcttttttaagcctgtacatttttaaaaagtttttatttctgtggctgggtgtggtagctcacgcctgtaatcccagcactttgggaggccgaggtgggtggatcacaaggtcaggagatcgagaccatcctggctaacatggtgaaaccccatctctactaaaaatacaaaaaattagctgggtgtggtggtgggtgcctgtagtcccagctgctcgggaggctgaggcaggagaatggcgtgaacccgggaggcagagcttgcagtgagctgagattgtgccactgtactctagcctgggcgacagagcgagactctgtctcaaaaaaaacaaaaacaaaaacaaaacaaaaacaaaaccagtaaaacagtttttatttctgtatagtctctgttttttaagctccatcattcacgtcgttggccattgttgggtatttgacagtagctgatactcagttatctgcaccaaaaagcatctcgtgatgtttgtcatgtcgcttgtctcttgtacaactctgttgtcacctttctctgggggcttgtgatcacactatgcaaaaaacaagttctgaatgaattggttagttactaccaaaaagtcaggccactattttcttccccgtccagcctggaagtggcacagcccgtttggactggggtttttaggttacatgacccatgtacaaggtgcagctttttcctgcctcttttagaaggggcctgtaagtgtgacagtctctgagcctcatggattcatctgcagcgtatgcatttactgaaattacacgcaaagttgttggcaagtgacagttttgtggtagtagtgtttggaacaacagcaaattttacattttattgttttggcaaaatttttctgtgaaggaccaagtagtaaatattttaggttttgtgggctacatactgtcttttaaaaacataaaaaccagtcttagcttaaaggaggcattaaaaatacactgagggctggatttggcccatggattagaataacagtaaaaatcataattaatctttgttctatactgctattataaaaatagactgtacggttttgacatttcaggatcagttgtttaacaatcttagtctataataattgaaattaattatatgttactttaaacagctgcattcaaaggaaaattgctcactgccattttttgtttttattttattatgttattattttatttttttagagacagaatctcactttgtcacccaggctggagtgcagtggcatgatcatagcttgctgcgtccttgaactcctgggctcaagtgatcctcctgcctcagcctcccaaacagctgggactacagacttgtgccactatacctggctaatttattaattctttgtaaaggtggggtctcactgtattgcccaggctggtgttgaactcctggcctcaagcaatcttcttaaattacaggtgtgagccaccacacccagccataactgagtttattagctctttagtctcatgaatgacacacacacagaaatgatggaaaccaggaaaatacatatattaagccaggtgctgttgcatgtgcctgcagtcccagctacttgggaagctgaggcaggaggattgcttgaacgcaggaggttaagttcagcctggggaatataagtgaggccctgtctctaaattaaatagaagaaagaaaaatacaaaaggaaaaaatatatattaatttataatttggttagggagggaacagcctacattgtttacttatacttttgcctttatgtaaacattaaaaaataatacaaaatggggtggcacataatgaatgtgatagtcatataaacatagaatagtctattgaagaataagcatttaccacaaaaggatattttaagaagacattttatgatatattattgagaaatatacattataatttagaaagatagtataagttcatagaaatatggataattaagtgttcatgtgtaatatagttacaggaaaatatttcctaaaggttcttagaaactttaggaattatgtcccaggcattgtaatttagggataagtttctttaggattttgaatatttatctcaatgttagtccaaaaataggaatcacaaattctgatgatataatttatagaaattaatattactttttatggagatgaatttatgtgttgattttcattcatttttttaaaaaaaatctaacaaccaagtctattactagatgcatattcagaaatttttattatggttagaaaccatggaatcgtagaaggggctgtgttttatggattgaacttaatgaagagccacttacaagacatctgagattatggatttggatatataattgtcagttgactttgggttagcatgagtttaaataattctggacttcttaaaaaataatattgaaaaagtactagtttatttaagttgattgtgaatttgcttattttggtggtcagtaaaataaccctgggttatttggattattcctctatattactgcattgatagtacacagttaatagtagtattgtataagccatgacagtgtagctccctttcattgttttaaacatgtctgtcttacttgagatcttcctatttaaagtgaaaaaagaaatttttttaatttccaaggataaaagctggggtgataatttttaaaaaactgacaataattttgcgtattattttcaggaaacgaaagccagcattgtaataaattccgttcatgaagataatttaggctttcaaatatggaagcaaagttctaactaataacctttaataaaaaatattcatggtagcacattaaaacatttgttttaggatatattattgaaaatggcttttaacttttcttgcctcactgggggaagaggaaaatggaagttgaaagcacattatcctgtaaaaacagctaagcattcaattgtttgtctgttttccacagatgggcggaagccatttccaattaaccatggtgaaactagtgatgaaactttattagaggtaacagtaacacttgttggcccatcttcatcaatattttgtcatctttaaaacatctctaaaggtcacttgcataacattttctttgtatttggatacttctttatccttgttctctctagaaaatccaaaaagaaaatttatattagtgttaaaaatctacaacaaataaagaggttttcacagctctatgaacaaatgtaaaaattgaaaaggcaagaatagtattgaaagacttgctcattatatccgagatttcatcaaatccaggataccattaattgtatcttgatcctgattttagagattttaaaacatgaataaattgtgtggcttagaatcaatgaaacgtgatttttagttgaaaagtttcttaatagcattttaagaacacttacggccaggcgtagtggctcacggctataatcccagcactttgggaggccgaggcgggtggatcacctgaggtcaggagttcgagaccagcctgaccaatatggtgaaaccccatctctactaaaaatatagaaattagctgggtgtggtggtatgtgactgtagtcccagctactagggaggctgagataggagatttgcttgaacccggaaggcagaggttgcagtgggccgagattgcaccactgcactccagcctgggtgacagagggcaagactctgtctcaaaaaacaaacaaacaaacaaaaacttactgtatcttatacttttgtacaaagcaaattagggcacccatgttcacttttctggtgttctttatttctcatttggaaaaggaagtttgcagtgtaaaattagtatgaattagaaaaatatgaaatgtttatcatttgtaagtaaaacacttttacactgaaaaatcatacttttttttttcctccataggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagtt

SEQ ID NO: 36636 - DNA, 8881 bp, Homo sapiens
gctgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatgtaagtcctggtcttgaccaccacagcccctggagtcagactctgcctagaatgcctaccccatcccaatgactgtcccacaccttgccctcttttcaactgtagcatgaatactgtctgaaccccattatttacattcttatgaattgtcttacccatatgtcctgttgtccttgagagatctctatgctgcttcatggcagggatctcctgatcagtttttctgtctttaaggtctacaccctcaaggcctacaggtgttcactgagtgtggactcatgttggggagattagtagtcatgagtagctcacactgactttgaaacacgtctgactcatgcctgtcagcagcagggtttctaagaaatttaactaaactaaaacttcctgagaccctgagacagccatattctctctcatttcataaatgtaaaaaaaattggcttatgagagggtatgtggctttattagagtgaatacatttaaaaaacaaataaaaacaaggagaggataataaaagctaattaaatggttactatggatcaggcattgtgctgattttggcacatcttttttttttttttttttttttttgagatggagtcttcgctctgtcgcccaggctggagtgcagcggcacgatctcggcttactgcaagctccgtctcccgggttcatgccattctcctgcctcagcctccggagtagcggggactacaggcacccgccaccacaccctgctaatgttttgtattttttagtagagacggggtttcaccatgttagccaggatggtctcgatctcttgacctcgtgatccgcccgcctcggcctcccaaagtgctgggattacaggcgtgagccaccgtgcccagccgatttttgtacatcttatttaatacccacaacccttctttgagtagctgtccttgatgtacagatgggaaaacagagaggttaagtaacttgtccatggaggcacacagctaggaaatggggagactggtattcaaacctggttccatcttgctgggaaaataaaaactactcctctgctgggaagtggcaactgatgcttcccaacgtcatcttgaattaactgaccaacaagaagttctctgttgagagcccttctcactgaagctcaaccagagctcccaagatacaatatgcatctccaggcccttcttaggatcctggctgagtcatggagcctgagctttggaagcctccccacaacctgccctaggtctcaaagaaaccaagttccaaatccattgaggatgctggaagggcaagaatgaagccagaggacccaggacaagccaggaggaggccctgaaagcccagggcagaaggttatggtgtagagggatggatacaagcttggctcaaggattagatgaggcattggaatccccactctgccactgtttatccatggccaagtgactttacctctctgagcctcagtttctgtcaaggaagataacagttctttctaaataaatcatataaagtgtccagcacaatgtcaagtgtgcagtagcaatgaataaaagggtctccctccttcctttcctcttccagattcctcggacaccacaccctgctgctttgcctacattgcccgcccactgccccgtgcccacatcaaggagtatttctacaccagtggcaagtgctccaacccagcagtcgtgtgagtctcagccccatggagccctcccagagcctgttccctgaggagtcctctgagaggatgccctacccacttccacctatcctccagctgcaagcagccacagctcctccatctctagcctcagagtcccctgctatcatgtaaaaagactagacaagctgtccttagagaatcgtgcccactccaatggactatgttcccaggactccaatctttttttttttttttttttttttttttttgagacagagtctcactctgtcgcccaggctggagtgcaccggcacgatctcggctcactgcaagctccacctcctgggttcatgccattctcctgcctcagcctcccgagtagctgggactacaggtgcccacaccatgcctggctaattttttgtatttttagtagagacggggtttcaccgtgttagccaggatggtctcgatctcctgccctcgtgatctacccgcctcagcctcccaaagtgctgggattataggcatgagccactgtgcctggcctaggactccaatctttactagtgtggcctttacttgaaacatggtctggaatgctcctatgtggggaagatcaagtcagtcatccccttcagtgaagaaccccatatttcacacagtcccccatatttcacacccaatcaaatccacctaaacctcagaggaactagggagaagaggtcagaggtcagggatctataactgtagtcaaataaaaaaacaaaaagccatccatcagagaagaaataaggaaatgagattcacctttaaatatgcaagctagtatatttggaaaaatataataaaccctactatataggaaatgcctactatgtgtcaaatgtcttatgtgcctgatctttaaattacacttagctctgacaagtatgcataattctctccatgtttcaggtattgaaactaagattcagagaggtttattgatttagccaaggctgcacagtaaatgagggatgaagtccatctctagagcctcctctttctactatagcaaagtcattagtgacaattgcttaagaaatttatggtagagacttaaaaaatgaaaatggtgcaattctgaagtttcttatataagagtgaagtttttgtttttgtttttgttttgagacagagtctcactcactctgttgcccaggctggagtacaatggtgcaatctcagctcactgcatcctttgcctcccgggttcaagcaattctcttgcctcagcctcctaaagtgctgggattacaggtgtgagctactgtacccagccagggtgaagttttttaatccaaaaatttatgacactggcaaagttagaggtactcaaagacagactttggatctgatgaatccttttaagtataatggtaatatttaacaattactaattttatttctgaaaacaaatatttttcaaaagaagaaaatccttccctgagcacatactattggcagacacagattactaaagccactgtcccagcccaaccttatgggactcatagtctaataagaggggcaagacagacacagcaatgactagagtacacagcaaaaaaaaacatgacaagggaaagagagaggaaacacattcagcttcagggatttacaggtttgctgcaaatggtgctgtctgaggagagatttggcctggcagagaaaagcctagggaatgggatatatcaggaaaagggactgtcccccaggattctactttggtttatgtacagtctccatgtaggaaagcacggagtgtcaggaaaatgcagcaaaagtgctaaatgcagctgtcaagtgtaaaatgagctagaacagggaaagctgagaaaacaggagtccagtttagcggctactgttgttatccacgtgagtagtattggaggctgaacagtgcctgaaggaaaggagagacaggaggtttcaaagacagacacttttgaaaccttcaaaggtggaatttgcaagccctagcaggtgatttgagctcaagagcaagggagaaaaatgggggttaaggatgacactgaggtttccacctctggctggagaagtgtagaaccatcttaagccttgtgaaagagctgtttaaagaggaaagagctaaggtgccagcaagataaccctgtggatatgtccagtggtgatggtgaaatgaagggttggtagctgaggaaagggtgttagggctgaaaatatgacattcttttgtgggaaaaaggggtatcccaattttaaaaaggcaatgcagcctgccttggtgagtactggctctagagctagtttgctttgttaggactccagctatgacacttggtgagtgtaggcccttcaattaacctctcgtaaccccaattacctcctctacaaaatagggtaatagaagtacttcccccactgggtcacagtaagatgaaaatacttagaatatgctctggtacacagtaggtgcataaatgttagcttattattatcattatcatctaaatgcattattgcgtacacaaaaataacaggtgaaacttaaggaatgaatgagtgaattgcattcattcacttaatcattcaataaacatccattaagcatcaactatgtgccaggcccagggccagagacttaggaaaaaacgcaaagaagagaaaagggcagcagctttgagaacatccgctcttaaggggtaggcagaaggaggaagtcaggcaagcagagggtgccaaaaatggaggtaaggagggaagacttggcaaggaggggctgttctttggtatcacagtctgcggggaggttgggggcaggaaatggaggcctgagctaccctcatctcaggtattgttttcctggccttttgacttcctagccacaggtcaaggatgccaaagagagagggacagcaagtctggcaggatttcctgtatgactcccggctgaacaagggcaaggtctgtgtctgaaactctcacaccaccctaaataagaacacaaactctagaaagtatgagaggccagaatattgcttccgttcccttttcatctctgcacaccggggtgggagaaaaagagatggtcaagtggctctgagtgaggctgggaaagggaaacacaaagagaaaccaagaaatcctcattctcaccagacaatctaaggcttcactttgtctgaaaatatttaggctcaagaatgtgcaggatacatccaaaaatggttacgatggtaaattttatgttatgaatattttaccacaattaaaaaaaaatttaatgctgttaggcacagaatcaggagaaccacaagagcttaatgactttgacagacacaccaatacatgcatagagaaagaatgaaaatattaaaccaaagaatgaatgagtgatgaaatatttaaataaggtgggtacatagcacatcagaacatatttgggaataatacttccatctagggaatacatttctttttttttttaatgtgatagtaatcacaaaagcaaaggcggaatttctgtgttgtttgagacatataattcctttgttatgctatgtaatcatgtggcatactgcatgggtcaataagatttaaaaaataaacttctatctgggtgcggtggctcacgtctgtgatccctgtactttgggaggctgaggcgggtggtcatctgaggtcaggagttcaagaacagcctggccaacatgatgaaaccctgtatctactaaaaatacaaaaacattagctgggcgtggtggcgcacacctgtaatcccagctactcaggaggctgaggcaggagaatcgcttgaacccgggaggcgaaggttgcagtgagccaagattgtgccactgcactccagcctgggcaataagagcaaaacaccatctcaaaaataaaaaataaaataaacttctggccaggcatggtggcttacccctgtaataccagcattttagggagattgaggcaggaggatggcttgagcccaggaatttgagaccaacctgggcaacgtggtaagagcttgtctctacaaaaataaatttttaaaaattagccaagtgtggtggtatacacctgtggtcccagctactcaggaggctaaggtgggaggatcacttgagcccaggaggttgaggctgcagtgagttgtgttcatgtcactacacttcagcctgggtgacagtgagaccctgtctcaaaaataaaaataaataaataaacttctggatggctgcacaataaatagttgattttcttcctatgagaatctctaaaataacatatccagtatttgaacttaagtaaaatcagtgttcaaatttcaaataataataagaataatgtgcaggaaaaaatcctaaaggaaaagccaaaatgggaaagggtaagtaggcaggactgaccctgaagtaatgtgttaattggcagcgctgctagcaaggcccaaggtctcgcacaggtagaatcagtttcccagcagacaggtgaggcaggcagctggactgaccctcatgacccccaacttttacatttccagctttatcatcaatgactatagagataaggcctctgattctcataggcctccacattctggctggttacttggtgcaagtgctttgacattgccattatctcatggccctcaactcccctgagccacagtgtctagtaccaggacttttagtctcatgttgctctcatccaccctaaaggagaagtttcagagcattctagtaacaacacatgaatggtatttttccaaacttattcatacatattatcctttgagcttcacagtaattgtgcaaagaattatttctatctacatttcagagcttagcaaatagaagcagaggctttaagtgatttgcacaaaatgatcaaactaataaatggtgaaatgaagactcaaggtcatgcccatctttcgttcacccacccatgcacagatgtattcacttgttgagtgtgccaggcactgcgttgtctaaagccaaatcagatgttcttttaagaacttctcggccaggcgcggtggctcatgcctgtaatcccagcactttgggaggccaaggtgggtgaatcacgaggtcaggagatcgagaccatcctggctaacacagtgaaactctgtctctactaaaaatacaaaaaattagccaggcgtggtggggggcgcctatagtcccaactactcaggaggctgaagcaggagaatggcgtgaacccgggaggtggaacttgcagtgagctgagatcgtgccactgcactccagcctgggtgacagtgagactccgtctcaaaggaaaaaaaaaaagaggccaggcgccgtggctcacgcctgtaatcccaacactttgggaggccaaggtgggtggatcacctgaggttaggagtttgagaccatcctggccaacatggtaaaaccccatctttactaaaaatacaaaaattagctgggcatggtggcgggcgccagtagtctcaactacttgggagactaaggcaggagaaccgcttgaacccgggaggcgaaagttgcagtgagctgagatcgtgccacttgcactccagcctgggtgacagagcaagactccatctcaaaaaataaaaaaaaaaagaacttcttgtctcccacttattcaatcatgactcagttcttgagggacaccttattctctctgcatcttaagcacccagcacaaggcctggagcagaggaagtgctgagaaaagtctagtgattggcaggctcagccctgggcttcaaggctccgtatcctcttagcttttcaggctacatgcatttgtgtgaaggcgattaaaatgcacacaaatttgtttctggcttggagccctttgatccaacagatgaggaaatgttctctccttaaaagccacaaataaaatcttatggagctccaaatatgccctaccccgatatcatcataatttccctttataccttaatccacttcatcccccaaactggctgtcccggtactgacaaggtctcatcctccctcttcttctcctctcccacagctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaatacaaaaattagccgggcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcggcttaccattaaagttctcaatgcaaccata

SEQ ID NO: 36637 - DNA, 114148 bp, Homo sapiens
cctcgctccctctccggtaatgagggggctgagctgtccctccgaggagggggcctggtgtggataaaagagacgaaaaagccgggggaggtttccaaaaataaaaccgtccgggtccccttcagacggctgcaggcacagggaggaggcgcgaaggtgcagcagccgtgcgagcccagctggagtaggagcgcggactcgaggctcggggcgcgcagccctcgttccgccgagagccgggcccccagtcggccgcttcagggccccctagactcagagaagctggccgccgggcggggccgggagaacagcccgcgggcgtccagcgtgccgaccacaaagctcttcgcggtgcccgcgcgcaccactctccagccgccccgcgccatgaggccgcggaccaaagcccgcagcccggggcgcgccctgcggaacccctggagaggcttcctgccgctcaccctggctctcttcgtgggcgcgggtcatgcccaaagggaccccgtagggagatacgagccggctggtggagacgcgaatcgactgcggcgccctgggggcagctacccggcagcggctgcagccaaggtgtacagtctgttccgggagcaggacgcgcctgtcgcgggcttgcagcccgtggagcgggcccagccgggctgggggagccccaggaggcccaccgaggcggaggccaggaggccgtcccgcgcgcagcagtcgcggcgtgtccagccacctgcgcagacccggagaagcactcccctgggccagcagcaaccagcaccccggacccgggccgcgccggctctcccacgcctggggaccccacagcggtctggggctgcgcccccaaccccgccgcgagggcggctcacggggtgagcatgggagagggaagtttggagggtacagaggggagccagggctcatttgtggaggggcgtgcaggcgagaggagagggcgccgctctcataccctcgtccctctgtctttagtacttcgggaaacagccccgaggttccaaaatcgggattggaagatttgatccgctttcgaagagttgaaggcagatagatcatcatcctcatcctttcttaccaactctcccggagccccgacgttaaatcctttcgcaaggcgcctctccactcgcccgcgttcctcctgcctgcaactaacgagctcttgtagactcttgcagcgctgccgggatctgagaggcagcggggagagggcaggagggtgggcgctccaggctcttgacgcccaggggaggttgagctggctcagagcgcgggttggcggaggtgtcgggggccccatggagagaaggtagatgcgtctccaggaggggagccggcagcgaagctggtgcgtcgggacaagtgtcgtggggcgtgggtcggcctgcgcacgctgagggctggatgcgggcgtgggcgtgagctctgggtactttgggcgggaagcgtgtcctgatgaggctgcgacacagtgggcgcgtggagaattggatcagtgtgctcttgtgcatctaggtgtaagcgtgacttgggcgcgttgcagggctaagccaccgcacaaccctgcaatttacttttttgctccccctgggcaccaccccctgcccaccgcgggcgccgtcgcagagtgagaagatgccccagtaatccccatccccaatcggatcatcatggctgcgggcacgctccgccttgcctgggtatggcaggtgcctctggaatggagggcactgagccctgggcagtgaggggctgggtgggggcaccatcgggaagtctgggaagggctttggcagcctctctttgcctgggcccgatttgccagttgggtttagtcctggggaacagcatgaaagacacttgtaccccgagtcctactccaaggaccttgcacttcgcagccttggcgctctgttttccttggcgctctgttttccttggctggagcgctcttctcatatttcagcaggattgagctctgtctctttcagatttctgctcagagtgacttttggccacccgtgccccatcctctttctcctttcaccctgctttatgtttcttcatagtacttattctatctgatatgttctattcctatttatgtgtttatggcctggcctcccagcccacactaatgcaagctctatgcaaacagggacttcgttgtgtccatttctgtgtctcttgtgcctagaatagtgcctgcactggttggtattctctaggtatctgttgaatgagtggatgaactccctgctgcccatggaaggcccagcttcaagcaggcagagagtagacccatgcactgccaagtcgcttacacataggatcattcaacaagtcttagtggaaagcacctgctgtgtttcagcgttttcctttcctgatctgtgcaagtgaatgcatgcttccaaggatcctgcgtgcagagcatgggaaaggggatggaggcccagagtccaaggcattgttcctgctgggagagcaacccaattacttaatatcacgttgaagaaatgaacagatgctttctagtactggaaggttcctgttaagtgcaaaggagtggggcaactgtagctgaagagctgagtagaggggacctgtgacctggggcccctggggctctgtgggcagcatgtggggaagcagaggggaggtggcaggaggggggcctggaggtgagggtggtgtgcagatgtagcactgcccaaggacaagggctttttactgttggcactggcccaggggtagcactgcagctttggtgtaggggaacctagagacatagcttgggctggagcagggaggagcttgtactgcaggcatttaggtgcaggtgaggtgcgggggaaggtggggaagtggagcgtgggggctggagggtgcactattagaagtcatgaaataaagcgaattgtcactacaacaaagctggtggatgtgaacaggcatgtgaagacatgggctgggtgccacctgctgtacacaggtgcacacatcacatgacacactggtcaggctcctcccccacattgtcttctgcagctttgataaagagtgggttccctgacactccagtcagccactccatgtcagctggggaggacctgaggggtcatcttgtttattctcttcctccaccctggtccattctggctaatggcttctagtcaggctgatcaggttggccattcattgccttgtgagctgcagacagccagggaccaagtgccacctcctggtgaatcttggaactgcaccactgctactggagcttcttcattcattcgacaaatattttggaagaacttctatacccaggccctatactggatcttgaggatatagcagtgaccaagacaggcatactctgtcctcatggaactttcaatgtagaaaagatttattgcacataataaagacttattaagtttgtgccaggcttgatgctaggtatttgggatacagcagtgaccagagtggacaccgtccctacgctaatgaaatttacagtctacagggtttctttttcatttcttttcttttctttattctttctttctttttttctttttttttttttcttttttttgagatagagtctcttgccctgtcactcaggctggagtgacattatttcggttcactacaacctccacccccgaggctcaagcaattctcgtgcctcagcctccctagtaactgggattatgggcgcacgtcaccacacccggctaattttttgtatttttagtagagatggggtttcgccatgttggccaggctggtctcaaactcctgagcttaagcactacacccaccttggcctcccaaagtgctgggattacaggtgtgagccaccacgcctggcctctatagggttttttgaaccagcctcacagcagaccacctgtataatatttttctctacctttccctcttgttctgttattatttttctttaactttatattctgttaaaataacaggattttgtgttttatctgttttaaagtatattatgaagttttataaatgcactaaaaggtattgaaaataatataacatagtctagttttggccgggcgcggtggctcatgcctgtaatcccagcactttgggaggctgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaacatagtctagttttatcaaaccttaatattttgacatattttgattccagttttttagttgaaatttcctctataaatttgcctccttccctccccagagttaaccactaccctgaatttaattaattccaatagatgtttttacaatattactatagatacatgtatccacaaaatatacaatgttgttttgcatattttaaacttagataagtgagaccctatttcattattcttctgcaatttgtttttcccctcctcattagatttttgagatttaaccatgttaatataattagcccaagtttattcattttaactgttgtatattattcctttgtctgaatattaccacagtttatccatcctcctgtttttggacatttagatgaattactttttctaaaagtaattttctaaaaattctactgaatttttttgctattacagacagtgcttgactcatttttctccataaataaattcataactgaaaggaaactttgtatcattatcataagttgaaagcagtaccacttgttataaagagaagataactgtaggaaaattgaaatgaaaacaaaatgttcttaagttctagtcagacttcattcattgtcttaggaagctcaactctgtggcaagttccctctattggaagggggactagcgtgtgttgaggggaggacgtggcctttttcactgacatcattaggttagaaggatcaccaaaaagagaatcactttctcaccatgtaactcagattgttgaatgttgtgatctgtaaacttaaaatgcctttcctaccctcagtggctcatcccactttttgtgaaactccagattaaatgaaacaagtatcaattgtataccacatgttgggcactgtgttagactgtagaggcacaaggagaaataagaaagaaacctctagatacccaagactgagatacaaccaatgacctgagacaggcagtactaagtgatcacagcagatgcagatggagaatgagggaaggctgggtagatgtcagaggaggtgggttttttttttttgtttgttttgttttttgagatggagtcttgctctgtcgccaaactgtagtgcagtggcacaatctctgctcactgcagcctccgcctcctgggttcaagcaattcttctgcctcaacctcccgagtgagtagctgggactacaggtgcttaccaccatgcccagctaatttttagtagagacggggtttcactgtgttggccaggatggtctcaatttcctgaccttgtgatctgcccacctcagactcctaaagtgctgggattacaggtgtgagccaccttgcctggcccaggggaggttttatacaaagaaggtaatatctgatctggaagtcttggagtatgcaaaggattttaatcagtagaccagagaggaaaggcattctaggcagagagagcagcccaggcaaaggcatcgaagtgaaatccatagggtaactggggagcaacaaaccttgtatccttggaggagcaaagccttggctgtggatggttgtggagacaaggtgggggtgatggggacaattagactgcacaggaaagtaggcacatgggtgccagggggccttgtagaggccagtggagagctgtgggaggtttttaacaaagggctagtgtgatcagatttggcccaggtggaatagcagctctcccagactgctagccagatgtgttccctacagtgatgctggatactgggctaatgtgtgctgagtggtgtcaactggaagactggactcagatgatctctgagaggtaccttctagggagtcagagtgattgaattatatatcccagctgttcaggctcatttgctctctctgctagccagagcccactgaactgacaattcccagaattcccagctggttacctccctgggcctgcacccaaaactttaatattggcctgtagggatccttagagactctccttggggacctgaatctctcttgagtgccctaccagccccagcctggcctctctgcctggcagcctttgattctggccaatcctcacgtggccttacatcccttagggcctactctgtgcaggcaaagcaaggttggcccctgccctcccacagtcagctgcaaagccatcctgagggcagctggggtgacggctggctcagggggcctccttgggctgggctccatgccatgacctcccagccaggcaggctcctgcgtccgtgctgtctgggttcccacaggccctaattcttagaaaattcccagggcacagaatctgtttcctctcagagccctcctagccccacgagaggtcttgtcaccaccacaaggggtggtgacataaaagtgggtacgtagtttccccttccactggggcgcacccccggaaactctgggtctgacaagcagccctttccctgacccccgtgacatgggccctgatgcagccaggaagctgctaacggtggtcgcccagagaggctttgaggtggcccaagtggcacaactcttggctggtgggacattctgggagctccctgggagggaggcagtgcccacaactttgggccaaagggccaggaatgggcctccgctttttcaagctgcaggaatttattttgaattcttcgtaagactccaaaaaccacataagctttggggtccactcaaatgtcaaacaaactcctaagtgggaccagatgtcgccatgctggccacagagatcacaggagtggccgccctgctctgtcctttgcctgtccagcctctgcacttctccctcccctcttaccctctagttccagtgcccggtgatgatttccaatgataaggatggaagccagagcccggcccagcctgccaaggagtcagtccctagagatctccaggagaagcccttctagggagacgccctggtctaggcatgtgggtctttagctgcagagtcagggccgggtggaaactgctggtgctgctggagtgcgccagacacccggaagcaaagtttggggagctgagtgaatgccccagcactgtaggtcagcgtctcatgggggtgccctcagagccaacatcaaggagtagctgaagggctgggcgcagtggctcacacctataatcccagcactttgggaggccgaggtgggtggatcacctaagctcaggagtttgagaccaccctggccaacatggtgaaaccccatctctattaagaatatttttaaaattagccaggcatggtggcaggactgaggttgccatgagccgagatcacgacattgcactccagcctgggcgatatagtgagactcaaaaaaaaaaaaaaaggagtagttgatggaagaactctatttcgctatagagtaagtcctgtttgcctctcaaataaaaattgtgcctccacataaaaattgtgcagaggcagcttaacccacatccccagccccatcctcctaccagcttgccaccttgtaagcacctcttaaccagggattctagagccctgttccttcagtgcccactcagggctcagccttcccacgcaccagactgccgggggctgagactcctcagtgtgcattcgttggcaggtaacacctcgtatgaccttgagactgttttatgtgtgtcttccagcctcccttggatcgtcagcattggtagggcaacgaccatggtgtttttttgtgtgtgtggttttttttttttttttttttggtgagaggcaatgtagagttggagcatggcttagagttgggccaacccaggtttgaatcaggctctggcacttacctgctgtgtggaattggcaagtcactgaacctctctgaagtggcttattagctttaggatcactgtcattgttgccccagtggactgccttctttatgtcagatgttaaacattctcacctcatttaaccatcataacaactcaattaagcagctattgttatctccattgtacagatggagagagtgaggtttcccagggatgtgcagagaatggcagagtcaggattcaatcttagatttgcaagtagaatagggacagccttcccagcctctccatgttcctccaggccctgcctctagaaggtgggactgtcggaggggctgtgaatagtccccagctctgagcatccttgtgttgactctgttttggtgaccccacaggaggaacgtctgcgggggacagtgctgcccaggatggacaacagcaaacagcaccaaccactgtatcaaacgtgagtgcctccaccagtagcagacactccgctctatcaaacgtgaagtgccattccccaccctactcccagggcaggtcaagcttaggtactccagaacctggagcagaagcgtctttcctagtctgcgtcctgaagatgcagcccctatttaaagtggaggcaacatccaatggaagggaagaggtttaaaaatgcctctagctggggccgggagcggtggctcatgcctgtaatcccagcactttgggaggccaaggtgggtggatcacttgaggtcgagagttggagaccagcctggtcaagatggtgaaaccctgtctcttctaaaaacacaaaattagccaggcgtgctgatgggtgcctgtaatcccagctactcgggaggctgaggtaggagaatcacttgaacctgggaggcagagtttgcagtgagccaagatcacaccactgcactccagactgggcgacagagcgagactccttctcaaaaagaaaaaaaaatgcctccagctggacacagcttctcaaatcaaatcactgcttgtgttttcaaagcttcctgcactccctcctgctgtcctactgtgttggccccactcacactgccggcagggtctcaggagactgcatgcacctatgttctgcagaacatgcctggcccagagcctccgcatcccacatttccaagggcaccattcatgtagcatgtgatgagaatccacctctgccctggcccctggcccaatggccctggcctctgttagccactctaccaggatggtcagatgacactgtgacccatgcctggagccgtctccccttggactgctctgatgcctggcaggctggctcgaaggagagaaaagccatcttattttgtggaaaccaaggagtgagttaggaagagctagagccttcacacctgagcctcttccactgatggtatcaggagcattaacaacaacaagagccagtaccttcatagcactcactttgtgcagggtgcactttaaacatcctctgtggcgggtggatgaggaacgtgaagcacaatcaggtaacttgtccaaggtcatgtagtcaggaagtgcagagctaggatttgaatccagacaacctgacaccagggtccctcttcttaatacctgtaccctgctgccaggtatcttaccttcatttctgggcctcactttctgcatctgtgaactggaggtgatggtactattgctgtcactgctgctgctactgctactattagctaacaactgagtatgtactagtgccccacactgcgctaagctcttcacatgcattatcttagttcgacctgtcaatcatcttatgaagtaggtgtatgcttatcatcgtggcttacagataaggaagctgaagctcgggttgcttgggaaacacggccaagctctgctgctgcaagtgctgagctcgggctggacccaggcagactgactccagaactccaggctccgatctcctgggcttcgttcactcccgacaccagcgaggcctggatattccagagtgtggaatccccacagaccatagcagatatgggagtctgagggagcccgttggatctttctccttcctcccacaggcccctcttgggtccacatcagctccccaggaactccacctgactatccttcaggtgactgcccctgcctctgccagtcccaagcctggctgcaaagcctcagtctcaacagctcccttccttcaaggaccagccccaggcccttctcggtaggagggcttcacagctaatagtccaggtgtgtgaaaaaacgtatgatgttcccagcatgatggatgccttcatctgggaacatcatacgttattctatgataacgtatgataacgtggttgtcctaacaccccacttgatgggatgcgatgcgattgctcccattcccgcgagtctggagatatgggttcaccaagctcttggcttctgcctcaggcctcgtggccctgaccctctgcctgtttgaagatgcagctcaggcagaattttgggtccctcctaggacctccaaataacagaaccagagccaaaaactcaaaaacaaacaacgaagcagatctgcttaaacaccctttccttttcagggaacgtggatgcctgggggcggctcagaggtcaggccctcagtggtcaggggcaccggtggggagaaacacttgtccctcattatttatttttatttaattaattaattaattttttgtagagacaaggttttatcatgttggctaggctggtctcgaactcctggcctcaagtgatcctcccacctcaccctgccaaagtgctgggcttacaggtgtgagccaccacgcccagcccctcataattttaaagaagaaagtgagcctcagagaggcggtgacttgctcaaggccacacaccttattggaaaagaacctgagactcaaaatcagctctgagcaactcctctgggtagagaagccagggatgtgggcggccaggtggctttatgctaagcagaggctctggggctggggcctggcactgtaatttttttaacagcatcccaggtgattctaggtgtggtcaaaaatcactgagcagagttgggggtcagtcataggaagatctgccttgggggccctcctcaaacttgaatgttcccccaaccctctaggaatcacatcaaagagaagattctgattcagcagatctggggtggggcggatattctatgttctaaccagctcccaggaacgctgacgctgctggcccagggaccacactttgagtagcagggccttccaggactcaggaggcctgggcaggagggactgggacttggaggtgaggaagagggttggtatgtttgagagagcttagcctttgttgggaggttgggaggcagcgttggctgatggagaatgttgctgaggtttgagctgaagctgcagcgggtggcttcatagggggtgggcctttccccagctgccccaggggtctgggcataggtctcacttgggccctccagccctggaggttctcggtttcctaacttgctagtgatgttccagtgttattctctgccaaactggagtttcaaccctagaaactcaaggttgagtgagtttgcatactgttacagtaccagtgcatgtgtgtgggggcatccttgtgccccagtgggtgctgcgccaggatgctgaggtaggatgctgccataccttctcccctggtatttctctccctggccgtctcaccctgctgcccccggtcacccaccctgacccaggcatacaggccagctgctctcctgaagggagttgccagtgggcaacagcccctcccacttgaagttggctcgcccgtggcagggctgtgtgctcattaactggtccctgtgctgtttgcttgttgctatttggctgctaataagcctaatgagaacccacgcaggcgggcggtggggtgttggcactggatggcttcatccagagctccgcagaaggtggggctcttggctccacaccccgtcagctggctctcccccacccctgtggctccgcacctccctctcccctcccaacagctgccctcctggctggggcagagactgccaatgttggggaatgttcatgattctgtcctagcagtttcacacatgaagggatgccttcctgggccagtgagagatgggggctgacatcccccactgccaagagtaaagtctagtgccagaaccacagggagactcagtctctcccagatatctgtgggcccaacccactgcccatgctcagggagtgctggctcctgctcagttgccctctcttgcctctggcagaatcaatcccaggtcactgtcacacaccagtccatctcccgggcctgccctccttccgccctgttctgcaggtgcccattgctggaagcccagcccctccttccaccttggcgggggctagagctgggccgccatctcctcctccagtcttggtatctgcctttccttctgtagctttgccagctctctctcgggacttatgtgtttatgtatttgtggaggcagctgattgcggcctgccgggccctgcccagcagaggggaagaactggagggtgtggagtgacagtgtcctgtttatagttgcagcttttggaagactgtccattcttcccagactggctcccgcccaaccccaccccaactggggaaggggatttgaatactccctagacttctcattttatctcagcctggacgcacaggggctggggctgctttggggaggacagaagagaatccctgcagctgtcgaggagggggcaggcaagttactctcccactcctgcccccagcagcaaggctcgagattaagagcatgtactttggattctggcaccagatccctggagacgtgtttgagtcccagctctgtgtcctgggggaagtgactggcccttttctagccacagggcctcgtccataaaatgggcataacaatctatatagagttggttttggggatgaatgatatgaacgcgatagctcttactgtgcaccaggtaccattctaagcacttcatattgttcatttttaatcctcacaacagccctataagctagattggattttttatccccatttacaaatgaggtcggctgtctgtccgagtcatgcctctgagactcatcagagcccagacatgaatccaggtagcctggttccagagtgcgagggcttagctctgtgctttctgataaatgagtaaatgtgtgtagacagcctggcgcaggctaagtttagctggtattttaatgctagatcaggagaccatgctggactgcctgggtttaaatgtcagctctcagctccaccacgtggctgaggggctatgggcaggctgcttaaagtctttgtgtctcggttgcctcttctgtaaactgggatcaacattgggccctgtctcccagagttgtaaggaacaaacaccgtcacttaggtcagatgtttagctcaaggcctggcatgtgcgatgcactctatacatgtttggccttgattttgagggcagggactgtgtctcaccaccctcagcaggcagcacgctgggtacaaggtaaagggtccataagtgtatactgaataatacagagcctatcccggccgtgtgcctgagagagccctttctgttgcccaagttctatcagcccttccagaaactccccacggtgttcaggggatcctggggatggtgacgctggagtgggcctgagcatttctctgcgtgtatcacgtgggcaatggaatggcatttccccaagtccccatctcagtcctacgagaaccctgtctctcctgatctgagctcctccttggcttccttgagggagcctgtttgccccattcatgacaaccacatcccaaagtggaagactgtggcaaggtggctaagagccccagctttggagtcaggctccctgagttcaaacccttgctccatcacttactagcatggtgatcttgggcaagttgttgatggttctgcctcagtttccccatatgtcagatgaggatgagagtagtacccagtgtagttataagaatgagatgtttatgtgaggtaatacatgtaaagcagtgagcgcagcacctcgctgtgggaaatgcttaacaagccttaggaaaaggagtaagggcaagggtaggattttcatcttcactgactggttagcacccaccaggagccaggaaccaggagccaggaaagtctcatctccggatgaaccagccagtggggactctgaagttggcagggagtggtggagaggaaggtgggaggtggcgaagggtaataattatatgacctcagtggaacccagctgatatgtagggtgcactctcatcaagagaccctgtccatttcttacccctgcatgggggtacccttcctggggagatcttcctggggagcaggttaccctgaggctctttgtccaacgaggtgattaggagatgtccttgactgggagcttcctgaagccaggtgctgtgtcctgctgacaccagtggagtgcctggccctctctccacacctgtgtcctttgtacatgcttgggacctgtttatcaaagagctgagtggggaaatgatggcatgggtggctggcagtttcctccctccatccccagctgcctcttctcagtctccttcactggcttctccctctctacctgacgtcttaatgttgggcttccccaggactttccccagaccttccaaatccctcaccccaaagagggaggccataggagccaagcggagcatgaactgcccctgggtattgagtgccagcaggcactgtgcccgacaattgacatgcaatactaacagtaatgcccggggctcactctgcctggatgtgccaaatgctgccatcttccttcaaaccctcatggtgttctctgtcctggtcccctcctgtgtccctggctgctgcttctcctctgctcactactaaactgtgggtttcccaggacttagtctggggtcttctattttgtttttgcattgctcccggaacaatctgctgccttctcatggatgtaaacatcatctccgggccaatgacgcccaaattcacatgaatcctctgccaggcctcttgtctgaccttcagtctttcacatctgctgcctgctcaacatctgcgcttgatgtctcccagacatcctcatcccaacttgtctaaaatgaactcgtgacttcccttcctctgagctaactcccccgtgcaggtcttactcactctgttaactggcacccccatcgacttgactgctcgagccagccacccaggggctacagggacaccttcctctcactcaggctttgacatcaacccattaccaagccctgtttgttttacttcctcagtccctcgtggacctgcctgcttccctgctgcctctctgggccagggccctgtcacagctctcctgggtgataccacagcctgctgcccgctctccctgccgccctcaacacatcccacctgaaacttcctgcagcggcatctccacactcacccagctccctgagtgcagcctgggccactggcctctaggctggtgcacatgctgctgcctctgtgtctgctccccgtcatctctctgtgcggctggcccttgtcatctacccagtctctgttttgaggtgtcctcctcagaggggctgccctggccactcttgcttgagtggcccccaccggccttgttcttctggatcttgggccctcgactgtctcctccatccctcacgtaccaagttctgctccacttctttgtttttaatttttatttatttatttatttatttatttatttatttatttttgaaacagcatctggctctgtcacccaggctggagtgcagtggcgcaatctcggctcactgtaatctcggcctcccaggttcaagcagttctcctccctcagcctctcaagtagctgggattacaggtgtgtgctaccacgcctgactaatttttgtatttttatagagacgttttgactaatttttgtatttttgtagagacgtttcatcatgttggccagactggtcttgaacacctgacctcaggtgatccacccgcctcggactcccaaagtactgggattacaggcatgagcaaccacgcccatcctgctccacttctttgtttacctattgagtgacagtccctctgactaaattgtaagccccaaaaggacagtctctcttgtttgccatcctggcaaatcgtgcgtttgaatgcattactgttttctagagaagaacactgaggctcacagaggtgatgaaactggccccaggtgagatcccacagtcagaactcaaacatgggtctccgactgcagggccaaactgtccttcatgcccctgccctggcctctctgatttgtcagtgtttggggtggtgttctcatccttcccgaccatcctgggcctgggcgcggggctggtgctgctgtgggaggatggctggctccactccagcctagaactgtctcccctggaagctgcttctctggaaaagactcatccccagggacccctcccagcctgtctcacctctggggcccctctggcactgaggcttcctcccagacaagccttgggactgtggggatggacagacaactcttctctgctttggggcagcagctggagaggagcctaggcctctcagccctgggccatgagctgggcccagagtcttcctcctcatgcctgctggagccggtgggattggggctgctctctgccccagcccctggccccgcggctccccagccctgacctggcccagtgttgcagcatttgttaatgcaattaacagggcggtccatgctgaagggctgggggccaaggtctgactcacacctccccttcctcccctccagccgccaaacccaaacggtagaggcccgcttggtctgccagacagcgtctgcagagagcaagtgaggggccaagaacggcatctttctctcattaggaggttttatgcgaacacaactgctattttggagctgggcacttggccggcccctgagccccagtgcagtttccagccgtcctgagccatggtcctggcacagctgtgtgggagctgggtgagcccctgaggccctgacttctcccacagcctgggggctcgggtcctcagtcagggcctgggagacacagcccctgggcagagcttgagagtggagagagcgattctgaggtggattccgagggtggattccgagtgtgggtgtgagccagacagggattccctgggctaggggatctctgacatcagggtccctctccttcctgtggaaaccaaaagtcaaggttgtggagaaacagctcagggccacaggtggaccccccagtaagcagattccagggacaaactgaggtctccaggtgagggtcccaagttggatgcccaggggtgtctgaggtaaatactgtggatgaggtgcaaactgtcccgtctgcgaaggcctctagctgtgaaaggggacagggccccggcctgaggaggggatcgggtggctcagtggatagggtcttagcatcccactggcacagattttagggaaaatggaggtttaacctgggaagcagctgagcttcaggaatggggggctgggcccagagtctggagttgaagttcttcccccagaccagagcgggtggcactggaagccactgaggaagggagaggctaaaggggcccaccctgaagttggtgcctcctctatctaacgggtcatagatggagggcaaaggtgtctctggggcccaggagagagagccgatgacaaacgccttgcccggggggtagggtggcagtggggaggggcctggctatatttgacacctagaaagcagtccccacccagcaccatggcccttggttgtttatctctgtaaccagggcttgatccctggagacgtgtttgagtcccagctctgtgtcctggggcaagtgactgggccttttctagccacagggcctcgtccataaaatgggcataacaatctatatagagttggttttggggatgaatgatatgaacgtgatagctcttactgtgcgccaggtaccattctaagcgcttcatattgttcatttttaatcctcacaacagccctataagctagattggatttttatcctgagggcctgagttgacattgccctttcctggggaaagggtcatagccaagaagctcagaggccatctggcctctgggggagtggttagttttgttgttgttttaggctttgctgtgctggccagtggaacttcctgtgatgatggaaatgttctatatcttgctgtccagtgtggtagccctgagccacatgtgggtatcgagcacttgaaatatggcttgtgagactgaaggaactgaattttaaattttatttaatctgaatccatttaaatttaaataaccacatacagttcgtggctacagtgtgagactctcttgaacagcacagctttagagagtacaaagtacacccacgtccaggtgctcagctgacactcacaacagctctttgaagcaagaattatcagccccatatcgtggacgaggccactggcacactggtggagacatctcagcgagatgacatgtgtccaaggtcatgcagctgagatgtagcagagctggggtcaaaccaaaccaatcctcctgcccccgaccccgtgttcttgctactacccagtagccaatgagcaggggctctgagcagatggtaggagcagcctgcatggggtggtcgggaggggctgtttctagaatctctcccaggcctgcccattctgagtttggtcccttcccaaaagtaggggttttgtgtggaaaatctgagcaaacctctgttgactgttctggggtggagtgaagggagaaggggctcagctaggaacatggggagattaggggaacaatgccttttatttcttgcttttaaagcaatttcaggagttttcttcctcttttggcgtcctgctgactccacagagcggaacacccaaagctgggactttccacctctctaatgctcagtgaagagcgggccaggggggtgtggaaaagaaagggtcctggaggagcccaaattacgaatggctagagactggcattggcaagcgaggaggcttcgtcacagtgtagtcttccggttgtccgagggtactgtcccaggggctggggggtattccgtcttctgcagatcaactcccgcaggctaaatgtggacatcgcggtatcatgcttgataaacggaccaataatcaagtggagattcattagaaccacataacccatactaggttgatttctcaagtataaggcctggtctgttgcccaggctggagtgcactgacaccatcatggttcactgcagcctcaaactcctgagcccaagtgatccctcccacctcagcctcacaagtagctaagactagaggtgtgcaccatcacacccagctaatttttaaagttttttttgtagagatggggtcccactctacaaaatatataagtataaggcctggtctgttgcccaggctgggcaacccttggactaaggcaatcctccagcctcagcctcctaaagtgctgggattacaggcgtgagccaccgcacccacctctaggatctctactattgaggaaaaattggaggcatcaaactccaagggcaaaacatgaagactcgctggcccaccatggatggaggttttctctcttaaaattcccacagcaccgcatggaactgcctctcctgggacctcagcgtttccttctttgctctaagcaatagcctctgccactggagattctgagatggccgatttccttttggatatttaagttttgaaatcatgctcatttggcataggaatgtttcacttcagtctcctttaaacaaaaggacacacaaccacgattgcccctccctcccgaagggtcactggacttcatgcatcagtaatgtttccaaaaatatcttaagtaccaacatgcagtggccagcttttcatttttccaagtgaagccatcaggaaaaaacaaaaaacaaaactaattaccacttgtcatcacctttaattaaaaagaacattttaactccaaaaatgtagaaaagacatcatctcaaaagacactctttagatgggaaaaatatagcctatgaaaaagaaacaacccaggaaagtgtttcttttcctgactttatggcagatgggtaaaaactgtcagaactgtcccattcatagacaggcactggaagccaccatcatggaccatttaggggtgacttttgggggaatggagagagaggagaggagtctacatacttcaatcccataatgcaaacactcagctcaaaacacaatgcttaatttccgtgaggaagccaggtagttccaggcatcttgccgagacttgtgaaaacaagagaggatgcgagtgaagccggcgagagctggttctaaacctccaaaaacctgaaacttcttggaggctctgcctcagcagattgggcctctgcacagcatcctacatggttaattcagaagggttaccttcctgaggggatttttcccaccaacacgtctggctggtttggaagccttttagaacttgatttactaggctattatatactaaatgccatttccacagttccccctaaccactcatttcccatgagctgtttgttcattgtaccaaccaaagtttgccagccctaaccctcactgaagacctaattccctgcttggaaaatggtttctaggaatgtgggaacccccactggccagggcttctccctctgcagggcccagtcttgttcacctttctggcctcggcacccagtctgatcaagataaggtgctcactacatgttttcggaatgtattattagcaagcaaggcagaaccagagctaagtgagtcgtggtgtgccgtaggggcttggctcacagggtttggggtcttggatttctagacagtgaaagatcttattttatatatatatttaatttcaatagcttttggagtacaaatggtttttggttacatggataaattgtttagtggtgaagtctaagattttagtgcacccatcaccggagtagtgtacattttacccaatatgtagttttttttccgcaacccttcccactctttcccttctgagtctctaaagtccattgtatcactctgtatgccttttcatacccatagcttagctagcttagctcccacttgtaagtgatgacatgtatttggttttccattcctgagctacttcacttagaataatggcctccagctccatccaagttgctgcaaaaagacattatttcattcttttctatgactgagtaatattccatggtgtatatatatatcacattttctttttcttttctttttctttttttgaggcagagtctcactgtcgcccatgctggagtgcagtagcacgatctcggctcactcctgggtttaagtgattctcctgcctcagcctcccgagtagctgggattacaggcacctgccaccacacctggttaattttttgtatttttagtagagatggggttcaccacattttctttatccactcattggttgatgggcattaagttggttccatatctttgcaatcatgaattgtgctgcagtagacatacacgtgcgggtgtctttttgatagaatgacttctttgcctttactcagtagtgggattgctggattgaatggttgacctacttttggttctttgagaaatctccatactgttttccataggggtggtactaatttacattcccaccagcagtgtataagtgttcccttttcaccatgtctgtgccaacatcaattgttttgtgactttttagtaatggccattctggctgggataaggtggtatctcattgtggttttaatttgcatttccctgatgacgagtgatgttgaacattttttcatatatttgttgtatgaaggatcttattgttaatgtgaaggatgggctgttctcagggctcaggaggggaaggatggaagctagactgttttccaaaggccatcctcggggcaaggaccacacactcagaggtggaagctgcatgaccttcctctcacccacgccgggctttgggtctctgtggcagagaggtgtgggtccatgtgggagatcactcaggccttcccattctattccctccctaaaaaaaccccaaggccgagacctgccctgggcacatctgcttcctccatgttcactagcactggcgtggctgctgggctggccccagctgaccatgtttccagtggtggtggtgacaggggcctggcaggtggtcaggtggggactaagtatgcttgggcagatggaggggtggccaggccaaaatcctgccgtggtggcagtttgtgtttggggaagtgctctgggttacaattctctgacatggttttacctagaggcctggagcctgccaggaagaggtgcctgggcatgaagaaaaatgctctggcctcagagcccaacttgtggttggaatgctattaaaacctgttatttcccatgctctctgctgatagactggtcttgagtgcccttggtgcacaatgtccaatttattcatcctttgtgtctctggtcagcatcacctcctccaagaagccttccctgactttccctactccctgcctcagcctgggttagagggtccagctgacatagcacttgtcatataacttgtgtgttctactttccgtgtcagacagtgtgctggagacactatcacaagcttcacatccagtgagtgctctacgaatgctcattggataagcccatgagatgacgtacatcctccatcattatttaaaaattctgtgtgggctttggaagggtgtgtggtcctggggtctccactgtcagggccaattgagatgtgcagtttctcagggcagagttcccaagggtgcatttggtggctgacttgaagccaacagatcccctttatttccttatcagctctgggccaaggctcagaaatagtagagaggaagaagaagaaccatgcccacccttctgggagtcagtgggggtggaaagagcctgggcttctcagtcacatagaactagatttgaatcctggctccaccattaactagctgggtgacctcaggcaagtctcttaacctctctgagcttcagcagcattatctgtaaaatgggaatcatagtcacacctgctgcatagaattgtcgagaggcttcagtgagagcgtgtatgcagagcacggtgccaggcctattgtcacactcatcagacagtatctgccataataaaaataataataatcatgttattgttaggcatatgttaggagctaaagttacaaagaggtgtaagagacagtcactacacttcaaggggctgactatatgagtcaggaaattgagacacatgcataaaaaaactaatggcagcggcctcgtgcggcggctcacacctgtaatcccagcactttgggaggccgaggtgggcggatcacctgaggtcgggagtttcagaccagcctgaccaacatggagaaactccgtctccaataaaaatacaaaattagcagggcatggtgtcaggcgcctgtaatcccagctactcgggaggctgaggcaggagaatcacttgaatctgggaggcggagtttgtggtgagccgagatcgcgtcattgcatccagcctgggcaacaagagtgaaactccgtctcaaaacaaaaacccaaaaaacaaaaacaacaacaacaaaaactaatggcagtatgcagggcacgcccagtgaatggcaaacacgacaagtgtttttcctgttaatcaaaggagggagcagctgctgagaggtgggtgtccagcatggggaagtgggtcttgagggaacagtaggagccaggtaaatggagagcaagtgggaaagaagagaggacatagcacatgcaaagacagagagaagacagagcagaggctacctggggccacagccagcaggccagctcggctggagcacattggcttagaggaatgttagaggggatgagaccaggagggtcttcagcgctcgtctatggacttgaatcctgaagacatcagggagccattgaaggtctctgtgacatgggccaggtggaattttggagatgtttatcccggccagcccctggtttggattctggtactcttctcagaaaggagagttcagctcacaaaacccaggaacctgctctgggtagctgtgcctggtagtttcacaggtgcccttaggatccctgagatgacagggtctgtgtatctgcctcctcttcctcactgaccttgcctacacctcctccgccaccagaccctggccttcctgggtctctggcggcttctcgagtatgccacgttccttccagcctccacagcctggtcttcgcctcgtcctctgcttgggaaactgcccaggtctttgggggttcgcttcctttgcacgctcccatctctctcttcagagaggtgccctggccgccccatctgagtctcctggttcggcctggacccctgcatcacctgggttgtcttcacagcccttgaaactgcctgaggccacatcatgctattgttttcttgcttcctgttggtgtcctttactcgaccgcaagccccagatggacaaggactttgtcccagtgcctgacattcactagggctcaacagctatttgttgaatgaatgagcgacagatggatgaggcattgggtttcgagggtgcggtgtgagccagaccatgcttccggggctcacatgtgttccccagtggaggtcctggtgggggaggggccggactccatatcccagtgtgtgcctctgcgtggaatgttcccttggccattaatcatgggatgtggctctggactttgcaagggggtgaaggacagtgaagagaggagtcagcctggggagctggtggctaatgctgcatagggctaaccgggaggagggcctggtttcagctccaccttgcctccggctggacccacagcccaggaggcagaatccagagagagcctgagcctgaacagaggccccacagagcggggcacttacctggccggcagcggctgtggtgccggcagctatattctggccaccgtgctttctctggccgcagtcgagagttctgccttgctaaggagggtgggagatggagaacaatgggaaggagaggagagaccgtcaagctgaaggtgcctttgaaggacccttagagtcctccagcctccttagttcacccctcccgtgatttaggcgcaaatagaggctcagtgaagtcaagaccatgcagctcacaagtgacaggaaaaccccagcaactcaaaccgcttgaatttcaggccagtgttgggccctttcccgcaaaagagactgattcattcatccattcgctccatgtttactgagaatctactctgtggcaatccctagtcaaagttccggggccgctgtctgtcctcagggggcttccagtctggtgggagtgaacatttcagtatagacacagtgtcaggcagtgcacttcctcttcagggtgtgctgtgggacgtggtggtgtgagccactctgcagctggccatatagtctttggttgtccagagatcagaggtgaacaagtcctgggggtctgtggatggaggtgggagagacatgggtcagggagccccctgaggccaggagagtggcttcctgcttgagcgacagggttgcagcactcaggagggcccttctgacaggaaggtgtgggcagctgtggtctcagtgccctatggccactgctgtcacctctctccctgtgtcctcagccgtttgcgagccgccgtgccagaaccggggctcctgcagccgcccgcagctctgtgtctgccgctctggtttccgtggagcccgctgcgaggaggtcattcccgatgaggaatttgacccccagaactccaggctggcacctcgacgctgggccgagcgttcacccaacctgcgcaggagcagtgcggctggagagggcaccttggccagagcacagccgccagcaccacagtcgccgcccgcaccacagtcgccaccagctgggtaagtccccttctccatggggcttggggtctggggctcagtctctttttggaggggcttcttcctttggaccgtttggtgaaggctggtggagaaggccgcagagtcctcccttctctcctccccaccctccttggctttccctggcatggccagagatatgagcaggagagtaggtgttggggctggcatgggctttgccagcctggggtgggaagaggaggagggaagcgaagtctttgccctcgagtgcctgaaagaaagctgaggagggcgtgtacctgggaccacggcttcttggttcacagcctggctttgccatttcccaggtgggccaccccaggcgagtcacttacctctctgtgcctcggattctgcatcagtaaggtgggacaatgataatacctgtgctatgaattgtcgtaaagattaaattagtcaatataaagaaagtgcttagaacagtgcctggcacatatggaagctctttatacttgttctcccacaccccatcctgacctcctcctcctctgcctgtggtccctgtgatgtaggaaggactcctctgccagaagaagacccttcggtttcctcggcacccagcttcagcctctctccttagaggggagaagaaggagcatgtgggagaagggagtagaaagaaaagtgaacaaggggagtgttcatgggcaggattccctggcctgcttgccagcccatctggctagactttttctagctcaggacaggaaatctgaactttataaacgagtccatttctaggggactgtgttttccttttcgtttttcaggttagtttttccattcgctttctgcttaagaagttctttctgaaatgttgcaaccttgccttgctgaactaaagggaaagaggatttgctctttcagagcccaggagaaccagggagaggaggccgaccttgaggttaggttccagcaggaaaggttaggagagactggctgagttggagggagagcaaagaaaggaggttgagggtgtccaggaactctgagagtgggtgaggtcaggcggaccaggatcttggtgagctgggttccggggccctggtcacccaagcagatgttttccaagggcagctaggagcaggaagaaagaaaggatggactcaggtcaagggcctagggaactccaaggtcaagagcaaaagagccaaaccctgcagccaaggcccaggggtgctgcagcagaaacaaggagcagagctaagggtcccaggtggataacaatgagggcctgggattggcagtgagcaggtgggcagtgccggtgccttgttctgatcggtcctggctgagggtcctaggtggtaagcctggtgtaaggcacctggaggaatactagaggtgccagttcaagggccagccagggcaggggtgggcacagagtccttccagcagagcttcccccatctcttttggcttgtgggattcatttatttatgatgcactgatcccatgtaggtgtgtgctaggagcaggggttgctgggcaagtcactctgcctctcacactcttgaatcttgagtcagagccgtttgaagtcccctgctgcatcttcccaccagtctgactcctccccattcttcaaggtgaatcacattcactaggctctctggcccctgcagcacttactctctggcatgcatctgcgccctgcacccccagctgcttgtagacccagtggcctgtgctctggatttctctacagcccccctgcatagtgcctggcccatcaaaaatgctcagtccatatttgctctgacactgggtccaaactacagttagcctaacaaaagggcctacttggcgctgaaccctcagctgtacctgcagccaagggcaccaccccatgtgttgctcagagggcaggaggaggtgaggcccctgccggttcccatggtgggttctccatttttccctagcgcagcacttttcaccctgccttcagatgatctgtccatttgctcactggaccaggagctacccgggagctcacagggactgtgttctgctcattcaaaattgtgtccctggtacctaacaccatgcctggcacacttctgtgctcaatcagtgtaagttaaatggataaataaatgaggctaggtgatggggagaggggaggctgcaaggccaggaggatgggcagtgtgagccttctatcccccagtgaaggtttcctgtgtgtgacaggcagtggagggccaaggtcctgggtgaggtctctggcccacagcagggctgtcctctttgactttcacaggctccctggccaggggctactgtgatgttcttaatgagctgcagcctccaggccagcctagtctctctgtgccctggggcctcaatgccatgaaatctgggagtgccctactgttggcccagctgctggcccagctgtgttttgctttaggaggccaaatcctgcttgcctggtggtgtcagacatttcctgtgaccttggccaggtttctcaagcagttgctggcctctctcctgatagcaacttggacaagccctgtgtgtccagatagaggtggtgacatgacacagggggcattctaggagttggggagggaaatgtctggggaggggaacactgcagggattggtgatggccagaggccctctttaggagagcaggcagagaccgagagacttgtgtcctggaggaagaccagagggagaggccaggagtgtcccaggcagcaggcagggtgccctacagagggccagatgtggactgatgctgtccagctgttgtctgggctgactggaggggcctggagactcccttgagcctcatgtcctggcttcttccccaaggctgggcagagtacctgcctcacctggagatcaaaagccaggcagctgggaagggcctggagagatgggagagggctggttacaggaacctgcaaccagcaggctttggaaagcagtggtttagaccagcacttctcaaactgaaaccagtaggtaagtcacctgggaacttgtcaacatgcaggttctgattcggcaggtctaggatgatcagctctaacgtggtcccacaggatgctgatgctactgggccacggaccatattttgagtagtgagggttagagcccgggctttggtgcattctaattctggatttagcactcaccagctgtgtgttaacaggcactcatcctaacctctctgagccaatagtgtccacctgataggatgacaggaaagattaaatgagaccatgtgagtagaacacttagtgtggtgcctgatatgaattagtgttcaatacatgatagctgtcaatgggcaggatctctttgctgtgaggacttgggtggatgggaggaggtggcaacaagcagagagaggaaactggagtgtgtgtgtgtgtgtgtgtgtgtgtgtgtgtgtgtatgtatgtgtgtgtgtgcatgtacacagaacaggtgtagacctgttctgggaagaaatcagagcccagactcagcctcagtggtcagcaggtccagtagtggctttggctggcttgggatacagttattccaccaggaccattgtcaccagccctagggaagaggaggttaaggggaggtgtcaagaatgggagggacctccactgggtttgctctagacctgaggacctagaggctgagccctggagacatcctacacaggcttgagaagaatcacttgaacccaggaggtggaggttgcagtgagctgagatggcaccattgcactccagctggggtgacaagagtgaaactccatctcaaaaaaaaaaaaaaaaacaacaaccctaggcaggctttgtcacaacatgggcaacaaggggcctgaaggcagtgctgagccctgagtggggtggctggggtgtgtctggggagctgtgaccctgtggtggtggcttccagcaggctgctcctgcctggtcgctccctctcctctggatctcttcctctctgcacaccccacctctttatccactgtattcgttttctatggctgccatgacacacgatcacaaaattagcaggttaaaacaacacacatttatttctgtacagttgtataggtcacacatctgaaacgggtctcaccaggctgaaatcaaggtgtcagcaggctcctggggctctaggggggctcggtttcctcgctcattcaggttatctgcagaattcagtcccttgcaattgtaagacggaggccccatttccttgctagctgtcacttgagggccatatcaggagctgccctcattccttggcttgaggccaccttcctccatcttcaaggccagcagcagcaggtggactccatgtttggatctcccctctgcctgcctctttggctgtctgtctccctgactcactcccttgcctccctcttctacttttaggggcctatgtcatgaccctgggcccaccaagataatccaggaccatctctctattttaaggtcaactgattagcaaccttaactccatcggtaaccctaatttccttttgctatttaatataacatattcaaaggtgtaaccccaggaacagagatcatgggggccaaccacacccactcactacagcacattccaactgggacccttgtccaaagtggaagagctccctcttatcaagggcttgccacaagggtggccctatgtgatctggccccaaagcctgtctgacatccccagtgtccaccctcaccactcacagcccgtgttcatcctgcttctgctctgccagctgactgtattttcctcaaatgtgctggagatgctcccacctcagggccttggcacttgctatccccctccctggagccctggaattattattattatttttttttgagacagggtctcactctgtcacccaggctggagtgtagtgtcacagctcactgcagcctcgacctcctggtctcttgcaatcctcccatctcagcctcccaagtagctgagactacaggtgtgcaccaccatacccagctaatttctgtatttttttatagacgtggtttcaccatgttgcccaggctggtctccaactcctgggttcaagcgatcctcctgccttggcctaagtgctgggattacaggcgtgagccactgcacctggcccctgtgttagttttctaaggcttccataacacactgagtggcttaaaatagcagaaatttatgctcttatagctcaggagctggaagtccaaaaataaaggtggcaggattggttccctctgagactctgagggagaaggttctgtgcctctctgctagcatatctgttggcaatccttggccttccttggcttgtagctgcatgaccttgaccccgcctcagtcatcacgtggccttcttccttgtgtgtgtctgtgtgtctctgtgttgtcttcttcttataagggttcagccattggatttagggtcctccctaatccagtgtgaagtcatctaaacctaacaacatctacaaagactctatttccaaacgaggtcacattcataggtccggggttaggactcacgtcttcatgaggacacaattcaacccgcatcaaaacactcttcccctcacactcccgtggcttcttctcccctttcctttgtagtggggccctctctgtccaccacatctaaaaccatgccctccacatcctccccacctcccacctggcatttttctctgcaacactaacgtcttaggtattttacctatttatttgaattcttcttcttcttaccccaagaaagcgtcagatgtgggaggacaggggtttttctctcttttcttggcagaaatctctccagcacctcgagcatgactcagcccattgtagcattgagtaaatacatgcccagagtatggttgagtcaattagctgtctacacccattttgctttacgtctacaatcggctgtctacatccattttgttttacatctcacaactccctacaacaggtggccagggttgccgttctgttggtgaggagaggctcagagaggggaggtagcctgtccttaccccttcccagcctggtatttccagcacctgtcctctgcctgcactaatctctctgagtttttgtccgtggggagacagggaagggccagggcaccagggcagctcttgttggaggtccaacctcaggtggtgagtgccaggactgctgggagcgtatggcagcatgtgcctgcatgtgggtggtcacctgggcagaggctccctacctcagagcagaaccctgccttgcctcagcctccacggctccacaggagccctgttggcactttttggcatgacctttaacctactgatgctgagagtgattggcatgacctttaacctactgcactgagagtgagcccacgggtttcccgtggcagtgctgcctgcctccacccaagaccttgactaactttcctgttgggagcacagggactctgctcccaagtcggtggtctctctaagtctgagggaacggagggaactatcaaaagattgctgccccagagccactgccggggagacccaggcatcccttcctaggggcaaaggtgcggggaaggcagcaccccctggttgacaaaatggcaaggggttttcccagtgacgaggcagaatcagaaactaggtgctggggccaggcgcagtggctcacacctgtaatcccagcactttgggaggcagaggtgggtggatcacccgaggtcaggagttcgagacgagcctggccaacatggcgaaaccccgtctctactaaaaatacaaacaattagccaggcatggtggcaggcgcctgtaatcccagctacttgggaggctgagacaggggaattgcttgaacccgggaggcagaggttgcagtgagccaagatcacgacattgcactccagcctgggcaacaagagcaaaactctgtctcgaaaacaaacaaacaaaaagcctaggtgccaggaacagagtggctgggaacagacacccagcctggggacctcagtgtggcagcttgtaaattgtgtccccttcccccagtgccagcagcaaaggggttggggtcagggaggacacaggacaaggctccctgcagggctgttgtggacaggtctgctgatgatatcgtgaacctagaggcgggttcaggcttggctggcaggaaggaggccgtgtggcactgttatgggggagtgcagactagtttctgactggggcagtgctgggtgccctgaggattagagtctggtggctggatgaggggacatgagtagggtgcctggtggcccagtgtgtgtgtcaggggagcccggggcaggggggttaaatttggtgttaggcagaatgtaaatcctgatgccctcacaaactttgcaagcccctttacctccctgaaactcaatttctttgaccttgatgtgggaaaatgaatgtccatcttctacgatggttgggagaatttactgaaataatgtagcacgattcgcggggtgtctgccacacagtcggtccaataaacctgaaatctcttggcctacctgcctactccatgtgcttatgacagatcagtgtggaacacctcatttgccaggatgagtttttctgcacctcactgtctgggcttatagctggggaaactgaggcaggatgcaggttggccactaggttgtgggcccacctgaaggcctgccctggccttctgagcctggctcctgctccagcccctcccaccgctgccaccctcccctctgggcttctgtgtgctgctgcgggccttctgcttgttcctttgggctacgtggccccctctttgtctttcttccttctcattcaagtcccttggacccaagattgttctctgattcagctgtgacgtgccagaagaccaacgtgtgctcggagaccttgggaaaatcttctgcccttcctgggcttgttcccgcatttgtaaatcagagggctagtgtggatctcctctaagctcaagagctaatggtcagctgggcgcgctggccatgcctgtaatcccagcactttgggaggctgagacaggcggatcactggaggtcaggagtgcaagaccagcctgatcaacatggaaaccccatttctactaaagatacaaaaattagctgggtatggtggtgggcatctgtaatcccagctacttgggaggctgagatgggagaatggcttgaatctgggaggtagaggttgcagtgaactgagattgcgccactgtactccagcctgggcaacagagtgagactctgtttcaagaaaaaaaaaaaaaaaaaaagagataatggtctaggattccggccagcctggccatcttccatccctaatggtgaaatgtgctcattctcccctttgcctgtttccaaggttgtgacaagaacatgtgagcctctcaccagggcagaccttcgctgtccctgacaccttggcaagcctgcagagggctaagcagcctgcatcttctgtgctgtgtcacccatttcctcatggccactgagttctctttctctgcggggttaactcaaacctacaaatctgtggtggcctccgagggttgagcccttctctctctttcttttctttttttagcctttttttctttctttttcctgacctgtttgtataactctgattcccaaaattgctccttgggtttttctggaattcccccaacacttaggaccttgaaaactattttgaatagactcggaatcagtaaacccaattttggcctcttagttactaactggccttgtgaccttgggcaagccacttaacatcactaagcattaatgtccctttctgtaaaatgagagggttaattctcccctcactgggatgttgtgagaattaactaagacgtgtgtgaaagattgctttgtgagttttaacatgccttgcaaatgcttgttattactttttagctgtcctgacactgggcttgggtatttgctcatgcctggtatatgtacagaagccacttttaggaagaagctccttaatgaggcccttgaggaaatagtttagaggaaatcttttaattttaagcttagggaaggacatcccctgttgtgtccatcttaacacaacaacaggggatgtccttccatcatatcatactctctgtgacaggtaccccaagagttgtacagtgtacagcgtatgcagctgtatgtggtgaccccagacctggcttcttccctagaaggagatgtctcccatttttccaatatttaatattttcaaacctcaacttgagagtcctttcctctggctcactttttatttccacagtactttctattttccactttctaacgtagcatataatttacttatttattacattggtatataatccatttttcccagttactatattcctcaagagcagggatctttgttttgttcactgacatatcccaagctcctagaatggtgcccaggatatagcaggccctcactaactaaatatccactgaatggacacccctgtcctaacgcatcttctgttgcttcctagagcagagagatggtctcagggccatttccttctgagctgatgctcgggccatcccctagcaagtcactgacatggaggggctctcccagccctcccaacaggtggtgcttcctcaccctgtgccccttggccctgggagtcggaagccaggcaaactgagggcaatgcctctcccctgagggcagggagagtgggcttgacagaccctcaggagtgctgagagtctggacagggggttgtggcagctgtaaaggaggctcctcctggtttcttccatctcttgggccttagaagagcccccatgactccccttccctggggctgtgggtttggaagagggagggctcagaggggttaggaagaaggggaatgctcactgtaggcctccagccagatccaatggaagagattttattttcccaagtctgagggtgcagaagccctgctcatgctttttgaggagagtgggaagagacctttgtctcagccaagaacttccttcaccacccacgccccatctccctgctgttgcagagggtaggttctagaaatgtggatgggccacactaaggcttgtggagggtcccttggcactcaacctctgccagccccagtgcatccctgtccagcagagactatttggagtggccagatgggtctgaggcactgtgttccagccaggcaggggagggacgcctgctgttctgcattggacctttcagctgttggacacaacaccaggggttgtccttcacattatagtctctgtgacaggtaacccaagagttgtgcagtgcacagcctgtgcagctgtatgtggtgatactagacctggcttctttctgggaaggagagagatgtctcctatttcccttacaaagtgtattgcttcaaggccgtcctttccagctgggtttggctgttgaggtcccttcgaggttcccctgaaagggggatggatctctgggcctttgtagtgttaacgtgcatctctccaacccacacaaatacctgagatccatggaggtcaggccctgagcaggccacggctggccttagggggtacaggtgtgggatgataaaaagactccagctctgggcagatgtagcccagggcacacggtctagctatgctttgatccggagcctagaagtcccaggagaggttgtgaggaaggtgggggccagtgtgccttccttcttctgcgtgataaagccggcaacctcttccttttctcatgctgggcacagagcagacatctctgggttggtgaggatgccgagctcaggcctctgagtgctcaggggaggaggccccgccttctccccacatggggcactgggcagattcaagggaaatggtgtctgctttctacacacttcctcctaccttcccccttctcccatttgagcctgaaggcggacatctggcccaagaagatctcaaactctctgatgacaacctagtgactcccttttttagtattctcccagagctgaggaatatatggaccgcatcctgggtttggtttcaggagaggactcctcccagccctgccccaggtccagccctaaacaaatctctgagatacgagctattcaccttctgtcctcccagagcctacagttcggtgatggggaaagctaccttttccagttcatcatcatcatcttcatcatcagtaggatttattgcaccctgctgtgtttcaggcattgtgctagattcctaccctattcttttcctccttgctgtccccactttagagtcaccagctcagtgacatgcaggacatggatgttgtacaaatgtcttttggtcaattgtgtcgtgtccaaatagtggagtataaatggcatagcacagggaccagcacccaggagcacaggggtgcagaggttccccagagctcatcatggccttagtggtgtgcttagaattatggttaccatggcggaagtttgggttaagattgactagcactaaggttgtggttagggtgacattctatttaacagtacggtagtggttagggtaagattagaggaataactttagcagtgcagcattagggtgaggttttaatcttaggattgtggtcagggttgggttagggttatgctaaagtaacatttaggactgtgggtgttttcgattgtatgtgtggttgttgttctaacccaccattgatggagccttattgaataagctgacagtttacaggcaccacctaatttaatactggggacagctcggcacagtggctaagagcatgggccacgagtcagacagatcccggttccacttgactcggttactccccagtcgtgctatcaagtgtgttctttcacctccccgagtctcaatgtgaaagactgatgataccaatactggctgcgcagagctgtggtcagaataacacaaaggaatgtggataaagtgccggctcacataggtaagtgctcagtactcgatagcaaatactttttcttgtctgggtcagttagagttccagcaggaaagggatggcacactcgatgtatttatttacaaaagcactggcagagtcaagagaaaacaatgaataatggtggagtatcccagggtagttacgtaggcaagctcttaccctccaggtctaaaggggcaagggaccagcagtcataagaacccagggtagctcaggctataggagagggccatggacagggctgcggcctctggtggaggaatgcagccactgctcacctgcagtacctgttgcgagggagctgggaggatctgcacctccactcacccttctcctgccctctgacctcctgccacagttccccactgatggaactggaccagaaggcagagggcaaaggaatctcccaggactcagagtgggatggagagggatccaggggcaagtggaagatcttcagcacatttgccagtccttgccatgaccctgtgaggagggtattcccatgactcccactttgcaatgaggacactgagggtaagggcgattccagcctagctctcctcgacttcagaacttgtgattatagtcattgtgcgaaccagcctccagggcatgtgagcgtaggcaagtgcggaaacatccagcttggcttggaaactgcagagtactgggttaggcaaggtatccagcgtcttttcagaaaactacagaagtcggtgagagcctggagcagcattcggcctcattaaaatgttaatgtatacagtttccagcaccggacttaaaataactagtgacaataaacatttcaagcttgtagctatgttcatagcatctagccaacttaaatcctgtaggatttttgtttgaaaggaagaggctgggagcaatgaagcaagaaaagagaggaaagactggcaaagctctttttcagatggcccagggaaggttcgccccatccggctgctttttacagaactggctgctcactcagtgagggtctccctctgcgggggtatgtgtgtgtatgcgtgtgtgtgtggcggggcgtgggtggaagctgtggagagaacatgtctcaaaagtcataatggagattttttcaggctccgtgaattctccttttgagctcaagtttttcaaatatgtatcaggtttcacctcttgtccaggacataaaggaggtttctgatttatgggtccggtagtttttccagttactccatctttaaatctgccatcagttaattaatttgccacggtcagaaaaggcactgtgagcttcccaggtgaaaataactttagcaaagtatgatcacagtttaaaaaaaaaaaaaagggaggcattctgaaacatacacttgtttccacttgtgaaattaactgaatcagtgtctcggcactcctcctcctccccctgtcatggcgcatgcacacacacacactctctctctctctctctcacacacacacacacagacacacacacacacacacacaccccacctctgcagaagggctaaaggggaagatttaaacctggcaggataatttcccagaaaaggattagaaggggaaaatggattaactgcaaagtcatctgatgactgtgttgtatgaggctgcttgggacccagaggggtgtattcgtctgtctgtgtctatctgtctgcagatgacaccgggaagattgctaaatgattcccaataatgaaatgtgaaaacacatagttgctttgctagccacatagctgtggttttgtgtctgtgattcatggtggaagtgagtagctgcgacaagcattctgtgggtttttttttttctccttatttctcctacaaaaatatttgtgaaaggtctaaaaggaagtggagtactttttgaaaagaaaaaaaatccctgttccttgcaaaacaaagattacagatgaaaacttctggagctaccacatttctgcttccagatgtcgcctacgctgcattttcctcctggagcctcagccctgcccacgatgtaacatgtccacccgcgagtgcccgcagcagaggccacttgagggagtctgcatctgcaggggtctggcggtatcctctcaagaccccagccaggccacgcccttccaggggagaaaaattaattccacatttctttcttttttgatgttcttgggacaaggtcagaggctccacaaaatgcagtagcgtgtgagggcagaattgtgaaataatttatgtcttaaataaacctgagtttgaatctcagctccaccacttagctatgcagcctacagtgagtgatttaaccttgtgagcttcagtgttctcatctgtaggctggggatgatcattgctaccttatggaattgtcagaaggattgactaatccacgtaagtgcatctggcacatttttggtcctctataaatgacacccagtcttttttggtggggaggaggatggagtctcgctctgttatccaggctggagtgcagtggcatgacctcggctcactgcaacctctgtctcccaggttcaagcaattctcctgcctcagcctcctaagtaactggggaattacaggtgcccaccaccatgctcagctaatttttgtatttttagtagagacggggtttcactatgttggccaggctggtatcgaactcctgacctcaagtgatccgcccacctcagccttccaaagggctgggattacaggcatgagccaccgtgcccactcttttttttttttttaatataaagaaaagtggtttatttggttcatggttctgtacatttgttcaaagtctcaccgtacccactcttacttgtcccctgcctcgggggttatctgagcctttcagaaatgcagcagcggtcatcagaaactttgagaatttgcccagagcacttgaaggtgtttccagacctgggaggtttctggtcacagccaagggtgagcagcagggtggggaagggaatctcatcccccagaggcagacagagctcagcctgaagaccctggcccagcacttccctgctggggatgaccccgggcaagttagcaggctccctgtgcttcagttttctcttctgtaaaatggggacactagttcctgtatcatagggttgctgtactaatcaagtaaataaaaaaataaaatgccttagcagaggcctggcacatcataggttgacagatttgggctgctagattgctgaatggaagctttccaggttggggccctagttcccatagaaatctccttttgtttatggccccggggtaaatttccagcccctgtgagagcggaaagggcaggctgggactttggccagttcctgaaagtgtatctttgacccaggtccctagctgccttagtctacagtgtgcttgtcggggcaggcccacgagtggggtaaacacatctggagtcaggcctgtgtttgctgttcaataagccagacctgctaagcttgtgcatgggcatgtgtgggggcgcatcatggagggtggaagggtcctgaaggccatgagctgggaactcaagggttcaggaggtgagcatctcatggccaagttagtggtggtgagatgtttgtataccaggtttgctgtggctttgggaaagagtcctagctcaatcccctcagcctaggtgtctctcctccccttcctccagcccctcctccaatctcctgtagcacttgccaggtccctaggccctgccttgcattttcattcccttttcatggctgcagctctccagccacttctggttttcatacacttccttgtagttaatgcagcatcaccatggcagcttgtggagggagtttggctgcagtgatgggaggggtgagatgagctttagagcctggcagtcctgagctttaggactgtgggttttgccgttcatgagatacgtgagcttgggccagctaccttcctccttcatgccgcaaatttctcataggtcatagtggggcagagacacctatgtcttaggttcttgttaggggacctttataaggtcatgtgtgtttggtgcctggtgctcagcctgtgtttagtaagtatagcaattatttcatcaagacaggttgtgtgggaaggactctgacgccccagcagatacccagaggaagagataccagtggacaaatctcattatagtctgatctctgcccctcagcacagctggcttctgtcattggacctgggaggagtaacccccttttggcatgagcagatgccctgttctaatagccaggggaaacccaggccttgatctgagctccagcagcacgtctgtacacaactttagtccttcagttcaacattcccagtgtctgcccacccaaagaacctgtgctaagagggggtctcctgcaattagaccccataacacattccaagtggtaagccaggaataaataaccttctcctgtgtgaatctcatacttcctattaatcattcttccattcattcaggccagttggaagaaaggatgctaaaaagagggatgttctctgagtcgggcaactgacaaggattttgttcagacttggccacccttctttccctccctccctccctccctccctccctgcttcccttcttccctccttccctccatctctatcttcattccaggcactagatgacttggacccatgcctcgcctctaagagctcacatccagcggtttgacatgctcaagcagctacagcacacccagcccttgggaagcttttgcaagtgctctaggagacaaggaggggagcatccctgggcagtgtgggtaataggggtaggtagggggcctccaaggggagttttccatgactatttttaaccttgttactttctggtgaaaacacttttttcaaggcttccttttcaagcatgaggttcataggatgaggcccagactgttggccttctgtactaggtcccgaagtatagttctcaagatggtgcaaagattcgtggtataggctctggaactagaatatctgcagaatgcctgtatttgattcctagtcattgactatgtgaccttaagtaagttacctagcttctttatgcctcatctggaaaagggataataataatacctacttcctaattttaatggtggttaactgaattaatatatgtaaagtgcttagcacagtgcctggcatatgattagcactatgtaactgttggctattattattctcatccttgactcctcctatttctctttaatcagacaggtctgattatccctgaacaccatgccagcacattcctgaatatgtccgtttatgcttgtggctctctctgcactccccaccccttcctccggctcatgtctcccaccctctggaaagcattccccagtgatccagccccacggccgcgctggaacatgctggctggacagcttacctggccataagactcctggcttctgcccctctcctccatctctgctcttggattgttatgaaatgctcgcatgcagggggctggcccggggctgctgtatatagtgtacctgctgtgtcctgcacaagggtgccaggcaggagatgaaccctggggccaaaatctagcctgtgttctgctcacccagcaccgggaccacgctacatcagcctgaaggaagtagggcaacttctgtaaactggctgcccagagaggcctcttgtgatttgtgcgaaggcaccaggtatgctcggcctctccctaccccctgccccccagtctgggtggcaagctcttggtgggaaagatgccctttgcataatgcctgatgggacggtgcacgttggcggtggttgaacgacgaattcatgaaatccaggttcaccgtgtgctgacaagtcttcccgagggaactcggagccaggggcctcagactgcctgcgggccctgggtggctgaggaatggggcccagctagggctggggagatggttccagtgaggcaggaggactgggagaagccatggagaagtctgaagttgagtgtgagaaatattttcagggcagcagctgtgtgcccagcgctgtgacgactccatggaagatatgaagagggtaaggcccagtcccttccctcctgggggtctgtgtcccccgccgagctgcaaccctttgggtggtccagctgggcccagaaggagacagggaagcacttagaggggctctttttcctggtgggaagaagagggctatcgccacagcagctggacacatgggcaagctagggagaaaatgaggggcatttcctggagccctgagaacctctcagggccacccccaccccgcctctgcccctgaggtggcccgggtgtgagcccagtgcccaggcagctcgctctggctctcttgcctggctctcttaccctgccaggagggaacaaaggccgcgcaggatctcgaggggccagggcttggcagcccggcagcctaaaggctggctgctcggtggaaaagtgttcacagtggaccaacacatgagggggctggagggtggaggggagagatgtggctcctaggagtctctggaccctttagaaactgaggcagcacctacttcagggctgcccttgaggggggaccgggctgcaggcaagggctgggtgcccctccctgacattaaccccgacacgcagagctcatgcctccctccgtctccctgcctgaaacaggaatgctgtgttcccttgagctgtctgggaagcagggcagggtgtggtctggacaggagagactgccccagggctctacctcctccccacccacagcctggcagggtcatcccctggggtctgtgtgctggggaatccagtcctttcagacctaggtgtggccataggaagagctagaggcccagagcctcagagcactggggatgtgactcatggcagccaggtggggtgagtggggtgcctggagctgactgatgagggcaaagaggttgggtgggtgcgccaagcagacacagcagcaggagtgatcttgagactccttggggacacgggggagagggctggctctcgaccctttaggataggcaccagggaatgttgatgatgccctatcagcgtgccaggcaacaagaaggtacagattccaatccaggctctgggcccgttgaacatgctgtccctactcgtctccctatcttaggtccccaggggtttggcagccaagggcctgcctggccagacaggaggagaaaggagcagagctctgcaagggccttcctctgccttgccagcacccagatcctcaggggagaccaagccatcagggaaacacagggcatgttaagctgaagtgagctgcccctgcagccgcaggaaggagcagcctctgcgctttggccggcagcagagagagttctgggaacgccttcctctcttggagctttctcctagatccttcctattcctctggctgctcccttccagatgccttcagagcctctccctctgtctgcctcttaagcgttggtgttccctaggccccctctgcccttctttgttctctttcctcttacatttctcaaactgtttaggtgtcagaacacctggaagtcataaggagtaccacgaaatatcaatatacttaatttcatgattagagctgggaacagttttattagcagaaactatgacgattgtctatgtatgcataaaaaaaattaaaaaaaaaaacccagctataggcacacgcacgtgtccgtgaaaagcgcaaactgtgggatgaagtatgataggctgttgccacatttttccgttaatattaatttacggcttgttcgtttgtttaatcgtgtgctagcagacaagtggtagcaggcgccagaggttggagaagaatttatgggagcaagacttagaactgagaccattctgttcattattacattttccccttttaaattggaaaacgttggcagagttaacgccccagtcaggcagtggcactctgaagcatggtttgttctgcctgctttcctcgaatgatatcatccttccctcttaactctacagctaccacctctactcttacaacctcctcccagccccaactgtgtctacagccccaaaactctctcccaagttctgcctcctgggtgtttccatctcaagataccaagcactcattatatccaaaactgagcccatcattcacttcttggatttctcatgttgagatcttggctcttggaactccctccacctattagtccaagtcatagctgggaattatctgtctctacatctgaaatagcccttgcatccatgccttcttcttggttctttcctcggccactgatagcctagaccacagccaaagccttccagctggcctccagctcgcctctctttagtccactctctaccaggtggtctttcactgcaataatcatcatttaagaatgcccatcccaacatgtcctaggcctgcttgaagaccacgagtgacttgaggctaacatgtggcttcccctctgccccctcacctttgctagggtactagtccctttgtccaccccgcattggagcttaggggacaaaagacttcaaccaaggttggagtttttgccatccctggggtcagtgcatggcctgtaacaggcactcagtacttgccctttgaatgagtgaaaaagtgtagctgttcttcggaccgggtcatttcctgcttcaaaatctcaggacactccccttcacccactcagtacagcccagacacctccctgaatatttcaagaccttcaccataagggcacagacctattctttaatccctcaaagcctcaatgtcctcatttgtaaaatggcgataaagaaacgattaatggtagatttaggatgaagttacctggtttggtaacctggcctcagcacttaggagttcagccaccttctgcaaggcatagaacccccatagcctctgttttcttgactataaaatggggataatgagtatctaagtcttaggatatggagagctctatgtgagaggatgcacgtaatgggcgttattggcacagaacatggcacaaagaaagtgtcattaaattatagcaccagttggctgggcctggtggctcacacctgtaatcccagcactttgggaggctgaggtgggcggatcaccaggtcaagagttcaagaccagcctggccaatatggtgaaacaaaaacaaaaaaaaattagcctggcatggtggcgagcacctgtagtcccagctactcaggaggctgaggcagaagaattgcttgaacctgggagacggaggttgcagtgagccgagactgcgtcactgcacttcagcctgggcaacagagtgagactctgtctcaaaatatatatataaaaatatataaaatataaatatatatatataaatatatatataaatatatataaatatatatatataaatatatatataaatatatatataaatatatataaatatatatataaatatatatataaatatatataaatatatataaatatatataaatatatataaatatatatataaatatatatataaatatatataaatatatatataaatatatatataaatatatatataaatatatatataaatatatatatataaatatatatataaatatatatatataaatatatatataaatatatatataaatatatatataaatatatatatataaatatatatataaatatatatatataaatatatatatagcaccagtttattccctacccacccacttcccacttcctgttctccaccctgccacatacgtaggtaaccactgttattaatattccagggtatccttccaaggttgctttatgaatatgcaaataactgcaacatatatccttattttctgtatgttacacaggagttcacatgccctacaccaggagccagcagacttccataaatggccagacagtaaatattttagattttctgtgacatatggtttctgcaactactcagcggtgccattggagagcaaaaccagtcacagatgaggagggcagctgtgttccagttaaactttatagatgcttaaatttgaatttcatatcatttgctcatgtcttgaggtattattctttttttgatttcttttccgccatttaaacatgtgaaaaccattgttaggtcatagtctgtacaaaaacagtcagtggtgggattgggctgttgtgctttcacttttcagtgtatcttggaaagcttaacttattgatgtaaaggagctgccgctgtgtttccagggcctattaccccattctgccagcagatccttgtttgtttaaccaatcccctactgaaggacacttaagttgttttcattctgtacaaactattttgctattacaaaatagtgcttctgtaaatagtcttgttcatgtatcattttggacatttacgagtgtcttaggtcgggtcccctagaggtgggattccagtgtgtgtgattttgcgggggaaatgcgaaaggaaagaagaaagcagtgtgggaaaggggagagagccaagtaaagatgtggtcccaggtaaatcaagctttgacctgattgaggatagagcttacaaagttgtttctccttaaggcctgggggcccaggcttttgaacttccctttcaggcagtcattggctgtgtggtcatggtggtgggaggagcttctcaggtggttcccatcagccaagagcatggcttggaagaaatcacaggtataagcctttagctgctacacttgcagatacacaagccagaaaggggaccagggcagggcagcaacacctaccacagaaggtttatctgcaggatagtcttggaggtggagcagcagggtcaaagcacagatgcattgggatgtggatagacgttgccaaattgctttccagaagggtcatgtcaatttacattcctgccagcagcatccgagagcgtctgtttctgcatagtctcacaaatgagtatgttattaaacctttgggtttttttctaatctgatggattaaaaaatgctacctcagcatagttttcatttgcacatcccttacaaggagaaaggttaagcatatttttctgggttcaagaaatatttgtatttttttttctgtgacctgttcatattccttgctgatttttcttttaaggctgttggtctctgacatttctgtttctaggaactctgatattatggagactcatcttttctctctgatacgagttgcacatatttttcccaccatgtcatttgtctttttactttaaggtgggtttggccaagcaggggtttttgatcatagaattgtttggacaagtaaatgatatattagctaaaacacttagcatgatacctgccacctgataggcattgaattggaatgatttcccttcccccctctcccctctaatctgtgctttacccaaatggtgcttattcttcttcaaacatggcctgtgcttcccacctccatgcacttcttatgttatttttcttttcttttcttttctttttttttttctgagacggagtctcactcttgtcacccaggctggagtgcagtggtgcaatctcggttcactgcaacctccacctcccaggttcaagtaattctcctgcctcagcctccaaagtagctgggattacaggtgcccaccaacacgcccagctaatttttgtatttttagtagagacagcgtttcagcatgttggccaggctggtctcaaactcctgacctcaggtgatccatccgcctcggcctcccaaagtgctgagattacaggcttgagccaccgtgcctggcccttatgttgtttttctaatctggaatgtctgcctcctcattttgggtctgttaaaatcctatctatccctgaagctccctggatccttctcctagatatggtctgtattctatctgaactcctgtacctctgctctccaacacagtccatcgtgggtcctagttatgtgtacacattcaccatgctttttctgagcctcagtttccttagctataaaatggagttgctgggaagaatagagatttattttgattacaaaacaaatacatgtttattccatgtgatgcatatttattgtaaaaatttcaaaaatattgaaatgataaagtttaaaataggaggtacacacacacagacactctcattcttaaagagtggccactatttacagatcttccggccttttcctatgcttatataaacatctgtaggggaagagagagagaaaagcttttcttaaaacacaaaactagaagcatactatccatatattctgcaactcagttttttcattcactaaaataacatagataagatgatgtatataaaatatctggcttcatgttcataatgataattacaactattctatgcatctttttttttctttgagagggagacttgctctgtcacccaggctggaatgcaatggcgtgatctcggctcactgcaacctctgcctcccgggttcaagtgattctcctgcctcagcctcctgagtagctgagactacaggtgcccaccaccacgcccggctaatttttgtatttttagtagagacaggtttcaccatgttggccaggctggtctcgaactcctgacctcaagtgatctgcctgcctcagcctcccaaagtgctaggattacaggcatattctatgcatctttagtaacactcttaaattttttttagcagcaagagcctttccaaacaaaatagtacagtcatccctcgatatccacagggaatttgttccaggacccctgtgaataccaaaattcatggatgttcaagtctctgatataaaatgacataatgtttgcatataagctacgcacatgctcccatatactttaaatcttctctagattacttataatacctaatacagtgcaaatgctaatagttgtcatactatataatttttatttgtattatttttcattgttgattgctatttttgggggttttccccccaaatattttccattcacagttggttgaatctgcagaggcagaacccatggatatgatgggccagctgtttttggaagcccgatttatgaagtaaatagaggagagcagccaggctagggtgagggtgaatggggtagagggcacagagctcctcgcccacttgtcttcccatcgctgttgggaaaccttagtgtgtcgggcagggtgtgggcacaccttgcacatttcagtaagtggcatcattatgggtacagactgcccaggcagctttcttgtgggcctgaagaccccggccactgggatgagaatttttcctcatcttggttgaaaagcccagagtccacagttgagaacagactgtggtggatctggtggctgtctcttggctctgtgctggcctgtgatggggatttcatgatccataaagaaatgaagaaaataaagtcatttggtgagatttccatgaagttaggcttattcaaacgtttcttttttggctctgaaatgtcttttctttcgtgaaattatggtggtagtgattggcagttttgtgtgtgtttgtcttaaagtcttagcaacctaaataaaaagcgactttatgttgttcccccaattttgttccaaaatcttacggattcatgaaatcctgaagtctagagatgactttttggtccattgtggaggcttggccaggacttccctggaacagtcccagaaagatagcaagttccattcttgtgctgggtgagtttgggaacctctgtcctttgatgaaattgcagcggttcttccaaggctgatagtagatggagcatctcctgggggctgtggtcaccttctcattgagacttgccttcttctgttaccagacctctactgtccttaatcggggggatactgcttctttggaccagcctggggcaaacatggcaccagacccttctcttgatgtcccacaacctgagactaggaaagaacatgcaaacaggatttggctaaaggcttgcgatttgcttaaaggaaatgagtgcaaagataacacaaggctagacagtggggtttgcaaactccacagctcacagtctccactccatcctagctgcctgtgcccttctatggggtgatggcagtggtaaccaattggagaccaccagggatccagagttgagccaagaacctgcagccctccacacagcgagagcctctctcgctgctcacctctgaggcctaggctgggacttataaagggagttatcaacctccttatatggatgctttaggaataagaggcaggacctataaaaaaacctgggagcttcttcctttactccacgacgagcctctcagaatgcagggcttttttatttctgtcatttaaccccaaatccccattagagtagtaggtgacaatgaattaggctcagaggactccggttgttaaaaatgtgttgacaccagattagacacttggccctgtgtatatataaggacacttggacagcaataacacttttttctggagtctttttatttcccttaaagaagaactttaagtggcccagtcatgttttcttatttgcttggggagatgtatttagtccaaactgtagctaactccttttttcctccttgtttctgcaatttaaaaattctggcgtatttttctactttgaccatttacttgtatttgtgaaataattgcatggtctcactgttctcgtcatcctcacaccagccctatgaggtgggcattgctattcttgtttcagtgatgaggattctgaggctcaggggagctaagtgacttgctcaaggctgtgctgctagtaagaggcagaaccaacatctgtctggcccagtcccaacccctcccctctgtacagccaggtcctgtctatgactagggaatacatggtttgtttatttggttttcctctctgcaaaactacccaactggcccttaagggatttgaaccctgggatcttggtgccatgagctctgagcaccaattagagaaaaaactgacagcagcaataacataacaatgacaacaaaccaccaagaaagaacactttgagtttccatcctgaccagactggagagctctttgtcagggtcaagttcagaaaagtggcagtggtctgggcagaacatgagctactcttttcacctctctgggatgctctgtggcgctgccactaacctgagcatggcaccagcctggtacccaggacgaggctcccagtgagccagcagttcagccacctctctctcccaggcgctttcttggaagtcctcggagggagtttgctttcttttttgttttgtttttttgagattgagtctcactctgttgcccaggctggagtgcagtggggtgatcttggctcactgcaacctccacctcctgggttcaagcgattctcgtgcctcagcctccccagtagctgggactacaggcatgtgccaccaagcccggctaatttttgtgttttttgatggggtgtctctctgttggtcaggctggtctcgaactcctgaccttaggtgatcctcctgtctcagcctcccaaagtgctgggattataggcatgaacaactgtgccaggccagtcctagtttgccttctgccaggaaagcataaggagtttgctcatggcctggtcaccaagggctaacagaactggggtggagatttggggagggagagaatcccagggccttatcccacttgggcaaggaaaccagtggggagggttggcatgggacctactgggggaagggatgcccccgaggcctgagcagaggcttccaggctgagctcccactggggtctgggctggttgtcggctggcgcaggacacaggttgtggatcaggccctgggttggcatcctggtgtccccatttagctcttgtataaccttgggcaaggactgagcctctctcagctttgatgtctgcaatacgcttacacccaccacagtccagacactgtcgtatacacagtggttcatagacattgtgacaatgacagagtatttacaacagaggctgccttttagaacagcctgcccaataataaacatcaagagaatgtgtccaaatgtatgagacaattcaagcagttaagatgtcaaaggacatgagcggaggattttcacaagtggtaaataaatacctgaaatattttaacctcaaaaataattttttaaaggagagaagggaggtgaaaagaacattgaagtaccactttgtgcttattcaaagctagcaaagtattaaaaattaataatatgctgtgctggcaagattgtgctctaagtggttcatttatatatttggatgcaaccctttcagaaagcaatacaccagtgtgtgcctccagacataaatgtttgtaacctttgatacagtcattctagccccaggaattcatcctaaagtttttgttttgttttgcttttttgagatggagtctccctctgttgcccaggctggagtgcagtggcatgatctcagctcactgcatcctccacttcctaggttcaagtgattctcagcctcagcctctcaagtacctgggaccacaggcatgcaccaccacacccagctaatttttgtatttttagtagagatggggtttcaccatgttgaccagggtgatctcgaactcctggcctcaagtgatctgcccgcatggacctcccaaagtgctgggattacaggcgtgagccaccacgcccagcctcatcctaaagttttaatcctttcaagatgtttcctataacattttttcaaatatacaaaataaaatagaatagtacaacaaatctccctgtactaaaggaatattttaacagaagacaaagtcatataggtaaggatgtacacatttaaaacttaaaaacagtccaggtgcagtggctcacgcctgtaatcccaacactttgggaggccaaggtgggcggatcacctgaggccaggagttcaagacgagcctggccaacatggcaaaatcttgtctctactaaaaatacaaaaaattaaccaggagtggtggcgggctcctgtaatcctagctactggggaggctgaggcaggagaattgcttgaacccaggaggcagaggccgcagtgagctgagatcgcgccattgcactccagcttgggcaacgagagcaaaactcggtctcaaaaacaaaaacaagcaaaaaactttttaaaaaatctaaatatgtaacaggtaaatgtctaaataagttgtgattcatctttagctggactatcatatagcgatgaacatgacaaatatgacaaattgaattgtgtaaagtgtgatctaatgttaagtgaaaaacggaatttaaaattgtatctctaggtgatgacaatagtgtaaaatcatatacgtgagcaaaggttgaaagaaaatatgcaaaagtagttgctgtgttaggatgggagatgatgaattcatgtttttctccttgaatattgttgttacattattcttacaataaaaatcaatgagagggagactctaggctctgccctgaatcaatcttgaaggtgtgtttgttgggcacctcttctacaggtaattcatattaagggatatattaagaagtggtagggagtaggtacaggacttggttttagggcaggggctggtccatagtgggttctcaaagacttctggaatgtcagagctacgtgaggaccgtctaacacccccattttgcagttaagggtcctggggcccagaggagctaagtgatttgcccggaataacccaccaaaagcctggtgattccacataggggttggtatttctacaaaactagccggcaggccttagatcagtccttctgcctcagggcaccttcatgtctgggagtcagccatacatgggtgagaaggcagccagagagcatttttcttgtgcaaaggcagagagtgggtggctggatgaggagtggcacagacacactgttcccagggtgcaaacccccgtgccgcggttgtctccacaggaccctgagtggcctcagccagacccacccttcccagcagcacgtggggttgtcccgcactgtccgacttcacccgactgccacggccagtagccagctctcttccaacgccctgcccccgggaccaggccttgagcagagagatggcacccaacaggcggtacctctggagcacccctcatccccctggggtaaggataccctgtcttgggtcctagaagagcagggcctctagaactctcttctcccaccttggcttccccctctgctctcacagaggggctgagttgtcaccttgtccctcattctttcagccaatcaacaaacgcttgttgagcacctgctttgtgccggggtccaggggtcctaaaccggtggacctggacttcaccccgttgcaacctttagacctagactgctctatttctgcccaatctatcatcccctcctgcctttgcttccctcatatcccgctgtgaacctcaactccctggtcccactcgttccacctcatccctcctacaaaccccaactctcctggatcaacccaaccagttgttacctcagcacctacagctgcgcctctgcttcccacagaatctctgtggattcacgccatggcacactctttgttattgcctgacaacccctccctgtgtgcctggacattttctccctccatttctcagagcagctactccaggcctcccctcccctcccctcctttcccgaggccccatccatcagcccacagacatgcccccacctcccagagagctcctcaacttcctgcctatcacacccaccactaccctgtttacatctgtgcctgagctcacctccttccttttttttccattttaaaaattgaagtggaattcacataacataaaattaaccattttaaaggctacactgcagtggcttttagtgtatttataattgtgtgcaaccgtcaccactatttcattccacaacatttttatcactccaaatagaatccttgtacccactaagcagcagtcactccttatctcccctcctatccctggcaaccactcacctatttcccgtctctatagatttgcatatccttgacattttacatgaatggagtcgtacaatgtaccatcttttgtgtctggcttctttcacttagcgttacattttcttttcttctctttttcttttttaagagacagagtcttgctctgttgcccaggctggagtgtggtggcatgataacaactcactataatctcaaactcctgagctcaagtgatcctctcacctcagactccagagtagctgggactacaggcatgcaccaccatgcccagctaatttttaaatgttttgtagagatagggtcttgcatgttgcccaggctggtctcaaactcctggcctcaagtgatcctcctgcctcagcctcccaaagtactgggactgcaggcgtgagttcctgtgcctggcttagcataacgtttctgaggtttatccatgttgctgtgtgtatcagtgcttcattccttttcatggttgacgattcctttcacgccatcttgagggggaggtgtccctcttatctaaggcacgttctggcaccctttgtcatttcctctggaacgctggcatcacttgtcccccctcttctgtatcttcaccctctcccaccctctcagccctttcccctcaacgtgtacaattgcttacagctctctcattcacacacacacacacacacacacacacacacacacacacacacgtttctccgctttcttcctatctcctcccttcacagtcaagcttctcaaactcatggtcaaaacatattttttcaatttcctcccctcccatttctccctcaaccttctgcctctggcttctgtccccaggctccccgtactgaattaatagcccaatttcattgccaccactcttgggaaatgaagcggcctcagcttgcactgctgccatgacctcccaggtggtcaccctgcctccggaccccccagcacatcaaagccagcatgatgtcttgcttaaaagtcttctgcagcttccccatcacccaccaaataaagtgcctgatccttgttctggtaatcaggtcccccacaaaacctgactctaatcctttcaggctttatcttctcttctcttagaaaactctcctctctggcaagctggggctgcattctgttccctgcccttgggttcaaagcccagctgcatcacttgctagctgcgtcacttgagcacccaaacttctctgggcctcatttttcttagctgtaaaatggacacagtaggttggatatatgaaaaataccaacactcagccataggaacctacaaaaatggcaatttctaatgattcaacctaacataccacccactcaagagggttgatgtgcatgaagtgtgagcttggtggctggcacatctgcgagcttctcaaaggtatcaccttgcccctacgatgggaccctgcgtccagtaggtactcagcaaatgcccttgagatgaatgcagccctagtcccatggggctttctaaccagactctggaggtcacagctgtgcctctcagccctgccccctggacccaagccctctctctgcagggctgaacctcacggagaaaatcaagaagatcaagatcgtcttcactcccaccatctgcaagcagacctgtgcccgtggacactgtgccaacagctgtgagaggggcgacaccaccaccctgtacagccagggcggccatgggcacgatcccaagtctggcttccgcatctgtgagtccctttcctgctcagatggttcccagctggccctggagggtagatggccagagagccaggcctgccttggactggagcccgctgctcccaaactgtggctccacaagttgtcccaaatcacatggggagctgagtcctcacttggcagcctagctgtgtgactctaggagtcacataacctctctgagtccaagtttcctcaacagagaagagacagagttcatgataatgccacctccccatctcccaggttattgtggggtgcagggaaacgcctaaatagacttttcaggaaggcaggggctggttattatccactcttcttcactctacatgaatgaagtggaaagtccctacatttcagggggctccgggctacaggagccatctagggtcagggttctgccgcctgtttctctgtggtggtcaccagccacagagcgggtgctgctgttcttccaccgctggttaccttgagggttgatgttgcagatttctgccagatcccctgcctgaacggaggccgctgcatcggcagggacgaatgctggtgccccgccaactccaccgggaagttctgccacctgcctatcccgcagccggacagggagcctccagggagggggtcccgccccagggccttgctggaagccccactgaagcagtccactttcacactgccgctctccaaccagctgggtgagtgccggcacagctgggccggcgggaccctgggaggagtgccagttgggtggaggctgtcaccatggctgtgacagggatagggaagctgcctgtagtccttcctttatgatcaaacctccctctttctcctggccctcagcgctaagtttcattccctcaacttctcagccccctcccatcggaatttatcgacttgtttttgccctttccctgtgctgggaaccctggggaagacaaaacagtgtaagggcagggtgccgccctcaaggaatccatgggcctgggtaatagagggagaatggatgggaaatagaatatcagcataaaacatttcattttccctgccttccattattaggtgccaaaaaaatacagaatgctttaggggatcaggggatggagaggctcctaagcccagagtgctctgggacagctgcgtggaggggatggactgcagttaggcctgaaacaatgggtagcatctggttaagcagagggactggcacgagcaaaggcacggaggtggggccatgcaggagacagggggctggagttccagggttggccagggtcatgggggaggtagaatcaggaaggtagcttggaatgtgataatgaggctccttcagtgacagagtttgcacttcatcccgtccccacaagggatcattctggggttctaacttgggagcaaagaaatggaaggagagttttggggtgacacatagccagtggcctgcctggcccaggggtggtggatacccttcagagggttggaaatgagggtggggccctgcttccctggctctgactctagcccctgtgcccagcctccgtgaacccctccctggtgaaggtgcacattcaccacccacccgaggcctcagtgcagatccaccaggtggcccaggtgcggggcggggtggaggaggccctagtggagaacagcgtggagaccagacccccgccctggctgcctgccagccctggccacagcctctgggacagcaacaacatccctgctcggtctggagagccccctcggccactgcccccagcagcacccaggcctcgaggactgctgggccggtgttacctgaacactgtgaacggacaggtgagaacacagctctggcctcagccctggatgcttccaggatggcagttgtccccagtctgcccttctcctcctctctgtcctctttgttcttatggaatgtgagtgtctgcagactctcccatttcccagatgggaaaacccaaggcatgaaattgtccatgtatggagagtctgggcctccttcctgggctctacttggtgcttgtcaataccaggcacacagaagaagacccaaggaagttcccctctggaggagctgtcaccagcatcctcaggtgaaggcagcctagagatgctgatcctatgacccctggcacatggaccagtggggctgttaggatctggccaggagttttttatccagttgaggctacagttggggtcacagaggtgtggaattaacaaatggaggttaaccccaaagccctggtggtacaaagatgagagatactcctattgccctctggaaccatcctcagctcataatgggaaatcagggaagattttctgaggccaggcacccaagaataggggttagaccagacccagtatggtttttcttggggttgccaggaaaccgcttagtttccagaaactaaggtatttccagaaaccctatctgagattagggaactggaggaggtgggacagccaaggggtaaacaccctgaattcccagatcatccctggcctctcaccttggggtgtccctgagcctggggctctgctcacaaggcccactctgtgggtgaccctgcagttccctggaggtaggcagaggaagctcttcctttaggaccctttgtctgtggttggggccatggagggtggtggtttgcagccccgcacagggcagatcttgtgtctggggtgtcccatccacacacaaggttcagggctgggagagtgcatggcaggtttctctgcttccttctgggatatgggctgactcccttctccccttctttggctggggacatcctctggcagaatgtggggagtgagctctgtgtcctaggctttcccgggacatctctgtgcacagcctgggagggaaggggggtggtcacaggtgtccatggcctctccttccagtgtgccaaccctctgctggagctgactacccaggaggactgctgtggcagtgtgggagccttctggggggtgactttgtgtgccccatgcccacccagaccaggtgagtgctggagtccaaggtcacgtgttgtggaggaagctctccctgggcctgccctctcctgccagggtttcccctccaggatgtcagaggccaggcaggtagaacaggctggtaaactgcagacttcccagacctgccttgaaggtgtttctggccagcactgaggctcctggcagccctctgctggtgcagtctgtcctgcctgctccatctgattgcctgcaagggcctgctctctcttgcagagattcttgatcagattttagggatttcactcagtgttcccctgcacacccctcccagatgccaggggtccagagatcttgattcagtgattcagtgttttctttattctctccctgatggggcccccaggcctcctctttatctccttacctcctgttccagcctccctgactttgaattagggttgaatgtctgtcctagatgtcctcatccttggggtatgggagccctagttccttgccctcttttggacgatgggaaaaacctaacatgtgttaattcattcattcattcattcattcagcaaatactcactgggtgccttgtatgtgccaaggactgcaatttcaggagtgagcaagatgcctgttcacgatgctctccccagtcttagttgcacaattgggaggagggtgaccagatgcctgtgcgtgagtgtggcttctgcccatttgtctgtcttctccctccaggcctcctttctgggcctgggcctgagcctggtgtgtatttcctttgcctgtcagcagtcagcttggtcaatcagctttgtcaggaggctggacaggagcccaaagatgggaggggcagggctgttccttgcatcagactcagctgtggagcagtgactacattttccaaactaaaaataagtgtagacagttttacagtgtgatagaatttttggcgaagtagcaaagggtagtgttcagctcccaggcttaaatgtctaacacatactacgtaccagtcccagctcttcctgatcacctctctctgcgtcagtctcttgatctgtaaaatggagatagtaatagtgccagcctcgtagactgctgtagagattaaatgaaatgatgcacatgcttagtattaggtcaataaaccatggctattacaatcattatcattattgtaattagaaagtatccctcaagaaagcgagaaaggaatggacccactgcacaggagatgtgcatcaaactgcccaggtctcccctgtaggccagagatgtttttgccacttttcttctttccttgttttcttttctctttcctatcaggcgttgaacccttgaaacttctatatcccacattctaatcagtcgacaaatatttacattgactaagcccccatttgaagaggccatagcatgcaggccctggacagagagtagagaaggtggtaaaaaccgcaccttcctctccaagcttacaatttagtgggtagtcatagatggctggtaggcatcaggaatgaagaggtttgagcagtgtctggtcaagtcctgagtgctgtgcaaacacaggcagtggagcccaggcccctcataggtccagtagcacctttgtgcaaattagaaaaacctgcccttccatttgttcaagatcatcttcataaatatgccaatctaggatgccaatgattcccttagagatggtgcttttgtgcagtgcacaacttgcacatctgtacactgtgggatgggggccctacaggctaaaccctgtggatcagggaaagcttctcagaggaggtgacttccaggatgagatttgaagaataattaggggtaggacagttaagtaatggggaagagtttaacaacccaaggaaattgcatgtgcaggtaagaccaagagaatgagcaacattttctggagcacagtatgtctcttgctgagccctgctcagccctggctctcctgtagaaaggcaggcatgtcagaagggttaggtggggccagggctcccaagtccctgctctgggcaggttctggttcccaagagctggctcattcagacaagtgggtgggggtctctctccctttaccccatcaaccctctgaggggcatgcagtacctgctgcgctgaccaaggtgctgacctgccctgggacctcctgacccagttagggctgtcctaggagggagctggcttttctaggtggtaggaacaatgagatttcatccaagtggcaattcaggggcagccttagaagtttcccctccttgtctcagggctcagaagctgtcacgctgttgcctctggaatctgagaaataatgaaggggaagagtgggctcagctgccaacagcgtgagtgtaaaggagtggagtggtgcagctgagaaacaggcttccagaagggccttctcagaatcccgcttcactgctgggattctcctcccagctgaggtctatgcccctctcggaaccttcctctgggcaagtcttcaggccttaaggtgtccttgatttgggtaccaagcataatcctgaactcttgagatgcagccctctgggtggggtgtcagcgatcagggccccacagggtccttgggtcagtatctcctctgtaattcactaagccaatctgacagtgatgttagtggccacagacctatcaggtgacattagtgaaaatgaaaatagagccactctggattcttcacttatatgtcacatctgccacttataggattggaggggacagtgggagcacagggcctgcctgtcccaagctctggagcccatcaggggtgcagagatgcaggctgtgaggtccatgccagggctggctgctgccaatggaggattctaggcctgttgccctcagccagggctgacaggcaccatgaccacatccccagatcttggaagcacttctgagagtgggggagccctccactggaagggtggggagcaggagaaaaaggccagagtctgtactgaagcagctacctgctcgcccacttgctgcactcctggttccacctgtgtgccagccttgagagctcagcccacctgatgcccaaggaacctgctccaaatacagctggtgagctcggttcagacagggctagagcccagtggcggtgggcacgggagcagagctctgtggatcaggtgcgtgcagaacacgaattgtacccctcccccaacacacccaacgctcagcccttgccctcgctctgccccatcccagatggtggcctcccctactgtgttcagaacatctcagcgcgctgggcaccagggtacagaccctggaatgtcaagcatcccagcacactgagcaagaaataacaaagaccagggcaacataaacatcaaaaacacatgaaagtgcagttgggcgttgtatagagaaggggcaagacgttggggagccttgtttgtgttgacagagtgccaggcacctcgcttcatgcctgaacctggggctggggtgggcacatttctttaagtggggatgacaaggaagcttctatacaagaagcagaggaagaaaagacaagctgccagggcaggtttggggaaggttggcaagacagacaggacttctggatcctagatcatccctggcactagtggctttgcctctctgagcccctatttctcctctgataaaataggcttatgcttctgggggaagcctttgtcatccccagtaaagtgttctagcaaatcaggcagtggtgggagtgatagggtgagcagcctgggagtggcttcatggcttcccttcagtcacattctggctttgaggctctgtgctggactgttgaagaaggtcgcaacagaatgccactattcctgacatggaaaaggactgccttgaagtcttaattgcatggcataggtaaatcccttttgttccagaatgccacagaacttgcatggagagctggcccgggagtcagtctagaccagcccacagttcccctctgctcccttcactctgagtggtagaggtaatgtgtacccagctgaactcccaggacttagcctgagccaggtcttcctgaccccttgggatttatcaaagggtcccagctcatagccctcttcaatcctcctgccagagtctggagaacacacggttctcaaaagccactttgattgaggccacatttttgagttttcatctgagaaagacagacatctgggctgactggaaagttggccactgccccatctggcttggcactggctgtgtcaacccccaggcccctttgctgggacaggcggggctggcacatggctcagggcctacagtggtgggctccagctgtttgccatgagatcgtcttgccatttgcctggggtgggttgagttcacctctgaacccagggccctctgtatctccagggagaacagattctcttgctctgccctttcaaggaactctgcacctttctctcttaaaccaagaatagccgccagttcctgaactttcacattacactgggcccttcacatgttttgtctcactgaatttgtacagccacctgcaagcccaggatttttaaccctatttgatggatgaggaaaatggagctccaagaaggctgaggagcttgtccaaggtcatacatctagggcaggtagagccaggattccaaccacagtatgtctgactctcagctgagcaagatctccctaatcattctggggagacctgagcctccctgaaggaaacaaagatcaggatgctagactggaattctgcagccaagaggatgcgcgtcaagattgggttttgtgagttacttgtgctatatccgtcaagaagatttgggttagatagaggggcaggttagcaacatgtagccccggcctgcgttaagagaaataattgccctagggagaagggtgtaggctttcccccacgtggttctcaagagaaatatccaatgtgtggtgtttctggtaaccagagctcgacttgaaactgatcacaagggacaacttattaaaaactgcaggcgcccagcaataaaatgggttgtgcctaaaagtagtgggctccagatcacagggagaatgactaccaagaacagatttttcataggagtcgacaaagaaaattgatttttgaggaaatgggggtttttagagatgtttgaaaatgtatttgaaccttccaacagaaagaaggctttgctttggtcctgacccttgcccatgacgagagttataggtgtagctctgtgatgccagcccctggggaggatgggtatgggagggtgctgggggcatgaggggcagagagccttagggcaggtcacagcagcaacaccattattatcacccttatcatcattcacaaccatttattcagagtacttataagtgccaggcacggtgctaagtgctttttcattttcttgcatcctaacaatatttctagatgttgggtgctattatccccattttacagaagagaaaattgggcctgaaactcccggcctatctgactccagttgcctgcttccagccactctgcaagtggcctctctctgctgcttcttgcacccggcacaagcatttgctgaactggaggaccccagcttggggaacagctgtgctggggtggggctcctgttctctgggattctggatgagatgcccagtcccctactctaaagaaatgggattttcagaattccagttgtcagctgaaaaggcagtgtctctttggctcagagatgttctgagagcttcttccaagggacttgaagcctgctgggaatgaattgtgcctcaggcttaagtgagcaccctcccaacccagcaggggtgggtgtcactgacatgtggcacctctagcccggagagcggaggaagggctggggcaggggtggctaggtggcacctgcctgagccaggggtctgaccagactctttttcgacctcactgtttgtggtgactttggttctatcttgctctgaggaggcagtcagaggccatctttgggcagaatgtccataatcactggggggccccactggtccttcaccaaggagggaaatctgaataatggacattatgagaattcctaaaatgggacaagtgttgtgctcagagttgtacatgcttatttcatgttcataataaccccatgaagagggacttatcatctccagtttactgataagaagacccagcctcaaagaggttgtgtaacctgcccaaattcacccagctagtgagggacagtgggccagcatgccagccttgagactgtggggaaggaagggaggaaggaagggagggagggaggaaaaagggagggaaggcaggcaggcaggcaggcaggctctatagggtttgtgccatgcatctgcgaggttcagtctgacatttattgtttcagcaaagctaatcctcacaatgactccacaagctgagtcttcgtcctcactgttttttttttttttttttttgagacggagtctcgctctgtcacccaggctggagtgcagtggcgcaatctcggctcactgcaagctctgcctcctgggttcatgccattctcctgcctcagcctcccaagtagctgggactacaggtgcccgccatcacacccagctaattttttgtatttttaggagagacggagtttcaccgtgttagctgggatggtctcaatctcccgacctcgtgatctgcctgccttggcctcccaaagtgctgggattacagatgtgaaccaccgtgcccagcccagtccccacttctacagatgaaaaaattcagccaggagcggtggctcacgcctgtaatcccaacactttgggagaccaagatgggcagatcacgaggtcaggagtttgagaacatcctggccaacatggtgaaaccccgtctctctactaaaaatacaaaaattagctgggtgtggcagcgcgtggctgtaatcctgtttactcaggaggctgaggcaggagaattgcttgaacccaggaggcagagattgcagtgagctgagatcgcgccactgcactccagcctggtgacagagctagactccatctcaaaaaaaaaaaaaaaattcaggctgagaggttaagaaatgtgccccaggtcacacaggtagtcagagtggagcctgggattagatgtgggtctggctgccccagcacctgcactcctactgggggagtagaattttctctccagcttgcccttctgaggtttgcaaatcaaaggggcaaggcaccagcctgctcacgcgtccctgtgtcactgagcttggcctcgccaggcatgtatgtgtctgtccctgggcagaggggctgtgtggtagggacctttcacatctccctgctgcaggcacctgtcatcacaggctgagattggcacagcttgtaaacagccctgtggccagacactcttcactttctcctccacagctctactcatggagtcagcgccaaaactgtctcgagaaattagtttgcctttactgaggcctccttgggagtcccagcagccgagggggagagttagcagggcaggggcaggctgcagccaggggcccatctgcttctttcttcagtttgtgagcaaccgaggcacggcagagggtggacagggccaaggccagggaatcagaagaccatatgtcccgatgtccttaccaggaaggttccccacatctgtcctgcatgcttcatgggcatttgtgatgtgaactccttggagttcaggtcggtccccactgatcctgggcagctgctttggctttcccaagtctaagagtctgaaaggcaaggacactgcagccctgcaaggcctccttgaagcatccgtgggagtcacagcttagccactctctctccccaggtctcacagattctcttctttctactctctgaccccttaccccttgtgataaccttgatctggctgaggagccacaaggggtaggatgagttctacaccatttcctttgtcagttctgcccggcactttggttatgcacatcgtggagcacttaccaggcatctgatcagttcttctgacctccttctgagtatccctacttttttttttttcttattccctctcctgacccctcatttaaaaacagggtagaggtttcctaggaagggtgctaggttttctactgggcaggtacctccattggtccctagggttttctgcctagacacccctaaggcttttcacaaatttatttatttggaggcagtggggagaatggttcagaatttctcctctggagctagactgcctgagttcataatcccagctctgtccaccagcggggtgaccttgggtttgtttcataacctcatccattttatggatgaacctcaatttgctcatccataaaatgggaataatattagtaagactctccaagggctcttatgagcattaactaagttaattcgtgtaaagcctttataatagggcctggcccatagtaagtgccatttgagtgtttggtcttcttatttgttcctattttgactgagtgcccacacagctctaggtgtcatgcttggcaccagagacataacagtgatgaagaagaataagacaaggtccttgtcctcacgtagcttatgctttgtggagagatggaaaagtaaacaggcagccacgacacaccatgaactgagtttttcagctcaaaagctagtgctgtgacttgggcagggctgtatgtattgggagcatgcaagagggacacctggtgtgggtggcagggacggtgacaggtgtcacctgccttcacctgtcacaaagctcactggctgctgaattttcaccctgagccatatggccatctaaacttccactttctcccaaggagatttaacctgaatttaacctacatatataaaaaatatatatatatatatataacctatatatattttaaatatatatatttttaatatataatatatatattatatatataaatatatataatatatataatatatataaatatatattatataaaaatatatatatattatatatatatataaatatatatataatatatatatatattttttaagatggagtctcgctctgttgcccaggctggagtgcagtggctcaatctcggctcactgcaagctccgcctcctgggttcacgccattctcctgcctcagcctcccaagtagctggaactacaggcacccgccaccacatcccgctaattttttgtatttttagtagagatggggtttcatcatgttagccaggatggtctcgatctcctgacctcatgatccgcccgcctcggcctcccaaagtgctaggattacaggcgtgagccactgcgccttatttatttatttttaagacatggtctcactctgttgcccagcatggagtacagaggcatgatctcgactcactgccacctctacctcctaggctcaaagaattctcccacctcagcctcctgagtagcgaggaccacaggctcatgccaccacgcccgctgactttttgtatttttggtagagacagggttttgccatgttgcccaggctggtctcgagttccagagctcaggtgattcactcgcctcagcctccaaaagtgctgggattacaggcatgagccaccatgcccggccttaacctgattttttggattcaatgctgtacttggtcttacagaagctaggaactagccccttatagactgtctctgagaggtgtgaggaggggtgctgagggccctggttttggggtggaggttgttggtaaaaatgggagtttccccagagacagtggcttggcatttatttccctctagaagcctgccttcatgaagaattgcccacgcaacacactcccttcaggccagcagaggggcaggttccccttattagggaggagaccattttatataaaaagcacatacatgtatccagactaatgggtggacccagctcctctgagattcactcattcctcgggttctcacagttttctgcaggtgccagcagctggttccactcttgcttcctgctctcatccaagctctctgctgctccccttctgatcactaaagaagcaggggcctctgcttcctccctctccctctccctctcagtctccgtctccgtctccctctgttgcccaggctggagtgtaatagcacagtcacagctcactgcagccctgacctcccaggctcaagtgatcctcctacctcagcccccagagtagctgggaccacaggcatgaaccaccatgcccagttaatcttattttttttgtagagacggggttttgccatgttgcctgggctggtctcaaactcctggactcaagggacactcctgcctcggcctcccaaagtgttgggattacaggtgtgagctaccatgcccaacatcatttctccctcttgacatctagagagttgatacctttccggcctgctggctcacccagctcttcctgatctctctctctctcttagagaagcacagtggaaggtaggagaaaggatgtggccttcacagctagaggcccgatttcaaccctgcctctgctccagcaactttgttacctgggtcagttacttacccctcactgagccttgctttcctaatctgtaaaatggggatgacggtccctgccttagggcataattgttgtgagaaacagacatgaccatgtgtacccatggccttgcaattctgaagcactggacaaatgtgcacttggtctctttcctcagccctctggcagcagccttgcatcattctttcccaccttctgctcctcataatgttcacaggctgcatctaatcagcctgccttctgagtttctccaaaggacttctctttcttccctcctctctgtcctcagtttataccaccaggccccacgccagggacgtgcacatctcccagcctcactctcatctttccatctccttctcagcgttttcagaatccccgtgtgtctccacaagagtggccttctaggctggaccctggtccctacatggaacgtgcaaatccggagcgggccagtcctggcaggaaaacatttttgaacttcagtttacattttttaatcttaaaaaagttaagcgttactaatttatgtcctcacttggtctgtccctatgtcaggctgtcacatgtcatgcttggcacacagtgtgtcctcagggaagagtggggcttccaagaaaatgtggtgcctccttctatttgtctttggcatattgcaacacagtgcagttcacagtgctgtgtttactggattttttagttatgtattctggtgttaactaaactaacccacacaaaatggagaggtggctcttaaaagctcctgcaaagaaactgtggatgcaaaatgacactagtcccataatcacaagcaatcattaaaaaacgcaatgccgacccttctcagggggtcttaccatgtcactcagccttattacaaagtaaaaatcgtgacgacctatcagatgtgacccccaagtaccccaggatccaaatgatcgagaagactatatgaaatacagattgatgtaggccattactaataacaaaccttgcgctaagtgtgtaagtgcccagagagagcagctaatggtgaaataatagctatcttgattagaaaaacattttaaaccaccaagacactcaaactttgctgtacaattggataaaggataaatatctctaacatgcctcttggtatttgcaagaattcatttcaacaataaaaatatatgaaaggctgggtgcggtggctcatgcctataattccagcactttgggaggccaaagcaggcggatcacctgaggtcaggagttcaaaaccagcctggccaacatggtgaaaccctgtctctactaaagatacaaaagttagccagccctggtggcacatgcctgtaatcccagctactcgggaggctgaggcaggagaattacttgaacccaggaagtggaggttgcagtgagccgaggtcacgccactgcattccagcctgtgcgacagagcaagactccatctcaaaaaaaagaagaagaagaagaagaagaaaatatgaagaactctctttttgtaaaccactaaaggatgaaccagtggacatatattctcaacagtaaatgacttcctggatgacaataagctttagcaaacaacactgaaagtgtagctactgatgttatgactgggagaaaaaggaattgggataaggtaacagagatggagggtgcagcattcagagacaagctattgccacaaaggagtcaaagctagaagacggcaaattgctacaggaagccatcatgcagctacctttatagagcaagacctttgaaatatcatggtatatttatggaactttgtatggaataaggtctgtggcaattgctcgtgcctgcttagaattgctggctatctataggcaaaagaattgtcagacttatagctgagttctctttttgttccacaaaagatagtattcccctgccttttcctgtgaagacaggtggcgatcagaagtatgcctcctgctagagcttttcaagagggttggcacactagtctgttcctccaaagtaatggagatttttttcctgtttttatttaatgtcaactctttggtttttttttttttctttgtaaagtaagggggaatgttgtgatttcaaggcaggatgtgtatcagcataaaaatactgagaataatttccttgttggtcaatctgcaatcagacatctgtgtatttttagtatttcaaaataaaaagcaaaaagtaataacaataaaatccatgttatatatataacatgcatgtagtgtagtagatactatatgtaataactatgtatgtgaagtatataatacatttttcttagtattaacaaaattttaattgacaaataaaaattgtatatatttgtggtgcacaactatttgtttgtttgttttgagatggagtcttgctctgtcactcaggctggagtgcagtggcgcaacctcagctcactgcgacctccccctcctgggttcaagcgagtctcctgcctcagcctcctgagtagctgggattacaggcatgtgctgccatgcccagctaattttcatatttttagtagagatggggtttcaccatgttagccagactggtctcgaactcctgacctgaggtgatccacctgccttggcctcccaaagcactgggattaaggcatgagccactgcgcctggctggtacacaactgttgttctgaaataagtatacattgtaaagtggctaaattgcacccatgtgtattacctcatatatttattttttgtggtgagaacacttaaaatctactctcttagcaattttcaagaatacaagacactgttattaaccatagtcactatgtcgtacaacagatcctttgaacttattcctcctgtatctaactgaaatgttgtaccctttgatcaatatctcccctctcccccaggccctggtaactaccattctactctgcttctatgggtttgcttttcttaggtcccatatgtaagtgagatcatgtgatatttgtctttctgtgcctgtcttatttcacttagtactgcttttaataaaagcgaggtgggctgagaggagtctggtgagaaccaggaagcacagctgcccagggcgatggcttcgggggctggggctcactgctgccgggtgggctggacatccagactgcacccgcttcccagcatgggtgacagaggagcccaggggccgtccagtgagacctgtccgtatctccactcttcagcctccccggtgattgagaatggccagctggagtgtcctcaggggtacaagagactgaacctcactcactgccaaggtaggacccccagggccagggctgggctcaaggatgccggggcacactcccagcaccagacaggaggggtgtctgtcactggccgagtggtctccactgagtccctctaagccccagctttggggagtggtggggggctgctgattccaggggactaaggaaatccagggacttgcttgagagtgacagaggaagccaagggggccgacacctcccctcgtccccatctccacccacacccacctggaacacaggctaggggctctaggctatgtggggctgtgtctgaaggggccaccccagtctgtgcacttccacttttctcctgagctggtctccctggagtgggaagaatttcagctctagggtgggaaatcaagtcagcctgagttgttggggcctctgtgggcttttcccaactgaaaacctttagctactcaggcttccctcccgcttgcttcaacccatagccaggaaaggggacggggagcacgggggcttcctgcctgggacaggctcctggggctggcagaggccagtggggaacaaggtggcttccctgtggggagctttgacaactggacaaacagttgtctgtatggtttgctttgggtggagctgggtcagagacaggggattgacccagatggcctccaaggtgccctcctcctggaggttgcttcagagagaggagtctggggaagctctgcatggctgggctgtcttccttgggggtgccaggctgcagaagtgattcctagcccgtggataagcaaaggtgctggggccaagcaaaagggcaggtctctggcccagcctagtccagagtcagactccctcaggagccagtggtttgagggccaagcagacagtggatgtagggagaaatacgtatttttgcctttggagggtacatcggggctgttcatgtctaaacagtcaccagttgcttttcctcctggtatgtttcccaatctggagctttaaggttatactcaggatctcaaatgggctctctgccctccctctactgagccccaagattcaggacaccaaaggaccttccctcaggaggccctgcccctgaaacctccccttcccatgtatgtggctgtggtctctgtgtctgcgaagggacctgctcatctctgcacccgcatgcgtcatctctcctctctctccatccttctctcctacttccacagagtattggaggggaggttactatgggctacatacactgtgctaggagtacacagtgatggagaagacagtcctgccccaagtgcagacagaccccctgaacaatcaggtctaatgagcggggcattcttgagagaaagcagcagtccctgagtgctacaggatcccatggtgggggcgccttcccagactggaaggatcagggaaggctccctggaaaaggtgatacctaaggccaagactttaaaaatgagtacacgttggccaactaagaggatgcaagctctccaggcaatgtgaaccccataagcaaaagaacagtttgtgctgtctggagtgtcccagaaagtactgtgtacgtggcctgtgtacacacgggagatgccacatgtctgccagtgtctcatcagagccacctgtttacccacaggctttggggaaaggtagagggccttggataccatgttagggtttagagcctccctctaagaagtgacagggaacccagaagcagagggaagcaagtcagatttgggtatggaggcccacatcccactgtggccacagtctggatgcatatggatcactgccccttcccatttctcagtagcaccttcccagctcttattggcaccctgccacaatggggcatcctaccaaggagtagtgccccttggtgctcaggctgggtcacctttcagtccctcgttcctgtgcccagtgccaatttccccaaaccggtgggtgacctggctctgcagacacagggctgcctgtgttaccgcctggcctggaggcaggtgcccctcacaagcaattaatgcttatcatctctgctgccatcaccaccatcaatagaagtgccatcatcaagatggcccccgactcctcatatcttagattgtgagggctgagacttccccttggcagggagaagtttgcagcaggaaaagggggtttccccctttgaggtcacagaagaaaccagtgcacctcccttatttgaagaacagcatgagcctccacgggtttccggggggatgcgtgcagcctgcacaaggaagggcgttcaggaggacccgaagatgtgcccttctgaccctcaacctttgcacactcttaactgtgacccctgctgtccccttccccttcagtgccttcctccagcctctgcctccttttccttaccagggtcctccctcctccagctcactgcagacatgctcccagggtcttggggcctgcagaggtgcttcagggacctctggaggaaggctgaataggagggacttggctgccccttctccaccttccaacccacacagtccccctgatctgtttcctgtctgcatctcaacatgccactctccagctgaatgactctgtgcccagtgccaatttccccaaaccagtgggtgacctggctattcctgggacctcagtttcttctcctgtaaaatgaggacatgtgggcctatttgataaaattgtttgtgagaattaaatggggtattatatgttaatacccagcagagtacgtagcatgtaataggtgctcaataaacactagcgcttgaggcctggcaaggcagctcatgcttgtaatctcagcacttcgggaggccaaggcaggcagattgcttgaggcccagagtttgagaccagccatgggcaacatggtgaaaacacatctctacaaaaaatacagtacaaaaattagctggatgtggtggtatgcacctgtcgttccagctactcgggaggctgaggcatgagaattgcttgaacctgggaggcggagactgcagtgagctgagatcacacccctgcactccagcctgggtggcaaaacgagactctgtctcaaaaaatagataaataaataaataaacattagctcttaatattatgatcattgttacatgccacttattggacaaagtggtttgcaatttgatcttatccatttaacaacaccatctggttgttactatcattatcctcattttacaaatgaggaaactgaggcacagggagaggaatcccactgaatacatagcagctcttttgttgttgttttatctggagagagtatttgaagatctctgcccagcccctctgctccatcaggcctccgtggggcgggcacttggtcatctcctccaaccctgcagatatcaacgagtgcttgaccctgggcctgtgcaaggacgcggagtgtgtgaataccaggggcagctacctgtgcacatgcagacctggcctcatgctggatccatcgcggagccgctgtgtgtgtgagtgctggcagggatggggtgggggtggacagtgggagacaagatgggacacttcaggtccacaggccaggcccagggcagcaattttccccagacctgatcacgccatgctcagggcctgtgtcggctattcaacctggagttgggcccaatgtgaaaaacctgatcagcccatcctgctggaacagagatggttactacttcactttttacactaggcattttttccgggcctttgcagtttggaattcgtcttttctatttcttattttttttcctttctaatcatttctgttccatgtgtagcctcgttttctttggtggcgggaggtggtgggggtggcctctgctctgatgtctggctgagccttggctgctgagtgacctttccagaagggctgtccatagcattcatggagctgctgcccgacccgagggcctttccacaatcctgtggccccttgtggttctgaagtttctccttatctgtgaacacatagtgggcattagcattgtgtccaggtatgtacatgcatgtatgccaggcagccctgtttccagagacctctgtggtttccagggtgagaggcccaggctggcagcagcccccaatggcagaactgacaccacagcccagatagggctttccctgggccgggaggcctgaccagagctgaataaaaccagtcccaactggcctctgggaggcagcagccgaggttggatgggccacgcccagctcagcagagctccctgcaaccggccaagccctcagtctgcaaactttctggtactgggtttgggagggccatgggattggacaagactccagtgccacccagaggctgaacccagtggctctagggagagaagacagcaagagctataggaggggggtgcccagagagtgaggggcccagagtggggagaacatgtcagaccgctctcaagaaaccttcatggtggcagtggcaggtgatcaaggccttgagaggcttacacccttccttctactccacatcacttaagatccctttaccagagaggtgtgtttgacatccaaggtgacttatttattagtcccagaaagagacccttaatacagggaagcagagatggctctcgagtgtccttttttccctctctgtccctggtgttactccctccagcctcctacagtgattcacctccctgtaagtgggaggggtggcacgaagtttctcttccctttgtttctgagttctgcctccttccctccctgccgcctgaccaggtccagtggggcagtctacagggctgccccagcctcctgatattcccacctgggtcatctccaccctggggttcaaagggacagagcccttccttacagtgtcccaatggaagtggctgctagaagcagagtttgcacctggagatccagggctcacagacggctgatgatttacctgtggcgggcacatgacctttaacaagccactctcacacacctcactctatttaatctccacgacaataccacgaagaaagtttattaatcgggagtctttggattgcaagtgacagaaaccaaactcaaactgccttaagcaaaaaagaattcgctggggctgggccccgtgcctctcacctgtaatccaagcactttgggaggctgaggcaggtggaccacttgagttcaggagtttaaaaccagcctaggcaacatggtgagaccctgtctttacaaaaaattaaaaattagccaggcgtggtggtgcacacctgtagtcccagctacttgagaggctgaagtggaaggatggcttgagccccagaggcaaaggttgcagtgagccgagatcgtgccactatactgcagcctgggcaatagacaagactcttctcaagaaaaaccaaaagcattggttcacacaactaggaagtgcagacgtggtatggcctcaggctggctgacctaggcagccacagtgtctgcagggcatgtcctgctctttcctctgtgtgagtttcatggttccttcaaaggtggtcaccagatgctctaggcctacaccctctcagccttgcaaactcaataaaaaatgagccccttttccccaataacccaggaataatagtctcaaagctgattatcattgggcctccttggttaagtgcccatccctgacccaatcactgtaaccaggggtatggaccacaagccttcagccagaaaggcgtcagcctccactccagtcatatggaccaagggtgggaaagggtggttcctgtaggagaaccagagtgatgatacgagaatatggtgcatagactctgggcaggcagaaatacaggtgtcccctgcgatggaatcatcattctcatcttcattttacacgtgaagaagctaaggcccagggaggtctgtagttcatggtggagcagggatttgaacttggtctgctgcgtcctgggcctgaccagcacttccccagaatcattcattcctaaactttgattgatgtcctcttcagcccactctcctcctcttagaatccagtcagccctctacggattccagactcttccaacctggcatggcctcctcgtcttccattgagataacatacagaaactattctttaatatttattttcaaagtacaagaaaggagataagggtggtggcattgctatgacctaagcccagcatagctcaaactcacagtgaccctcagtattttgattggctggttgattctgtgtttgattggttcattgacctagccatccacgcatagcttcaacaagcattactaagcatttgcatgcaccaggcactatgggaggtgcctgggtgacagagatgacccaagatagggtccctgtcctccgagctccccatccggccttagctccttaccttgcctcatcttcccagggaggctgtggtcctcaggacatactgctgcccgctcaaccctagggacacgtggggccttcagtaaacacttctaaactcggcactggagacaagcagctgcatcctcattccctgctctcaggttctccacatgcaggtggggagtcacgagtctcatcaagcacacaacatgggcaggtgctgaaacattccactacgcctcttcctcctaaagttcttgtgagcatttgcagggctccaaacttcccaactgagatatgggccaggccagtctgagtgcatgtggccagccacacctccatccactgccctcccagctgcgcattcccctcccactggccacctgcccacctccacgtgctgtgtctgttgcagcggacaaggcaatctccatgctgcagggactgtgctaccggtcgctggggcccggcacctgcaccctgcctttggcccagcggatcaccaagcagatatgctgctgcagccgcgtgggcaaagcatggggcagcgagtgtgagaaatgccctctgcctggcacaggtaacctcctgttcccatcccagctttcactgcccaggggctcaaggccagtgaccatgttgccaggcctgggtagacttccctcaatctggaagactgaagtagccttccctgcctgctcacgtgcttatcccaacctggggctccctccctccttgctgccacaattgccgtgtctcccaaagggagggaaaggaaggccctggtttcctgcaggaacagcacctctcagtttgtcctctggctgttggctttgcagaggccttcagagagatctgccctgccggccacggctacacctacgcgagctccgacatccgcctgtccatgaggaaagccgaggaggaggaactggcaaggcccccaagggagcaagggcagaggagcagcggggcactgcccgggccagcagagaggcagcccctccgggtcgtcacggacacctggcttgaggccgggaccatccctgacaagggtatctgagctgggggagatgcctgagggattttcctttcccctaagtttccagcacctcagagaagtgtgggtgttaatcctgggtccctgggcatcccatctctgtggcattaggaaagggagcttggagcagcagcacccaaccctggcagccttctctcatggcctggccccacccacttcctcttccatatggggtcaagaggtgcccacgccccagggagttgcttgtggaggtgggaaagatcagccgcagcccccaccccagcgatcaggcctctccatctcctgccctctggccatgcagcttctggggccggtgcttgctgcaggcctgaatagctggcaggtgggtcctggggacctgcatgtcagacccctggcccggccttggagtcagagtgctaactccagctcaacggccttggaccccagaggcacggggctggagggaggctgggtatgaggctctccttgcaagtgccctgaaaaccatggagaagtcatgcccaggtcactggtaacactgaatgcaggaggcctggaacgtcatagcgccagcaaactatgtgattggtcaaactgctccaggaatctggaatagacaggggagtgaggacagagccccagttgttgtggacacaggacaccggccaagccaggagcaattccactccttcctcaaactgttcccctggcccaaagcccagggcagggggctgcatgacccagcctggctgggaggcatgggagggaggaggtagcagtgcaaggaggtgactccagaatggatggggtggacaggtccgggagcaggtgggactcctgtcacccgaggccttacaggaaagcagggccttccgcttaccaagtgagaggcttcactaagctatcttcaggccctccagacctggggttctggaattttgtggtggccagtccctacaggggtgatggggcagaggcaggtaagaagagtccacgctttctgtgctgctggccctgctggggatgtggtctggggcgcagactgtgaagccgcccaggtggcggtgaggggagaaggcagccagaccctcctccctgagctcacgctgttacctttcccttccaggtgactctcaggctggccaggtgagtgcgtcctcccactagggggccgggcaagcatggcagagagcaggacctggtagcagctcaggccccagggcagtgtctcatgagggagggagagggagaaagatggagtatctgttagattttacttgaagagatgaccaagtgggaggattgatccaaagacccagttttaccctaaaggaagtgataacaacagctcttgtttatggagcagccattgtgcaagcattttcccatttgggatgggctggggccccttcagaaaggaagtaggaacatgtcctgttaggcctggctgtcactcaagctttaagcactgcagacgaggtgtggagctgcttccagttcattctgggtctggcactttctgcgctggtttagttgaacctccaggtccctctgggagtggtgtacagggaagtgtgggcacagctgtgaacagcctcaaaccacctcacggagaaaggtgcatccaactcccttccctgtgcccaagattcccctgggaaaacctgggtgtcgtcccaggaaaacattccagaagaggggatctgcttcttccctcatcagcctcagtccctactctgtcccctgcccctccagcctgcatacctgactgttcccaaatacagtttcttccgggtgccttgttctgtccctgggccaccatatgatgtccccccaggccaaagctctaactctggtccccacagacgcagccagcctccagggcctttttcaccctctgcccactcttctgctgttacatccccacctctcagcaaattctgtccactggctatgttgagggacaccaggtataacctgtggtcccagcttccccactctggccctgtggctccaggcactctagtgaacctccagagcttctgttactgtgttgagatgctagggttatagctgacaccaaattgctgattttctaccatggacccaacactgagctggcatagtatgtatatcagctcatttaatcatttcaacctcccatcataagatagttgagaaggttaatgaagtgagtgtgtgtaaagtgcctggcagaatgcccagcatagagtaagaactcatcaatacctggaatgaatgaaaacatgaatgagctcctggtaggaagcccggaggtgggggtcagtgtggtggaaggtggcacatcacaggtacggcagaggagccaaaagtgaccttctcctgtttctgtgcaggtcacgaccagtgtcactcatgcacctgcctgggtcacaggtgagtccctcttcctggcggctcctaggcaaaagagaagggagggaaagagcccttaatcaggagtggagttactatgtgtgagctggttcacgctcacacacacatcagaggagggtgagaaggacgtggcctgtgagtgctgtttctgggagctctctatacacctaaggtgctgtgaagtcagcgagagaccccatgacgcttcacagatagttttctagccacagaactctttgcaaatttcatggcaccacttagcacataaatcagaacaaagagacagcactagctgaaacaggtgtttggctgggtcgctagactctttcccccaagaggtcttgtcctgaaaccactacttgcctgtcactggtgttgggttcagacattggaaggctgagctcatgcttcttgtaaaacggtagaagacactgatgcctgtcttgcagactctcaaagcaaataagatgttggtatttgtggcagagctctgtaagctgtgaaatgctttgtaagcagaagtgaaagaatgttgaagtgggaattaggaaacccaggtgtcagctgtgcctccgacaagctgactggccttggacaagtgaccatttctgcaagcctcagtctcctggccctgacatggaggattagactggatgtgctccaacgcctgttagagctctcagattctctaagtggggccagatcaactttcaggagactggaaggcatgggagtgacccaccccaggcttcacccttcgttcttgggagtctgagcaccagggaagagggaagggccatggccagccaaggggccacaaccccacctcttcccctctctcctccacagggaatgccacaaccccaccaatgcctgaacaggggattgcagagatacaggaagaacaagtgaccccctccactgatgtgctggtgaccctgagcaccccaggtagctgcagccagacctttggggctccctgcaccctgccctgtgagctgtgtctgtccagagccaactccagggcaggggcatgaatggaatgccccctcacctttccaactaggtaaagtccccagcaggctcccagctgggctgtgcacccctggcctcatcttacaaagaacacagggtccctcttgtgaaaacaagagccctgcctggagcactgcccaagcccagaagggggaagagaagggacaccatgggagaaggaagccaggggtcttccaggagaatctgggggtccctctcaaggaaggggagcatggggagtgagggccactgggatcctggctcttccaggccactcccctgagtcagcagagtgcctggcagcgagcagctgcctgcccacggggagggctgattttcgggaaggaacatggttctatttctcaaggttgtttaaccaagcctgcattcctctccctctggtcagctacagtgatgggggcgaggggcgggtgtgggggcgatcctggcaaatccaccttgctctggaatgtgccctccttaaaggctcattgtctggggacttggtgcaggagaagcaaggcgggtgttgttgccgctgctccctgtacacgtgtgtgcccgctcctggggctcctgctctcttaaccttacgactgggtccagagacccagtcaccttgtgttgggggtgagggtggtcagggggttctggatttccttcagcaaagggaaagcccctgcgcctggtggaacagtccagagagtggggagtaggggtccagccttcccaggcacaccccactgacctctcctgggacctctctcctctgggctcaaagcgctgctccagggagcatccccttctggcctctgctcagcaggcagagtgtgcagaggagtgctgaatttctgacaaggaaaatggacctggaggaagggatgggaagcagggggcagggggcagggggcaggccaagctcagcagcagctcttggcatgtggatgagtgtccccaccgcaaccccagcctcagccttttgccctatcccccttctcctctgccattctgtaacctcacccctctgggcagacatttaggacccagctgagggcccccacaacccccaaggctgacacaaacttagagccaggcccggggagagggtagccttgggtgcacattcaattcagtacaatctggcagactgttaagccccactgtatacccacgtacagaccattccccaacccattcccttgggtcttcggcttctcccaagctatgggggcggggcagggacccctgagcatgtgggcttcaggcaaagacttcagggtggacacaaatgcagaagcatcattcattcatttatccatttggcatgttctaagtgccaggtacctttctagtattagggataccgttcagaaagctaaagtctctgctgtctacacagcctcaaccccgagtcccagtgagtctgcctccaaactatttctcaattctgtacctgtctccccacttctcaccccatcaccaccacccaaggcagaccctcatttaaattatttcaacaggttttaaggacccactatacctcccttaccagttcatccatcatctcgttgcctgagtggcctttctaggactgctctgacccacccccacctttcacaaaatccttgttacaggccagtctcaatgtggctttcaaggctctgctcagctgaccccagtccacccctcccattttcccctggcagttttccccaagcaccttactcaccaggtctgtctgtctgtccagggaaaactgggcaggagttgcagggagggatggcgctgggcactgggtaggagtcaggcccattttcggggtggggctaggatggaggggttttgctggaaatttgctggaaatatgggttatccattagatctcggtgagggggatgccctactatgacctccatcctgggtagggctcggggtgctgggcagaggtcccctagggtcttatgcaaggccaagctgtgcatgggtatgggagggagggcctggctaaggttggccttctgaggcccctagaccctggccactgactgtccccaccccgctccactgcctttgtccagcacccaccctgccataacctctgttttgctctgtctcccacaggcattgacagatgcgctgctggagccaccaacgtctgtggccctggaacctgcgtgaacctccccgatggatacagatgtgtctgcagccctggctaccagctgcaccccagccaggcctactgcacaggtattcacttgggtgccctgggcttacttggcggctggggtagatgggagcaggggctaagaggccgagttgagagtccaggaagaagcagaaggtccaagcagtgctgggtggttgatgagtttaggaggagcacagtccctgtggactaagctaactttaaccttcaggggaagaccagtctcggtgagccccatccgatgagtctccaggactccaggagcacagaagccagcccattgcatgcatcctggcctgtgcctggcagccctcttctctgagatcagcccacccctcaaactggccattttgctgcctggagagcacacccaggactgccccagttgcaaatgtctccaccagggtcatccgtagggggaggtctgaggctaagataaatcatcaagtgtggacctcattcctcctccccccaatattttcaaataagggagaaatatccattgtggtttcaaaggagaaaggaatcatgaggctactgggggaaggagtcgaggggcagataggaggggctggcagtcacgccaggcttctggtgcctgagtgggcccactgggctgactttatggcttccagccttagagattttcagcctcctccactccctcaccccttccttgccacacagcaccatcccctgcccagcccctagtgtgggcaggttgctggtaggtgcccaaagaacggcaccgctggcccccctgacctccctccctgccttcttctggtcagatgacaacgagtgtctgagggacccctgcaagggaaaagggcgctgcatcaaccgcgtggggtcctactcctgcttctgctaccctggctacactctggccacctcaggggcgacacaggagtgtcaaggtaagccaagcccgcccttgcccttggccaggccccacagtcttgagggggtggaagaggaaccaggggttcacacccccaaacaccgtgccgcagaatggggagtgggcagctgaaggagtgaaggaggagagaccagaactccagcctggatctgggaggaggctgattctatgccagtggcaaggaggggtagaaatccaaaaaccagcaatctctgcaaaggccctaaggaattgtgggtggaaccaagagtgtcacagggtcaggagacatggctggagatgaggattatgcagcaggcccccaaactccgagtgacaaggagctggtttcatgtcagggaaggagggagacccataaggatgccaggctgggactactggcagacctgggagtaggtgtgcctttgaacgaggagcacggctcctcagcagcttggaggcacttgtagggctttgcacttccctgggaagatgtgatgtggcccactgccaggggacccttgataaatacgctcccaacgcaaaccctttaatgatgcaaaacaccccacatacatttttttccacatacatttttatgattaagttcacaaataatataatgcagcactttctaagcaacaccttaagattcataatccagttgtaaatccttcacctcaagagggaccctgcctgtgcttggggctcacattgctggttctggccagacccccagggaggccagggaagctgtgtaccctcctgctgccaggatcccctcgggttccaatcccccaagggtccagtttacagaaaccaaagccatccaggtccaatcacttgattatggagggaagggaagtagaaggggcagacctcctaacttaacggaggagcgggagaatcacgggtagtgttcattatgctctcatgcgttggcaccacctatgtgccaggcactgtgccaagctctgaggatgctgagatgagtgaggtgtgaatggtgacactgtaggatccagatgaggagcaagttgttctgtatgagattattcgggtactcgagatggagcagaataaaaatagctaccattcattcattcattcattcattcattcatttatgatggagtctcgctctgtcacccaggctggagtgcagtggcacaatcttggctcactgtaacctctgcctcctgggttcacgccattctcctgcctcagcctcctgagtagctgggactacaggcgcctgccaccacgctcggctaatttttgtatttttagtagagacagggttttaccatattggccaggctggtctcgaactcctgatcttgtgatccacccgcctcggcctcccaaagtgctgggattacaggtgtgagccaccacacctgaccaagaatagctaccatttaatgagcacttaatatatgctggcaatgtcccaagcattttgttatatgaagctcatcatcccaactccatgttatggaaatccttagccccatttaatagtttagcaaactgaggctcagaggtgaattgaaatacccaggggcctcaaacctagtggtgacagagctagaaacagaatcaaatcactctagctccaaagcatggtttgcttccaaagacacactcccttacacacagggtgttggagcatgaataggaatggagcgtgaataggaattgagggagcagagggtattccaggtagagagaagcatctttgcagagacctgaatagtgaacgttccctggcatgctctgggaataatcatgaatgcagtatgactggagcagggctacctggaggaagaggccagtgtgggaaatgtcttgagtgccaggctgaagcgcttggacactgtctcacaggcatgggtagccagtagaagtctgtgagcagaacagtggtgactgggtcagctgacttccggggagctgacttaaggggcagggctcagaacaggctggaggagccaggagagaggctgagggaaggaggcttctctgggctccaatcgtctaggtgggtgttgtgggccagaggcactgctctttgcagacccagcctggggagctggcctgggataagcagcagctgctgcagagaatggtgtcaccaggactggtgcagacacaagtttctgccaccgtgccagcctgggtgtccaagatgtctctgccagccccagcagctggggaacggggatggggttcaaggctggctctaagtacttctcccagtggggcttgggtaccactggaagaggccttgtccagaataacacccactttctgaagcttcccagtctcataaagtaatatctcattacctcaatgatttgatatttatatctatttatagattatttaaataatgtatatataattaatataaatcataatttatattatcaataagataaattatttacatattaaatatctaagtaaatgtttaccaataaatgtaagcatctcttcatacattagcctgtgggtttcctcatctgtaaactgctggctcccatttttgctcagttttccaatggtggttgctgctttttcctggggctctttaggagtccgttatatattctagattcttggccgggtttagaaattgcaatgctcccattttgtcctctatcctttaagcttatctacatttcttggaacagaaatccttaattttgatttactgaaattcaccattttgccttatttttgtgtgttttgggggctttgtttaagaaatccttccatatcctgaagtcataaagatattctcctataccttaattgagttctagttttcccttttatggtatgctttgattcatctggagtccatcttcatatggctgttaagaacctggtctttctctattcacgtctccatttttctccatggagtgagggagttttccagcaccatctatcagacagtcgtcctgacctcaggggataatgagttcttcatccagttcccacatacggctctgtctatgagttcccttctctcttccattggggttagagcttctcacagtgaacaccagttattccagaattgcctgaagagctataacagcgtgggttcctgggcccaccagtacagcaggatcagaatctctggctgtgggcctaggagtgtgcatttcccaccttctggcagagactttgctgtgcactggagttttatgaagtattgctcaagtgaagacactgtccttaaacaaatggttattattcaattccttcagtaagcacttattggggttctgtgctgggcactggagatgctgagataataaggcatgttcccattagtcagggagaagcaagtaaatgaacaggtacactgaaagctgggccctcaggggacgctgggttggagataagtgggaggcagtcacactggtgtgtaggaagctgttccaggcaaggggacagtgtgggcagaggctcaggaacaggtcctgaggttaggcgagggtaggagaggtgcgggcggcaggaaacagatgagaagcaggctggggccggtcatgcaagatctcacacgccaggcttgaggagctgggattttatggggtttaacactaggataataatagctaacatttctgcagtgcttaccttatgccaggtgggcacagtgctcaacccctcacctggattattgtatttaatctgcacaaggactctgtgaagtgtttgtatcagtcccagtttaagggggagagtgggaaggtgaggccttgattaatttgactgtggggacaggggatggggacccacaggacccaaaggtgatgcattaaaccagtccttgaaatgggggcagggatttgctggccatcgtgaggaaagagactccaggtggaagcatttgtgtgaacaaaggcttggagattggactgctgaaatctgcaatagctgaggctataccaagggacttgtgtgaattagcaaatacagcagagctgggccagctggcaaaggccttgtgagccaagctgcgaacagaactggaggtagcaggggtctctggtaggagtttaagcagtggaggggcgtgagtggggttgggctttagatgatgggacaccaatatactttggaaaagtgacagaaaccacaccctacagatccatggttacctaaaacgcaatccctcactggctgcttggttcctaacctttatgaaggtccttaggaaggactccaggaggccaggtgcagtggttcatgcttataatcccagcactttgggaggctgaggagtgtggatcacttgaggtcaggagttcaagaccagcctggtcaacatagtgaaacctcatctctactaaaaatacaaaaaaattagctgggtgtggtagcgggcacctgtaatcccagctacttgggaggctgaggcaggagaatcgcttgagccagggaggcagaggttgcagtgagccggaggttgcagtgagtcaagatggcgccatcgcactccagcctgggcaacaagagcgaaactccgtctcaataaataaataaaggaagaaaggaaggaaggactccaggagcagacccgaaggggatatagtggggccaggagcggggtgggagtccttttggcctctgcagtttatactgtatggactgctaccccacctccagatcagcccttgcatgagggtgaggaaacagttgtaaggatccccatgggtccccagagtagactcccctgagagaaaggaactcaggtttatcaggggcctgagctagatcatttcagacctggcccaggagcccctccaggcaattgtggctgcagccagcatgccttccctgcccaggcctcagcatggcatcctttgtccttggcctctagaaggaatgctccaggaccccgccccctccaccatcctccagggctggctgtgactcagggcttttctgtgtgttcacagatatcaatgagtgtgagcagccaggggtgtgcagcggggggcagtgcaccaacaccgagggctcgtaccactgcgagtgtgatcagggctacatcatggtcaggaaaggacactgccaaggtaaggaacgggaaggagggaagcgccctgccaccccaccacccacctgtccctccctacgcactgcccaccaccaacacgccttctggcttgtctctgccctggccccttgatgctgagcccacgtctatggacagagacacctatgagaattcctgagcccttccatcccctcagtgacattctggcatcctgtctgccacctgcagcaggggagcatgaacaactttatccacatgacaccttaggaacatctcctctgtaacctccgccctgttgccttgaaaaatgtgctcttctcatggggcagaggaagagtcggtgtgtctgggagtgtcagccttcttattaagcttgttagattgttagctcctgagggctgggccatatctttagatggcccatacatggacaactgataagcacccaataaatgctagaggaaggaaggaaggaagggagggagggagggattccagatccttctgtctttcccagacccagccagaaggcgctgtgacattgctaactggtctcctcacagacccttgcctgtctcgtgccagctctgaagacccctggcagctttgctgccaccacgtccctgtcaggctggggtgtcacaggcttgtaggaggcccagggcatttgctctcgagactggctgggacaggaagaaatgagggtaaatccaggcgcagtccaagaagaacctggccctgggtccgagcttaggctgagactcctcccagcctccaggtttccctggctgggacttgcctgctttcagaagggcctggaagtcagagaagagcttgtgtactttgtgaaaggacagcttcccttcccaataccactaccatggaagcgaagtccagagaagcaaaggggagaggttgcggcaggtgcaggacagacagctctgccttcagccccagtgtgtcacctcccaatgcctccctcttggtcctccccctttaaaactcaggcctacccatgaccaaagccggaacccacctgccttgtcctccttagcacgatggagataagacagcctggcatcttcaggagaatggagaatgatggcacccaccactgacaggtgcctcctgtgtcccaggtgtctgggttaggtcctcaatagattacctcatttaagcatcataatgacactgtgaatttgacattagactttatcaaaaagagaagtaaaatgagaggaaatgaatcaagaaaataccagaacattaaaaacatcaggtttaggctgggcgcggtggctcacatctgtaatcccagcactttgggaggccgaggcaggtgggtcactggagatcagcagttcaagactagcctggccaacgtggtgaaaccctgtctctactaaaaatacaaaaattagctgggcgtgatagcacatgcctgttatcctacctacttgcgaggctgaggcaggagaatcacttgaacccaggacgtggaagttgcagtgagccgagatcacgccactgcactccagcctgggcaatagagtgagactctgtctcaaaaaaaaaaaaaaaaaaaaaatcagatttatattaaccagtctgtgtgaagggcacaggctctggtgcagacaggcttgggtttggcttttgacgcgatgtctggaaattgaactgtaatgcccatctcagagatgtttgtgagcaccggataagctaatgtatacaaagtgctaggcaccgtctggcacatacagaccttgaataagtagagggaaatgttactgtcagagggtagttctttttcatgtccaggctcccccataccccagccctctccttcccttcccaaggaaaggttctagacacacacctcatctgggaggtcaggcagagttcctggcccagggcagacactccgagtctgttgaaagaaagaatgatgtagcccgcacacttctccaggtttccatcggtaaccacaagcccggcccatcaccctgggagcccagtcaatttcctctccctctttcttctttctccaactcagaaaccactctcgccactgaaactgaaagtctctggtgaaaggctgagtggtctggacagaggcccgtccagcagtctcaacggcatttccgtcgtaccgggactccaggttcccacggacaggggatagacttccctgcagactgccagggcctttggtgtcgcccagccataaccaaggtcacttgagcttctggcccctgcctgagtgccttccctacccccaccgcatgctctcacaaccaccagaagtgaatgcctttatatttcctcatccaaaggctgatctgtggttagagaagctccaggattctcccagcgaaccaacagaagcttggcaagctggtctctggattgattgttgccatgggccctttggggtctcttcagcagccttataccaaaaagatgaagggtgaagtttgaggcatactctcccactctttggttagcaaacatttgttgagcaccagctgtgtcggccatgggctgggaacacaggaagaaggcagatggctcctggcttcaaagacagaatattaaaaccctccaaaacacaccgtaatctcagattaacattcataccctaggccaggcagaaaaactggaatatttctgcatccagtgactggttccagtccaggcaccaagatgctggtgggacagcctcagagtagctggtaatagaatctgcttcattcggaatcttcctctggctcctttggattggcttggctaatggttcagttatattcacttccaccaaggagagcccttccctggctcgggtggagaatgaggggctgctttcatcatctgccctccccctcccattcacgtgtgataatcactggctggggctctggtctgaggaaggaagccagcagtggcatgccaagatagacaaggttatgctgcgttaacaaacaacccctatcttattgacatagcagccaagtttgtttgtttgtttgtttgtttgagacagagtctcgctctgtcacccaggctggagtgcagtggtgtgatcttggctcactgcaacctcctcccccaccgggttcaagcgattctcctgcctcagcctcccgagtggctgggactacaggtgcccaccaccacacccggctaatttttgtatttttagtagagatggggtttcaccattttggctaggctagtcttgaactcctgacctcagatgatccgcctgtcttggcctcccaaagtgctgggattacaggcgcgagtcaccatgcccagcagcagccaagtttctatctcatcagtgccacatgtccatcaagggtcagctgggggctctgccccatgtttcctcattggagatgtaggctaaaggaatagccagtctctgtggaagaataaaagagcactctggagggttgcacaaattaaatggtttggtccataaattatccgtatcatacgcactcacagttcgttggccctcactagtctcatggctccacccaaccacaagagactaggaagcaccagattaccatggtgcagaaagtggagagctggaatgccacatgcatcctaaatgcccagcattaagacactacacacaccacctccaagagatgtgcccagcatgtttggggcaggacagacttcagggccctttgctcctggcaaaccttatctccttcccacgttgcctgatccctgcaggaaaggtccaaagacttcatttttcctggcatggatttaggaggagctttgcctcaatctcgttctcttcatcctggaagagatcatctggcatccctgaaacagggattgctgctcattctcagtggctttgcccatcctccttcaagtaccttggccaaggccaacaggtcatggcactggcctctgtctcttgggtggccaaagttagtcatcttagatccttcattttatccatctctgtctttacagaagcccttagaatagttaaggctggtgtcaccacaactcaagtaggggctggggctaccctcttgccagagatgcgccttatctcagtgtccccaagattatatgggagttgtgggactctccttgcagagacccacctgaaaaccacctgccctgtggcgatgtccccgtcttctggaccctcaggcagaagctttaggcttgagagggtcccagtcctctgggacagagggcttcgatgtgtcctgacttctggaagccaaacaacctcagagaggactcactttcaccctccactttaaggtccatgtcctctcctctccatgtccagcagcagtgacagctgctggctttagtccctctgcagaaagcctatgttcagaccctaggcctgcctcccacacttcctccataggtgctgagtaggtcctcctctcgggcagtagagcctctaaatatgcataagctggtggacttcctctagaagaatgacaattacccatttaggaagaagaacccctcctctttccttggccaatggacctgttgtgaagagtgggccagagccttgataccgggccagaggggcataatgtcctcctgcagtgctgactcagagttcagtccctgtgacaggacctccctcactcagtccaggtcccctgggtgccttgatgatgaagcccatgatatgccaggttatgtcggggaagagccctctcctcggctccggggagaactagctccctcctcttcctgttgccactctcccttcctgggtcctctcgtcccctgggtgtccatttggtgtccaggcttaacccttctggctgactttcctggatctcaccagagtgggtgccaggatccctacatgattcttggctggaagaaatgtctgacagctctccagcagagaagctttgccagctctaccctacagtctgcactctgcctcagagctggtcttggccatatccaagattgggggttcctccatggtcctcatttcctggtgcaaggaagcccaagttgccttcactgcccctccgatgatctattgtggagcctctggcaatccagttagctgctgtgccaagcacatcccagtaatggtcactgcttataaaggattaggaattcgccaggggagagatgaaagcccatccccaacagcccagctcacaaagtggagcctctgaccctcccacagctggtggtaaccatagcctactgcacccacccagggagtctccctttctaatttttaagttcttccatctccctcttttgtcccagacggtgggtgagaggtggagttgggaacacagggcagctctcattctttcctagtttccctctgtccatccctctccccaaccaaaggcagggacaaggatttgctgtgtcacagacctacccatttgctatgttcccagggatgaccaagggaggggctgctgttttgcagatatcaacgaatgccgtcaccccggtacctgccctgatgggagatgcgtcaattcccctggctcctacacttgtctggcctgtgaggagggctaccggggccagagtgggagctgtgtaggtgagggctgctggccaaggcactgagccagccattcggccttgggacctctggttgagcccacacacggaaagggaaagaggtgggcagagggaggtggcttggaggctgttgtcctccatgatctagctgggttcccagatgacgctgggcatgagtcgccagggctctgccctctgaatcagctagggtggggcccttttctcctctttggccatattcattctggagtgactgcccaaagtcccagcagcttctgtagctggatcctgtggtggagcgaggagcctaagggtcttaggatggggccaggcccttctgcagttcccagggaggaagggtctcctgctcttctgcatctcaaaagcagcgtctaaactgcacgcccaccgcacagcggggcgctcctccctcagaagggcagcaggtctgcagtaggaggcgtgtgctcttttcctgcagccccctcaggaagaaaggctcagggttcagaatgctgggagggactgagtgttgaatagacgctttgaggctctggagagggcagacgtttcccaggccctcagggctgccactcagccacctcggcatgactggcctctctccacgctgcccgcccacccgcagaagctgcttgttgggttgggatcgtgggttgtttggttggccggtaggaggtcatgtagggttcctggcacacacaatgagggaagtcaagggtcttggacacctcatttcaagtatcctcagatgagccaaaccagccccagggcggggagacctggccccctgcgtggatacatgcagagtgctctgagttactagatagggctgaagtgagcccgggggatgggacgccctgccctgcctaggtgggaggagggagcatggcctcatggcctccccaggtggcctgcggcccctctgaaggctggttccctggcctcataactgagatgcttggagcctgccagcgggggctgcaggatggggaggaggccagcccaccgtcttggacttctctcccacagatgtgaatgagtgtctgactcccggggtctgtgcccatggaaagtgcaccaacctagaaggctccttcagatgctcttgtgagcagggctatgaggtcacctcagatgagaagggctgccaaggtacagagatgctgaagcgccccttctccgcaggccgatccagcttgtggctccctcccctctgcacaccacccttggccccctgaatccacccctggccttgcatccctattcacactgacccaacacatccctgcccagacctgtccttcccccacccctgcctacctgccagtgtcctggcctgtctgtcctgcagagtcccacacagaatgcaatgccctatttcagatgtggatgagtgtgccagccgggcctcatgccccacaggcctctgcctcaacacggagggctccttcgcctgctctgcctgtgagaacgggtactgggtgaatgaagacggcactgcctgtgaaggtaaccctggggaggcagtggtggaaggggacagaatataggctgtcttacctcccaaagaacactcaatttgtccccagtttggggctgatgccgaggggctccaggctaggctagaagaccccataaatggacctggccccaacaagagcttctattgtcataatccccaagttcagagtgaggacaggaggaaaagccagtcccagagaagagggaagctgagggcagggctgtcctgggagcgttctagggagggggttttaggaaagccccaggggctcagagagggaagccacggtgaggttcctgcattgcctggggagtgggagccctcctaggtccccgggcgagcgctgtctgtctgcagacctagatgagtgtgccttcccgggagtctgcccctccggagtctgcaccaacacggctggctccttctcctgcaaggactgcgatgggggctaccggcccagccccctgggtgactcctgtgaaggtatgagcctctgtgtgggagaggatacaaatgggatgccccctctgtcagggccatggtgaagcccagcaggtggggggctgctgaggctggaggagctgccatcatcccgctccccaagagtcgctcacaagcttgtcccagctgtgctgcctcatgaggggatgatcccccgtgggtccagctctgcaggcaggtgacaggtcctctggagacttcccccttgactcctgtccttgggaggtgctgccatcggctgtcttcctcccctgtgtggccctgcagatgtggatgaatgtgaagacccccagagcagctgcctgggaggcgagtgcaagaacactgtgggctcctaccagtgcctctgtccccagggcttccagctggccaatggcaccgtgtgtgagggtgagtgacccaggtcaccctactgggggtggggggcatgagtgtgtggggaggcaggcacatccccagcagacacccactccccatcttttccctgcagatgtgaatgagtgcatgggggaggagcactgcgcaccccacggcgagtgcctcaacagccacgggtctttcttctgtctgtgcgcgcctggcttcgtcagcgcagaggggggcaccagctgccagggtgagaagccagcacagctacctctactggccaggagcatgggaagccagcacagctacctctactggtcaggagcatgggcgctacaggctaagactagagtggtgtcccttttaataccagtactgagagcaagtgctcacggccctgcccagggaggagaagatgggagcgaggagtgatgtgagggagcccggggctcagggagggagggactcagtctctcaccagggcctcttcacgacgttgacagcaggcatgcacccactccaaactccgagtgtcacttctcccctttacagagctccagtcccagggaccccacctcacccctcacccccaccccggtgcccacctcccacagcctggcctctggcttcgagccttttcctacataagccactccctgactctcctatgggctactcagggcccagaggaagctacacaggaccctaacagggaagggacccgtggctgggtctgctgacagccatctctactctagatgtggacgagtgtgccaccacagacccgtgtgtgggagggcactgtgtcaacaccgagggctccttcaactgtctatgtgagactggcttccagccctccccagagagtggagagtgtgtgggtaagggctctggggggagggcacagggctctgcccacatctgcccatctctacactgcctggtccttagctcccatggagcagagcactttccacagatgaagtgtccaacaaatagtgtatgtattgagactcagggctcaggggctgtccaaggatgacaaaatgaagacaatcatcatcttcgtgctggcagagcacacaatctagttttaaaggccaaattgattcaatagacattaaacacctgctatgctcaatgtcttttgctaggacaaatagacagttatggatgatcttgaaagcaagggagacagatatgaagacaactctctgtaatacactatgctgaaggcttcgtgtaaagagaagtacagtgctctgctggtagggataggagacagatgggggcagtggaggaaaaggagtgtcacagaagggcaggagctcactgcttcctaaatagcatacggttctcttcccagaggctcagccctgcagggtcaggggaaatcgtcctgaccttgatgtgctggggttgggatgagcacagtaatttggaatagatcaagaaccccagaggttgtggggcatgaccctgtgggaccacagcagtgacctggccacctctgtcctctctcatggcatggctctggggacagatattgacgagtgtgaggactatggagacccggtgtgtggcacctggaagtgtgaaaacagccctggctcctaccgctgtgttctgggctgccagcctggcttccacatggccccgaacggagactgcattggtgagtagggagggaggagagagaggagagagggctgagaaaacctatttttcacatattgagcgagacatgattttctcctgaggacacgattttttgcagctgattgtagcttgtatattttccatccagcagagcttatgaaagatgccacaggactgtgaatgttaggattttcttatcctgggttgagaggctgcttttcacaggtcttggtgctaataagccaaataagtattctcagcagagaacgagagagtgtgcatgcgtgtgagagagtgagcacacacgcgcgcgcgcacacacacacacacacacacacacatcctctatcctggttcccactgtcccacagacatagacgagtgcgccaacgacaccatgtgtggcagccacggcttctgtgacaacactgatggctccttccgctgcctctgtgaccagggcttcgagatctctccctcaggctgggactgtgtgggtgaggagcctgtgggctacccaaggtctgggccagggaagggaaggccctggggtcctcctcctcaactggtcctggtcacgtggctccatcacgggtccccagagcatgggcaagggaggcttcaaagaagagggagacttcaactcctcgcccaggggcacatgggccgggcgggtaaggggaagcacagccgcgctctgccagcagggcagcaggtgtcctcaagcctcagagcctcaggaggcaggaggtttggagaatgtgcactgaggggtaacccttcctctttgtgcacttctgtgaccgtttgctgccactcctctccttttttcttctttcccatgccctctgtccattggttcctcctccctacaaatctatacttactcttgtttcttccccaaggcctagcctgcttcttttgggggcagtgggctgtagtcaggggcagggggcacgggctgcctcttttctgcccacgagcctgttctcacacctggcagatgtgaacgagtgtgagcttatgctggcggtatgtggggccgcgctctgtgagaacgtggagggctccttcctgtgcctctgtgccagtgacctggaggagtacgatgcccaggaggggcactgccgcccacggggggctggaggtgaggcctgggagacacattatccatggtgactcagaggtttacagagagcgtgtccctctgcatccctctactagcctctagccgctgagggggacactgggccagggcctggggcagcatagggaggtgcaggcggggcctggtgcatggaggggtgaggaggctgagggccgcgcgcagcaaaaccaggagctacagggtggcgacgatcctagaggaggctcaggaaaccctgatgctgacttagggtggccccagggaccgcagattgagccttggagggaccctgaatccatctaatccctgggaaccttctggatgagagaggacttggagctgaactaaaccgggctctccctttcccacttcccactccacccgagagctcctgggttcagcctctcacgccaggctggactaggactcagctggtcttcactgccttgggggaaagtgagggagacgaggaagggtgggaggggctggggtacatgtgaagcagaatggaccagagggctgcccatatggcatgccaggcactgggggcagcccgtcccagggaggcaggcagcatggtataccgcaaagcgcaggggaggaggaactggggtcagatccctgctgcactgcttaatagcttaatcgcacagcagtggcgaggccccaagcctctctaagcctcaatttcttgagatgatgattaggccacttcttagggttgtggagagcctcagtgaggtaatacaggtaacagaattttttccactgtaaagtgctacacaaatgttaaatttaagaaataaagtcaaggactattgaccccccttagagggtcatgaacagacagtaatgagcatctgtcacgcacaggtcagagtatgtctgaggccccaacgggggaccatgccccggcccccacccgcatggactgctactccgggcagaagggccatgcgccctgctccagtgtcctgggccggaacaccacacaggctgaatgctgctgcacccagggcgctagctggggagatgcctgtgacctctgcccgtctgaggactcaggtaagaccccaagggttccagatcctcgaagggtcagctctgcaaggtgacactgaaagaaggggagagaggaagggggcagggccctccccactctgagctgaaacgcctctctacatagctgaattcagcgagatctgccctagtggaaaaggctacattcctgtggaaggagcctggacgtttggacagaccatgtacacaggtaatctgctccatcctctgccccaaactccttcacctgagtgggccctagcctgctcctccacagggtccctggggaagttctgcatccagccctggcctcgcaggttgcctccaccttttctgtcccagggctgactccctgcagagtgttagctggaagttctgactcaagctgctcttggagtgtccacatgagcctcacctcagtttccctgctctcccaagctgcacctccagaaacaaactatgatgccttgactaactctcacccacagccacatgtgggcacagggacagagtggagagcactgctctagaggccagaggctgcgctcatctccctggccgcactgatgaggccagaaactctggggaacacacactcacagtaggatggtccaggtactgcgcccctcagcaccctagtcctgaagctagtcttgagaaggaaatgatggagacagagattgcttttcttgggtgctggctacacgccgtgcacttttttgagcacctcacacatattaacaccttttcatccttacaacaactctaagagtatgtaggaaccggaggcaaggcgaacttaagcaacttgcccaaagccacctagtaagtggcagagctgggattcaaacccagcctggctttggattccctgctctaggtacccctcatactgcctctcaccttcctctcacctcagctctgccttccacagatgcggatgagtgtgtgatattcgggcctggtctctgcccgaacggccggtgcctcaacaccgtgcctggttatgtctgcctgtgcaatcccggcttccactacgatgcttcccacaagaagtgtgagggtaaggacacacatgatccctgcccccaccccaggcccacagctgaataatggcccacccagcccctgccagccagtcccattattgctgagagtcccccttcctagggaggccgcccactgcagcaggctggtcccaggtgaaggagctgtgggctgtcagagattgtccccaggagggccttccaggctgggctgggttgaggggagggaggcagggcactaactcttcattatcagtgataggcaaacacccttccctgagggtggttggtggaaaggccaccttggcaatgccccaccctttcctgcctccccagatcacgatgagtgccaggacctggcctgtgagaatggcgagtgcgtcaacacggagggctccttccactgcttctgcagccccccgctcaccctggacctcagccagcagcgctgcatgaacagcaccagcagcacgggtgagtgggcctgagcgtgggggagcaggagaagggtacctgggctggggggctcatgtgcctccgtgccctgtgccaccagaggacctccctgaccacgacatccacatggacatctgctggaaaaaagtcaccaatgatgtgtgcagcgaacccctgcgtgggcaccgcaccacctacacggaatgctgctgccaggacggcgaggcctggagccagcagtgtgctctgtgtcccccgaggagctctggtgagggggagcaaaggggataccctgcagggctgggccaggccccagggagggggatgccctcaccttggaactggggatctagaaagaaggagcagagcaaaggccctgtcttccatccctgctgtttggggacaaagtagggcaggggagaggtggggagaggaatgttgccaggatctcccagagggtaccagtccttgcatgctcccagagacaaagccagccaggctttagctggcaggagctagaacccagctccttctctccctcctccctgacagaggtctatgctcagctgtgcaacgtggctcgcattgaggcagagcgggaggccggggtccacttccggccaggctatgagtatggccccgggcccgatgacctgcactacagcatctatggcccagatggggcccccttctacaactacctgggccccgaggacaccgtccctgagcctgccttccccaacacagccggtcactcagcggaccgcacacccatccttgagtctcctttgcagccctcagaactccagccccactacgtggccagccatccaggtctgtgttgctgcaaaactggggaagaggtgggcaccaaagctgtttcacttccatctcctccacctgctagtcatattgccagcagggtgaggactgggaaggggaaagacacaccaagccagaggtccccgttcacggctcgcttgagacaagtacatacgcccaggtccgaccctaacaactccgtcataaactatcacagggacacaaaaaggtacaggacactgcccctgtcccaacctacaagcttcctgtggggactgagagagagagagaaagctgttcactgcagtctttttctccctccacgccacctacaggctgcagaataacctgctctaaggacacccagcattcacacttgtgacctgaagtgtggattaaggttttctaaggactttaaaggcccaccgtgatgactcggtttgtgaatggtgcgatccaaacactcaggccttggagtctaatgaggaagtcaagcctagcactgtgccatgcacacggtacccaccacaggcaaagctaccacatcagactaaaaccatacctctgggtagggtgtggccttttccatggggtggaggggtgcttagggagtgaagagggttaggtagatctggtcaatgttttgctttgtgttgagtgaggcccctctgctaccaattgttccccacttcccaaaaacacgatgtgaaggtttaaacaaaacacctcaccccttccccacgcccaaacccaaaaactatgtagcaacacactcctcgaccacccaaaccccagcaggagccgggcattgtggaagcagcgagtctcagcctccctggagccctcatttgaagcccagagcacctctccccatctaaaatgacacatactttttttttcaagagtactgccttttgttctagcatctttccacaagaattttatgatcctctctgcccccacccccacagttccacaggggcaccctttgtccagaagggcgagggtcccagcattagggagagtctggacacagccctcagcctcctcctctctccgatttcctcctcccagagcccccagccggcttcgaagggcttcaggcggaggagtgcggcatcctgaacggctgtgagaatggccgctgtgtgcgcgtgcgggagggctacacctgtgactgttttgagggcttccagctggatgcggcccacatggcctgcgtaggtaagtgcagaattctgatggaggagtcaggctggcccactgcccacagagacgcctgaactcaggaaggctggaagagccactgctgcctcctagtggggctgtctgcatcaggctggaagggaagaaagcgccaaaggaaggtttaattatgtgctttagaaagccccttccgtgcaggttcccagacaaaagacaaggacaagagagcacggtcttgggcatggtatgagcttgctgccccctgctttgtccttgagttgcttggttttgggaagtgacttcagcctctggctgtcacacttagggtttcactctagggcagtggccagggcttactaaccagagaggtggaggcagccagcagaggcacctgggctccctacagcactctcctttgtttcctcttagatgtgaatgagtgtgatgacttgaacgggcctgctgtgctctgtgtccatggttactgcgagaacacagagggctcctaccgctgccactgctccccgggatatgtggctgaggcagggcccccccactgcactgccaaggagtagcagtcaggggtcagtgtggcaactacctggaaatggcctccagtcacaggcaggggccttgaggatgatttcctagctgggaagacaccgtgacatcaggccagaggtttccaatcagccttgcctgctttcatctctcccagcttagcctctggctgtaagcttcggtcattgcctccatgcccttgcttggctcaagcaccaccaatcgctttaatgcttcagccaccgcatgaggccctgtccaccacctttcctggccttgctatgggatgcttaccaaaggatggccctcatccaccctcccaagctgtgcgagcatgcaaggccccatggcctcacactgcagacacccctttccagccacaatccaccatcatcctgacgatcccacaactgggacagaggctacatctgccctagggaggtccttcagaatctgtggagcaagaaaggatttggggaagcttggggactgactccagagccccctcctaagaaccatcaccaccactcagccaatctgttctgggccctgattttgccacacctccatcctgtagcccattctctgaccccaaggagtggcagaagatcccttcactcagagaagcaaggctgatattagcttgttgaatgtaagagacacaaatgaagaagaacaaagagcctgagaaagcagcaagaggacatgatgaaaaatacgtggagttgatgagaaaggggagccaaggctttatacgtctaaagaaaatattcagtagctgaatccgcccagtgatagcctgtgggcaccagcagcaagggctgccatgggatacagcacccatctacaaagacctctattacataaacactgcttcttacaggaaacaaacctcttctgggatctccttttgtgaaaaccagtttgatgtgctaaaagtaaaaagtctattttccagtgtggtcttgttcagaagcagccagatttccaatgttgtttttcccctccactcagaaacccctgccctttcccttcagaaaacgatggcaggcattcctctgagtttacaagcagagactcactccaacccaaactagctgggagttcagaaccatggtggaataaagaaatgtgcatctggtctcttctgttgtttttatttcatatcagattaaatttctttaccatgttggctaagtctaaatattagagatgaggctgtgcctactccctggccagctctgctgatagcctatgatgggttccaatgggaaatgactctttactattaaaagacaaggaaagctctgacttcgtacttctctgatgaatggcaatgtaaatgaacaaggctccatgtgactggagcatggaagtgaatgctactttcttaatttaatctgccctgtcctacctgctcctctgattgttagccatcacataacttattgaatgcttgccatgtgccaggcactgtgctgagtgccatacatacatttcatttaattatccaataatcctacttactattgtttattctcaatttacaggtgaggaaactgagacatagaaagcttaaataatttgctctaggtccctatactaattgagatgttttcagcagacaaaaataagtcactcttacgcatgtaaaaatattctttcactcataataaaagaaatgcaacttaaaaccatactgagatcctttttaaaactgtcagattggcaaagatcaaaaagcttgttaagactcctagctggcaagcatgtgggaaataggtactctcataacagctgacagaagtacatattgaagaggacaatatggcaatgtccttcaaaattataaaagcactaactctttgatccagtagtttccacttctaggaacttaaccttcagatatattttcaccagatataaaatgacatacgtaagaagttattactgcatcatttgtaatagctaaagattagaaacaattaattgctatggaacccttaaaaaaggtggctctaaattccttaagaaagatatccaaaacaaattaaggggaaaagggagggttgcataacagcatgtaacataacactatttgtctaaagaatggggaaagagaagcggttgtctgttcacctcatccttgccactccgccttatacctcaccatcggagaacttaccatcccccaaatatatcctgctggcactacaccttcgtaactgctgttcccactgcccccacaacactccaatctccaccttcctgccaaccttgagatattgtatgcatatatacatatttcctttgtttaaaatacaaatagcatactatgcatgctgttctgcactttgctttttttttatacttgcaattagagctgcctcatttcattttacagctgtatactattccattgaatggataaaccataatttatttaatcagtccctcactgacagacgtttccattgtttcctgtcttttgctataaataatgctgtaatgaatattcttgtgcatatttcacattaatttatgggattacatctgcaggataaattcttagaaccaatggtggtttgtggggagggtgacagggtggataggtacaggattgggagacttttcactgtatctccttttgtatttttttgaattttgtaccatatgtatcacctattcaaaaaaaataaaatatttttaaatac

SEQ ID NO: 36638 - DNA, 70937 bp, Homo sapiens
aagctgggagggaagaagaaagggaggggaggggagaatcgaggacggacggcctagccaggccaagaatgcaattgccccggtggtgggagctgggagacccctgtgcttggacgggacagggtcgggggacacgcaggatgagccccgcgaccactggcacattcttgctgacaggttagtggcctgcgcgcgacgtggaggtcccggggccaacaggccgccgcctccccctcccccgctcgggttccgggcgcctgagcgcgccctttgggcaccagcctctctttctgtcccggaccccaccgtacccctccttcagtacaccctgtaccccatttccccggcccagcttctctctccccaggcttgacccctggcctttttttcctctccgcgcccccgcgggcccctccctgctctgcgggcgcagaaattccatctccaattcctgttcccaacatccccctccccgcccagccccagggtagtcctctcccgatccctgtagcaaagagctgggggtcgttgcctgtttttctggggggcccgtttccccgcgattgggctctgcgaccgcgatgcgagccaaaggaaatgggtgtcaagctgcgtccccgctacacaaacacatcttttttccttttcttgatagtggtagagaacacaaaaatgtgacatttaaaacaccgaatttccccctcttgctaagtgcatttctcggtgacggaaatctcggttttcttcggttttacggagcagggaagcggaatcatgaaatgctgggagctaaacagggcgttcaggtcagggttaaccccggctggaggccagagatgctgccgtaccgagtgcgctatttccagaaaccaaaaccaatttaaaacagctgtggatgcttccagtgtgtttggcgggctttgaaggctcccagctaccgacttttggtggcgattacgaggtttacacagagaccttgcttcccttgcaacgttacattttcctaaatcttgtagggtgaatgaatgcgtttagtcacggcaaccgcacgtttaatcctttccagcgggttgccgagattcggccacaaatatttgcgtgcatttgtactatgaacatatatattttatgtcagggaaaattgcagtggctgataagacgctaaaattctgatgaggaaggatgctaaataaaaccttaacgcggattcccatctaagcgcctcagtgtcaggtgcttgggaaactgacaatctgttgatgatcttagtaaaacaagtttaagttaaaagggaaaaccaaattgtctacagctgagttaggtttctgaaacacagatgaaacgctttcatatttgaagagcaaaattgagcacattttagtaacattgctacggattattttatacttggaatatcaataagaatttgacttattgtcataacaacgttgcagacaccgcactttaaaagagagcctttctaggaataaacaaaactgtagcccatttactgagattttactttttattagaaaatgcccactatccggaatatgaatgaatgaaatgcagctttttaacaaagacatttccctaggaagttgggtaaacacaattatactttttagaagtgccttttaatttaatctttaggatgttcaccctcttctgcaagatagaataattccaggatttcttatgcttggtagagtactgttctggtgaccgctgtcaaattcttaccagttttgtttgtttgtttaaattcgaaagttacttcacctagttaactgagacattatttttctaaaaattgagatttaaaaccagtatagatgaaaagcaggaaaaattaaagttcaaaaatccatcttaagactttaaaagtttgaacaagtttgaaccaatttgattttttcatttcaaaatgctaaccaggactttttttaaaaaacgtaattagtattttaccataataaaagtaatttcaggtcattgtacaaaattcaggagagaaaaccctagaaaactctaaagaaaaggtcacctgtaacctattcaccctgcaataacaccagtaaacattatagagtctgctttttcagacgttctctatgcatatataggtagctatacaataaatatttttcataggattgcagttaaatactttctaaaagttaaaaacaagatcaaattaattctcctcgattattttctttccaaagagcctttaaatgttaaataacattaagtttggagagctttctttaaaggaaataatattaattttttaattaaaattttaaatgaacaaccttagtacataaatatttaaaaccagaaaactgagaagaattttctcccatctcactattctaacatattgtagttttttattcctctacatatgaaaatattttcactttgcttagaaatagaattttctaagggaaaaaacagcatcaatatataagtaatttagataaaacctttttgttatccaaaaaacaaaacaatactaaaaataaaacagaaagataacattaatagagcaatactttaggtaacatttttgtgttgtctagaacaacaaacattttcaaaaccaaaaccaaaaccaaattaatagataagaactttaaacatattttggatatttaatatctatgtgaattttggattttctcagatatttatttctggtgttgactatttctgcccattttgcacagggttgcatatacagcaaagaggagttaatgtgtattatttattttatcaaataataactgggcttcgtatttagacattttatctatttttatgagaatttgctgtagatctacgaagctgttgatttaacacctatatttaacttctagtatgttaagaaaattgtatttcaaaacaaagtgggattttcacttgttagataataactagactttctctttggacattttacccatttaatgaaaatttgccatgtatttataaagctgttgaatttaccttatgtatttagcttaagttctagggttttagaaaacgatttcaaaacaaactggaattttcacttgtaaaatagtaattgtactttctatttggacattttatccctttttaatgacaatttgctatagatctatgcatctgctgacttaccacatatatttggcttaatttctaatatagagaaaatatatttctaagcaaagtaaaattttcagttgtcaaataataactggactttctatttggacaccttattcatttttaatgacaattgctatggatttacgaacctgctgacttaccacctgtatttggcttaagttctggtatggtacggaaaatttatttctaagcaaagtacaatttccagttgtcaaagagtaagtggactttgtattgaacattttatccatttttacaacagtttgccataaatctaaaagctgttgatttgcttcatgtattttacttatcctatagtatggtggataaattgcatttctaagcaaagtggcattttcacttgtctcacagacattgaaaataagggacaacaccagaaaaaactggttagcgacaacctcaaggaaataaagataacatgtatccagtttctaacactagttttccactggtgaaaatcatgcagtacacaaaatattgaagtagtgaagaaatcctgacttgttaaaaaaattcccaagtcaaatattcagattgtttctgattctaataagtgcagtatttatagatcacattttctccaaaatacccagccaccttcttcctttttcttttttgctaattatccataatctacccaaatcctttccttaaaacttacccttccatattctgtaaacacctaaatgcatattctaacacttatttcctacctccagtgtaaaaaaatgactctaggggaattgatgatatgggtctgtgttcgttagaaattcttgggctggaggggagatcgcttagtccatagcttcacagaaatatcaatatgatggctgttttctttctatccctctcaacctccccagcagagacagacagacagacagatgtgaggagcatacatagactaacgcacactccattcaggctttttctaaacttcggaatccagttctccagtctgttatctccctgatttccagaaatattaagcctaaagtagcagtacgagaaacaaaaaaaaaaaataataaagaagaaaaagccaatgtttctaggtatcaataagtcttttcaagtgaatatgtttctgattcaagttttcaggttgataggatcagatagagtctcaatgctcttaaatgctatttcacatggattgcttccaagccaaattctctcttcataattcccagtgttttaaattctgtaaccgtattaaagacagtattaagtaaaaaacaaatctccagtttccacagactgactctggaacaaccatttccattgatgttgtatcccttctagtctttgttctgtgtacataaatatttgtatataattataattttaatatgtatagatttcttacactttgttttgaaagataagttaatcctgctttctgcaaagcatttgtcaaggatgcaggatgctcttgtgtatgaggtggtgtgcagattaattagcagtattgctgtgtgagcgggaggcagactgaaccagcaccggcgaggtgtatacgttcttgggtttgcgtcagggtatcgtccctggttaaggatcataagcctttgccctgagttttgtcttcctcagcatttgtacgaatgactttgatgaagatctaagaggcttgctttaaaatccatggattaattgaaaagggatagctgttagaaataggtaacaatttagagttaacatggtttttaagtgggctgcaatgctgtgctgaaagcaaaaaaatattttatagtagtaaatgcatcataattcattggtatggaagtatggagatgactttgtatggtggcagttctttaggaaaatgaaggttattatgaaccagtggcatgatatggttgcaaaagaaaaaaaaattagttaggttctggtagtagtatagtgtccatatgtcacaaaaattaatagtaccctgctctaatcaaccacatctgtagtattgtgtccatttctggctgtcacatttaaagagagattttgacaaattagacaacttccagagcagtccatggggatgttgaagggtctggcaatcctgtcatgggaggtatcctcacagggtctggaagtgtttaacttgagaagactaaacagtcaacatgaactctctgatgtttgcttcggaaagtagaactagcatcggtgggttaaaggtacagatagatttcaacatgaggccttcctaacattgcagctcaacaaaacaatcaactttatttattctgttctttaaatatcagaaatattcacctttcttgcaatgaatatttaacttgaagaccttgataacattttagtgtagacctgaaagataattgtgatgagaacattttatttttctgataaactgtctaaatagccctatgtgttgcaagttcatttcttacaacttgaaaatagctgcaacagggtaatttaacacacaccctcctatctctcccattctgtttcaaacatgaaaacctgagaagaagatgaaagattccttttccccctgcaaagtgtcttaacttgcttaatttgcttcctagaattactctttcctggaatttcttgctctgtccaagcaggctactggggctgagtggccgtggatgccgagggtacctagggctagagggggcaggctggctgctggagctcagctgcctcttctccagagggaaatagggtcccttctgcaacctcccctcccttgtgatgtatctccctacaaaacttaacagttacaatttttagcttttacatagcaaaataaaatatttttatcaaatgtttttaacttctgtctgtttcaggttagcctggtttctgcctggctgaagggcacattcttagtgtctcaaacatgtcttgaggcagatttttctttcctgtatggtgatctgcctattgattgtttatttgggttagtatatcaaactttgaaaatatgatttcttaaaatgaatttgtggattatatagggcttccttacaggaccccttttgtgagtagtttcggattctacaaaagctatttttataccctggagttattagttcttgcaaactaagaagtccaatgagagaggtgaagaaatgatagaaaaattcttctgtcatattttctaacttttccctgcagctttcacttctgcctcacacttagaactttctcctccactccagttgttaggtcagaaatgcagtcactttcactctgactgtatgaagtatatttctaatgttgaacaactttctcttttccttattctctctttcatagaagggccccatgcacttttgtgggattgtaataatgcaaacagcagtttgagatggcttgcatccctgttgttgaagatgccacgggcgttcttgggctgagttcatatttccaagacagaaaagctcaaagatgagtttctggcttgtcaacgctcagctgatctacaggcggctacttgtaattccttgaatgcagtgcttgcttgctctggctctggctcccctgctttggaagtaataatccccagtgtctacattttaaaacttaaagatgttaccttgggaaataaataggtagcctcaaaacattagttgctggcatgattattgttatattcttggaaacaatatgttagtaaaagctacagtgctgttttcttcttcggtcactctttggtagaattttattttattttttgtatcttcatgtaagaatttttgtgcaatgtttatgcaatagcagtttaagtgcatttgattatttaaaaaccacgcatgtttagcacatttcactttgtatctaattgtcttagactaatcaattttttggaatagatctttggcatcctgtaccacgggaatcgccatggtatctgttgtgacatgtacgcagactcttttctgataaatgaagccgctcatttaaaaaatgtataggagttaggcagctctggtatgaattctttcccattctttagcttttcacttccttatctgatcaccactttgattattatggagatttggggttcgctgcaaatttgaaagaagggatcacagtaattttcttacagcagttaaagtggaatatttgttacctatttcttcagcagtatgcatggaagtatagttgctcttttaccttggaaagcaaaataagagaaaaaatagccctgaggttttttgtttctccttcttagcaaattcatgtttcttgctgtgcagtaaaatgacattggcttttctcttctatgaaatagttaatcagtgtagcacttttaacatctttcattttctgtagttactgggttcattctcatgaaagaccagtactgccgaagtagaaacagaacagatgactacatgtgcttatcagaatttgaaatgtacagtattatttttcatctaaccgttttactgctagaagtctagcttagagatataatggtgaaggtgcttcaaagatacagataaggatttttattatagtgttgataatcataataagaaaactagaaaaaatcctggtcatctttactaattagtaattcttttttttttttttttttttttggagacagagttttgttcttgttgcccaggctggagtacaatgatgaggtcttggctcactgcaacctccgcctcccgggttcaagtgattctcctgcctcagcctcccaaatagctgggattacaggcacccgccaccaggcccagctaatttttttgtatttttagtaaagacggagtttcaccacgttggccaggctggtcttgaactcctgacctctggtgattctcccacctcagcctcccagagtgttgggattacaggtgtgagccaccacacctggccagtaattcctttattcattcatttttttgagtgttgactagttttgagaccccatgctggatgctagggaatacacagctcggctatcgtggaactttttacactagtggggttgacaaagaacagggtttttttcaagattatttgattaatcaaacaattacacatataaatgtgcccttaaaactatggtaattgctatgaacctgactagaacttgtaagtagaggatttggccagatagggggtttaaggaaggctcttccaaggaagtactcagatcttaaggatgagtaaatattagtaaggagggacggtatatatgaggtaaaaggaagacctctgtagaggccctggggcaggttgaatatggtcaacagaaagtgctaaaagaagtccagtggcgttggagcagtaaaagggtaagcacaatgttaaatgaggctagacaggaggtcagggaacaaattttgcaggacctggtagacaaccttaaaggatttaatctttatactaagagcaatgggaaaatctttgcagggatttaaccaggacatgatcagatctgcatttcaaaaagagcactttagctgtttgtgaggaaaaggttggaggggtcagaatagtttgcagcagactagtaagctcctttagtaattgaggatagagttgatgaccttgtgggctagcgtggtgatggggagatgaagataggagggatattttagggggtaaaaaccaacagaagtgagtgttgcattgaatttggtgctaagtttgtcgggaggagatttcaaggatgatttccagatttctgtcatctacatgaggacagatggtggtgccacacacaggatgaagagggctggaataggatcagtttttaagggaaagagtatgggtcctagtttggacaagcttagtttgaggtgatgataaataaattatgattgagacacatagcagaaaatgatgtagccttaaaatgtgctatcatgtaaacatgttcaagatatattctaagtgaaaaaatgtgatcatattatgcaaaaaagagcacggtatgtgtttttgtgtgtacacacatagaatatggaaagacacgaggacgattaagggtagatacgctaggcagtgacattggtgggatggcaacagggatatgagggagaacatttatattttgtaccctcctggttatactattggaaagtatagtacaatgagaatgtatggatttttataattaaggaaattaataacaatttaaagcaaacatacaatataagaatatttcttttttagaggttacttagttggaaagagcatgtgagcattgttatattttttattgtgaacagaaatttttcctgcagctttacgtccctaacccaatagctcatacacttggctttttaatccttttccactagattgcactattacactagattttatagtgcctgtatactgttttgtattctgcttttcactaattttattattttcacaatagtccaacattgtgcaagtgaggacattaaattgtaatggtgcatataactgttgcttatatgcattgtttttgttaaagtttccactggtgttcctgtttcatctgagatatatagttctgttcccatgagtggaaacccagacttatcttctcaggctatttgagcaaaggagcagaaaataccaagagaagtgagtaaccttctcttctccattaactattctgtcaaaccaaaacttcttatattgaacgtttaactttccactcaattttgatattgtgtttaatgcagttgagtcttgctcacacataactttttgcttttgctgcattgcttcctctgaataaatatctaaaagcttatgagagtcagaatataaatatcgatgtaattcatttcttactacatcaggcttccctcaaaagggttaaactgcagccctcaacttggctaagtgcagagaatgaggattgactgagatgccatctttttagtccttggacaacgagtgtagtggagtttggtatggctgtcgcctcttctgagtagcctctacagttgactctactatatatttctatagaatatcatttttcatatgtgtcatgattgtggaaaaaaatgagagtgcagtattattatataatgccacctgtagtgatgatagttttttttcatttgaagatatatttttaaaaacgattgtatttaaagaaatccaaaattttcttcaaattagttgaagagtaaatgtaataatagttttcatttttgggggacatcattatatgctaggcattcttctaaagttcttaaatacattatgtcatttaatactcaacagtatgtcactgatatgggtactattctattccagatgaggcacagaaacattgagtagcttgcccaatggacaaaaattaggatttgaacccagacactgtctgtaaagactgatgttaaacactacctttctgtactacagttttatttcactctaaagtctcttatatctaatttttttagcttcttctggcattcttcatttaaagccttgctgtaacatttcttttaggattatcttttcccaactcctttcagaggttggggtaaacagtcctcctcagtaaagccatttttttccccataggttccaaaacttaaagctttcttctttcaacaaattgtttttgttcttgttttggtgcccatagtgcatgagattaatttccactgcacagtagtagcatagtaatggtgatgggaactttggctttatatatgaaaaaatatatataaataaaaatgtgtatatcattttgtgtaagtacattctttgactgcacaacaaaatcacctaacaatgcatttctcaaaaagtatctccattattaagcaatgcatgactgtatttgggggtagtattgatgtgttcatgacatagactttgcagtcaaccacgaaatgggttaaaaattcaactctgccacttagtaaacataagacctggggtgagttaacataattttcttaaacttggtagtctcattgtaaaatagagtgaatactgcctacttaacatagtcattgtaaggattacattagttaatatgtgtacaacccttggtgtagtatccagcacttagtatttaagacattgtagctaaagaaaagtaatggccaacttacattttttagagagaaaaatgtaaaaataatgttttgatgtaggaaacaattttaaaagaaatgaggagaattgcataaaagaagggaagagaaaaatgtagagggtcagggagcagcgtaacaacttggatggggatggtaagagaagggaagggatgccggacacgtgagctatataaccaacttctgaaaacaaagtctttcatcccccttacagtggaatatgaaagagacaaatgaagtagtggacagagaaagacttgacagtttgcttttaaggtgagtatgataatcagattaaatttcatttggcatatccggctgtttacttggacagtgatgtctgaataagttattatttattatttcccttccttgatattctgattagctcatcagcaatcagtcactattcacagctcttcaattacttttattaaatagcaatcctctcctcccccagtcagcaaattattcaggtttgggaaacagtaatatctcttcagagagtgcttgccccaggccagatgaaatgtagtcatgccgctacaagactcaaaatgaatcatggaatcttaagacaaactttaactgtcatatggtttctagggaaggtgaaggcatgccagccacctttggattaatttaggctttgatgatttagaagggggaacattgaaaagatgattaaattatgtacagtgatatcctggctaattgtgtgaatgccttcttagcttgggctttgtaaatgcaagatgcatatgatgttttgtttttgtgtttatgaactagagtaaaactcacacccagatataattgtaatgtagattaccatgaacctggtgagcacagtggcgttctcttccttttaagattcctgaggatagtccagtgtctttggaggatgtccaagaaccagtctctacaaggttgacatatctttacacattagatttaatcttgaaaagttgtaggtaggatacatattttaaatattgagtcatatttttccgtcctagagaaatccattctcacataaaaaaatgcattggtccttttctaatgaaaattaaactttaaaatactagcctttttcaatgagtattctgtacttgtcaatgtacagaatacaatacttttctatacaagaagttagtcaagtggatccatgatattggacacacaattaaaaataaatagttatttccctattattaaagtttctccctcaatatgtgggacttggtttaagcacatcattcgtggcatcgtgtcttgcctttagtgatattgcctggggagtagagccataaaacattgtccttttattgggatttattggacttcagtcttctgtggtcaaagtaggacttcatctggatcaatacaaacttttaaaaaatgaatgtgttcaaaagcagtgctggccttgaaatacagcaatatctgtgtgttgtgtttaaactattctaccctgcctctctgtttaaacaattgagacaccaattcaatttgctttttgaatcctgtaaaagccaactagactgcccttatgcaggacctggaaagtatgagcaatgatgcattgattcactagccaaggacatgtagtggtgttaaatcttatgctgggttagtaggattctaaaagcaagagtgtaagaaaaaattccatagacctaaaattatcctagtaaatcctttaaatagcccataaggtataatatgtgtaattttgtatataaaactctgaacaataattcttatgcacaacatagtctgagaaccactgagctagaataaaggaaggaacaaaagagaagctgcctgggcactcaccccattctttctttatggtaactacccagttcatggagaaatggagagttctatagagtgtctgcttgcctgcaggatttacttcattatgctttaagattaagcccctataatcttcagacacattaatagatgatttggttttgtaaggattgaattagacagtatatgtgaaagtaccttgctcaggagctggtgatgggaagcagttaaatctaaatgttgcttgtcatatccacaaatacattgttctttggaacattgtagagaagaatttggccacctgtttcttgtccttctagttgggatattccactatccagcaaggtcttgcatgtttttacaaattggttgtacctgtaaatcagttggaggttggaatgggtagggttttcaggtaatagtttatatttctttgggttctgtaatggctcctctgtcttctagagttcacagttttgtatgtgaattacctgacggaattgtgtaacccatctacctagactctccatggtggagtcatgaatatgtgttttagaattttttactatgtatattttgggggtacatgtgaatatgtattttgggggagctgcctacgtgcttcctatgtaaccagcatgttgcttttggaacatagccatcaggaaaaaccctgggggtggagtattttgccacaagagactattagcatttctgatcctgttttagcttaaattattgggaaatgcctcctgtattattcatctggatttaaaaatacataacttccgttattaaataagccatttattagagaaattcataagattggtcatttagtagataaaattaatattcttaatttgacatatattttaaattgaatacaaattcagtagcttattttggggggtgctgtggattttgatttgtactcctaggtgtcactgacatgatcacctgaggttttgtttgtttttaataacctgggtttaacaactttttaaaattttaattatggatatgtaatagttgtacatatataaagggtgcctgtgacattttgatacaagcatacaatgtgtcatgattaaatcggtagcctcggttttagccggttgcagtggtcccagcagtggttgtagtcctagctacttgggaagctgaggtaggatgattgattacttgagcccaggagttctagtccagcctgggcaacatagtggaccccatctctaaaaacactactactactactaataataataataatctgggttttgaattgtattcttttctcattttgaagggttggatttttcataatttagcttaagttcagatttttactgaaaattcagtttgaaaaggaaatatgccttttacttctgatttattaaggtggggagctcttttaaagttaagtttgctatactccactaactgttgctgtcttcactttcctttccttttctcatgcccaaagtattttccttacttccacatgcttggtcctacccattctaccttttcttggattgtatcttatcagttatgctcctgttctttatccttaatctcttccccccttacatcttttcctctatttagatacaaaatatgtcatccctactaaaataaccaaccttctgtccaccttgctactcttcagtctatcatttgatctttttgcttccctattctgaccagtgttcttgaaagattaactgtaatttctgcatctacatcttgaccttttgcagtttggcttctactctcaccactttatcagaactccactttcaaggagtcaccagtaacttctcacttttcaaatctagcagtcttttctaagctctcatcctctttgacctttttgcagtaagtgaggatgttgatcacactctccttcttgacatctctcttctgttggcttatgttactcttcagacttcatttttcaacctctgtgactgcttctctctttctttgctgaatcatcctctgcttttgatatgttaatgtatttattaacatgttgttttgcttttgctgtccctcttaccttttgagcattctttcttactgcatttcaggtccagaagttaggacaggccgggtgcagtggcccacacctgtaatcccagcactttggcaggccgaggtaggcggatcacctgaggcctggagttcgagaccagcctgcccaacatagtgaaaccccatctctaccaaaaatacaaaaattagccaggcatggtggtgcatgcctgtagtcccagctactccagaggttgaggctggagaatctcttgaacccaggaggcggaggttgcagtgagccgagatcacgccactgcacaccagactgggcaacagagtgagactccatctcaaaaaaacaaaaacaaaaaacaaacaaaacaaacacacagaagctaggacaaatcccatgggcagttcttgggctgagctgaatccacaaggaacttacctaaagtagcccaagggagaataggatggagagccaatattgtaatcagaaaaaactggtgcccaaatctatcatgtctaaaatgtaagggtgaaaaatcagagagtagacagcagattggcagtttggatggtgaaaaacaggatcaataagaacaggaacatatatttgctccagatcactttctatgtaagagcctgatgtatgtgttaccagggacatggtatctttaaggaatcacactagggctttggcttcaataatcatttctctggagaagaactttaaatctgtatgtgaagccccattacattatcttcttcttctcagatagtttcacctagatgtccaactagtaccctaagtttaacatatcctgaatcaaattaatcatctttctcttgaaactgacttttctgaggttcctaaagtattgctattctatgtcattctagataaaaaattcaaaggcgtctttgattctccttttatccctgcacctagcagtttgaaaaagtattgtcagtattatctccattatctccatgtcagtattatctccattacaaggtgtcttgtaattggcaccactttttgtttccttgtgcttcaccctgactgctatctgacactcttgcagtagcccctacttagtattccttaacccctatgctagtcattgctgccagtgtgaggaaaattcaactgtgaatttaaaaggtactttaaacttaacaacattcctagccagagataattgcttccccattagtgttcttatagcacgtatgctttctaccatttgtgtgtataattagtatgatttattatatatgtgtgtgtgtatatatgtgtatgtatgtatatgtatatgtacatgaattgccaatccccatagattgtaagctccttcaggggcaggaactatgccttggttgtcttgtatccccacatactccttgtattgacatacaacaaatatttgctgactagaattaaacagttagctgggctggaaggaatctgatcccagttaattgtaggtgatctgtgacagtcattttaaaaaatcatgacattaatttcatttttttgtacatttgttttattctgaaaagcttttttattaagctgtgctgatggcataaatggaacagttaactggaagaccagacaggccaacaattttattatcagcagaaaaatggctgctgggatgaaagatggtgagtttaggttgtaaatctaaatccctttgggggagccaattaaatgtctgcttccaatagtctcttcccttttttagtcatgtgtggctttttgttgttgttgttagtaagtctgaaaaactaaaattttgttttcctaatcttctaaaacttctgttttagatcccgtgtgttcttattccattatttttcaagtcctcttccttggctgtagctttgccctttttaaagaaaaactaaaaaccattcctatgtttttaacttaccttttatccagtcactagcttgccacttataaaaattgtcctactgtggttactataacaagttatttataatactgaaaaacgtacatttaacatgtatcattttaaatagcagtatgtaaccttggaaaaactcatattttggttaattttggatgattcttgttgcaaaaccaaattgatatgttttgctattacttagtggcacttgttttctattggaaagatgacttgacctgtaaatgattgattgatccttctaaatttttcttcagtatctataaatgtgaccatcagcaatattccaggacctttgaaataacgcatttcattatggagaaaaggcattacttaacagtcaaaatattagttgttttcaaaataccagttaccattatgaacttgcacttaatatttcttttttttttttttggctttatgatccttcacacagaatattaactacatgtgttcatgaacctcagcagaatagtagtttctctaacttcggagcaaccaaaatgtctataaaaataatagtaatattaaaatgttttgaaaagaacagtaattttatgtgataagatgataatgccagatgaaacctgctgggtacttgtaggattgattcctggcttacttcattttcttcatacatctctgaagttgggcatcactaacatttttatagctggaaccgaattattcttcagctggacacttctacccccagatctctttcacaatgggacaaagtttcccaacatctattttctcaagtgactttgaaacaaacctacaaatacctgtgtatttctaaggaattttccttgctaagatctgtaagaaaacatagagtttcatacaaataacttctcatgaaaagatcacaaaaatttgttttaaaaagcactagatgcacttgttccaggacacaggcccatgatctcatagttcttttccccacattctctttagatattgccatcagattctcccaagttccttcaagggaatcacccctgattacacccttatctggctggtttcttgagcaagctgagggccatcggcttctttgacacagtcactcttccttttttctaatctattttctggttatgggtccccggtgtccttcactgttgcagtctgcactgcacttctgctctgtcatctccaaaggacttgggacatgccctggttccttgtgcctcaccgaggatctctgaagactcttcctctggacttcacatcatttttcactagattgcagtcatcccttttcttcagtctttcctctttagctttgatccctggaacctctgttctctctgagcatgcctctctctcctcttgctgtttgatttccaaaaacaaaaaaatactctctcaacagctgctgcactcagcagagtcatctattatggtgctgttctcagggaaatgcatttcaagaccttgacatatagtgtcatctagaatctctaagagacgccagtctcttcctgtttcaaacttcatactgtcattgaacctcacactgattttctccttgggacccaagagataactagagttttcagaatagaaatgatccctccatcttgaatctactgaggtaaagagtttcgattatcacattttcttatttcttcagtttagcttgatctcatcctttagattatttttctttcttctcatcctatttatatcctatcattatagttctgaattatcaagataccttatacagggagtaagttttgtcaactgtatgaggagaattgtttcatcacttttaaaattataataacaaatactagtaacttgtatggcaaggccattttaaatgctgtctcagatatagaatgttctttgagatgttcttgaccatgaatcccagtcatctcttttagaaaatttcaagagagcacaaaagatgataggatcatttatatataaaataaatttgacaaatatatgttttgtgtagctttttttttttttttgagatggagtttcgctcttgttgcctaggctggagtgcaatggtgtgatctcagctcactgcaacttcctcctcccgggttcaagtgattctcctgcctcctgagtagctgggattataggcacccaccaccacgccctgctaattttttgtatttttagtagagatggggtttcaccatgttggccaggctggtcttgaactcctgacctcaggtgatctgcccgccttgccctcccaatgtgctgggattataggcgtgagctgccaggcccagcaaagaatattccaattcttagctaaagcggtaggatggtacttcttctgtaaataggattctaaggaatttgaatgccttaacttttgacattctacctcagcacccagtaagtggttacaaaagcaataaggaatactccagatatggactatggaatctcttctttttttccctggaatgggagtaggggacctacttgagcaagctgagggccatcagcttctttgacacacccactcttccttttttctattttctagttatgggtcctataggcttgaagcagtcacttagtccctctacgttcaattttgttatctataaaatggactgaactctccaagagagcaaatgcatgcaaactctgattgttagtaactgtcaggaatcctgggttaagtaggaggcagaggccatatgcaggtaggaaataatgttatgatctgtctcttaataaagaaatatatttggcatgcccagacaggatgacatataaagctcttttcaatgtagcatgctatgacactaagcttattgatcaccaattagcaatggtttgcaacctttttccgattgacatttaaaaaacacacacatgaaatcacacaataatcaagatgtttagttccactttggaaaaactgaaagtaagtggttttagttggggaaaatatcatgaagaaactcttctgcttttttgtagaagattcaagtaatggtttcctctcctacttcatgtaaagaaaagtggccatatctcctagagaaatgaagtttacaaagacactgtaatgccttcttagtgatggattccacagccaaggcatggactatctgtgactgaaaaaaaaacaatagctggccaatgccagatgaatggcctgcagtactttgatgttgagtgaattaaaggtgaagggcagactgctgagaaaagcttttgattcaaagccaagattcataaagttgtattgataaaacacaaggtaaatcttagtgagaaaaacaaaaacaaaaacaggttgtctaactggctggatattgatctctcttaaaatatttctctacagcaattacctggcttaataattaaatttcaatttgactgtagtaacaacatgttaaaaaaataaattagaaaggaatccataaatgtatcaggctatgcaaactttgaaatgagttcttttgatgcagagacagcaagtgagatttgcctcttgttcaattcctatgtatacagggactctgaatctcataaagagtttttagatgttaaaactataaaatatgagacgagaagtattattttttgtcagtacttaacatttttaattatcagggatgatgatacctagttgcttaggcaacaatttattttaaaagatacagcagataggtggctgtttagtactctctttgtatcctcaacataccttaaaaccttcttaatcattcttatccaaaacatttttttagataatacttactgttaaggcaatacttaaactaagttcaaattacttgaacaactaatttcctagctgtgaaatatatactatcatatttaaataatttgaacttagttaaaacacctttgcgatgcttcccaatgaacagcttccatcttcaaactcttcatgtgagaaacaaattgataaaattgaaatgcttttagaaatagactttaattgcttattaataagttacttattaattatattgtgttatagtatcttaggctgatttagctataactaagggcaacatatcatttaatccatagatctcttcgtttaaattgtgcagtgtatttcccacatatcgaatatgtaagtgttttatacaatgcattcaatccattttttatttgacagttcacagttatgtaatatatgggttgaattaagactttcaattgtacacctatttatttgtgaatgtattttataacagagtttctgctgccatcaccttaagtaatggctctctctcaagtatagtaagatcatctattcagaagtgtactgcgtcaactaagaactaggaaatacgccacaaaagagtctttcggcagccaaaatagatgctgcgaatgcaggctcctgtcttttacatctagcagagccctatgtgtgttaaacagcacgcatttgtttttacttcaatgtgcaaccctgcctcatttggtagtctggtttctaaacctgcagccgattaataacagcaaattagaggggatagagaagctgctatgggaaacatactgatagcaatgagaaatgacagctgacaacttgtctacaaaagagaaaacaaaatctgtaaaacacacaaccttaaaaagcattagcagactgggacccacagtgtgatcggtaaatgacaaggcaaccaaacagtccatacgggtatcaccgtataatagagcagagtgcaacaattgatgtacaaaatgatgatcttataccatcatgaaaaagaatcaactgcagagtacttcagaaacatcagctctgtggaacaattcatttcatgtggttctggtaaactgagattttattagatccttgtaaaccttaaaaattagaaaatgatgatataaatggacattttaaagtgattagtttattaataaagcatctataagagagacctaaacatactgggtacctaatcaaagtcacccggacataaatattgacaatactttatgactttcttctcaaagatttcagaagacagatggctttaagatttaaaactagctcaaacttgcagggtcttatactcagttgttattttatctttatagccatgtaattgttcttggtgatgcagaaaaagaactggcaagtgttctctggacatttttgtagtgaaggggctgtgtgtgtgcctgtgcttatgcacatgccattaagaataatcattgtgagaattgtgaagttatatgctgtggattcattggcagcgtaccaccatagtactttcaaaatttaatgtttactaaatacattcaaacttgctttgaaggtaattgtaataagcacacgtgcacacccatatattttcattatggagagagagtttccactggactattagtaaaggaaaacaagacattgtttagctagcatgagctccctttttttttgctactgctttcgtggtctgttatttgattctgggctctatgctgtcacataatatagagttgttgaaatggctgcagattctataccctgtgaatgaaacatacagataacagttttgtgaacaaggttttggtaacatggtgatgagataaattggatctatgtttagggagagcgagataatgatcccagctacttgcttacataaccctttggctctctctactcagatatgtaattattacttaaaaaattctgttccttatgactacctgtcttcagaagtttttaatctttgtaaatctagctatgcttgctatttggagatgatatttttgacctcttgcgggttggacttttggtctcattgtttttcccattaatagtgatagaattgcatggatttaaccacccatagttttccagtttcatttatatctagtggcgtatgtttgcagaggtaatggatttgcagccgtagaagattgcaaaaccatgcgatacacagagaggccagaccctgttaccttggcttgattagcatggcactgtacacatgtatatttcagagattattagatcttagtgttgtggattcttagagtgtttaaatttgattttcaagacttgctcttaaggaaaacaacatgctttaagcttatggtttgtgagtgctgcctgggcatatgtgactgcaacatgtgttaactgttagtaatagcctctgtaggtgttggagtggaccccatcagctttatttatatagctcacgtttagaacaagaacctatagcttcgaattctctgtgtcatttgttgtttttgaaaggaagcataggtgtaaatactgcctaaattgcctccgttgcagagctatttgttttgcaagtaacaaatgcgaaagggaaaggcaaagggcactcctctaaaatgttgtgtgggtgcctgtaatttaaactgatgctacagaaaggaagtattatttttacaaacaaaacatagtggcttagtcattttccatttctagatgatgaatgtgtcatacatctgtatcatgtttttctcaaagtgaatggcatactatacttaaagtgaagcagcctttactgtggagttgccaaggtaactgaccagcaagtatgcagttcagcagattgctgaaaggcaattgagtacacatgaataaagaaatgtgcttgtcatcttcaaacccaggagggccatggtagattgtgtcttggctctgtagaacgcagaaatgttttttataaaagcagaaactgagatgttctatgcaagttcttgaagtgagatgatatggagtggcaggtaccctttctttaatggttccacttcaggacctgtggagggcaatgtagaaaatggaatcatttcagtattatttaatatgaacaacctttcattttgctttgttagctagcttttaccaccttatagcagcaaatactaagggagactattagtttataatgtcaatgaaggatgataatctacagaatgctatccctctaagtattatatatatttagttcactaataggaaacttgtgtttacctctgccgtactttgtattagaatgtactcatccattccataggcattgatacaattattcaaatataccagactctcttctagctgccgagaaaatagcaaggtaaataaaacttagtgctgtacttcaaggtatttttaatctctagaaagaatgaattagataattagataaactacaaagagattcctttagattatttgtaatgttctctgctttggatgtagggttgtgatcctgaatttaaatactttgatatacagagtgaaatgactttttagcaggagttcaaaactccctattttaactcttcttttcttcccagttttgcctccccctaccttaaatttaccccaggatccagcattactgacttaattcccttccccgaaaggcccccacagtatccagtattgtatcttgcacatatgttcactgtgaaatgctgaaattccacatctctgagtttcagaatcctactactgtagtattttaagagccatattgaattccacttcttccataaatcttttctgaatctgtccaaccttaattgctcctcccatatttccaggtgttgccaaagcagttttacctctgggataatacctagttaggtggatgttggtctcccataccagatggtgaactcctggaaagcagtggcagggtctctttcatcttcatattccccatagcacctcacattcagggtacattgtggtatcaaactggtaaaaaaaaaaaagtataaaattctcatctttactatttttctgtgattcattcattcttgtttcgcggaatgggattattcctgctggtaagtacattgttcttgagtagaagttgggtactgtaaatgccacaggggaagatcacttatgaatactagtacaaaacaaatcaggaaagaatagatctctctgcatacctagtttaaacataacttgtagcttccttccctctgttacacagcctttgaagttatgtttttagtagtaaatctgtagatacgtgaagctacaagtcaaatattttagctcagttcccccttttctggcagccatccaccgaactgcagggacaagttttcacagataaagaaacattttgtgggagtttttatttttgtgctgaaaaatgtagttcagtgatcttgctatccaaggcttttagtaagttgtgagcttggagtgagcagccttgtggttcataaggttaattaccatatttacaaatccattaatgacttaaaagaaagaactggcctgatagggtttatctctctaaaaattgcagccactagccaatcaggaatatagaaacccaaaagagatcgtagaagtgacaagagtaacggcaataatgtgttagtggagaagatgctatcagagcaaaaacaataagtggaaactaatcaaaacaattggtcattttaatgtactcatatcatatgtcttaagtaactggtaaatcatgaaatttgcttatttcacttaaattattttgcctgaattttattatgtaattgttattgcttatttaggatgcagcataatataatagattatattgtttgaattattaaatatcaagatcagagaaaattgaataaatcatttctacaagagatgcgaggaatgaatacccagaaaaagtatccaatgcatttttataagtatacgtaaaaaccgcattacatgtattgatagtgttatatagtctgacatgctttgtctagaaaacaattagtatagtatggattcttaccacttaaaaattactctgtactttgctttaaaaaaaaggaaagaagaaaaaaatctgtagcaattatgtagctggtcagttctcatgatgtattttgttggtaataacttcaagtaaaaagaaattaccaaaaagatattatggatagcttcattatttgataacagtctaaaatattaaatgtgcataattttgtctatgtagtgtttgaaaaggctgtaaacacaaatcaaaagaattttttcccattttgtcctgaaatcacttccatttaaaacaaattgttattaacagtttccttgcatgttgcttcagtttttccagaaatgtctacatagtgagacccctctttataaacagcgtaagctgaattatcaagggcgtatctcattatttgtctttctgtcacttatctttcctctttgttttcagtgtacagtattttctccaaggtacactccgatcggaatgtatacccatcagcaggtgtcctctttgttcatgttttggaaagagaatattttaagggggaatttccaccttacccaaaacctggtatgttctttgtgaggaaaaaaaagcagttaacgtactaaattttttgtttaatttgcataatatagacatatatgataaaatatcattaacattatttcaaatggtctaaatatgtgataaattgttgtaggatatttctcatttacagattagaaatttaattacagacaaaaataatttatttttgaatgttaaggaaagcatatttctggattctcagtcttgagttttatgtctctgacaagtgatctacctatattcacatggaaataattatagctgtaaacttatgattttctatattaagacctagattctcacatagtacattgatttttggaaaactatacatatgttgtagaggagaatgaaaaatggcattaggtaagagcttttaaaaagcttttacaataggagataattttatataactccataataatattatggagattaatttttccttttaagtgataccaattatgaagtcttacttaattcactattggtttaaatatgttattttgagtgatcataaatgccatcaagttaatgaagatatacaaagaatagcaagagaaaacatatcattacagctcttccttaagcagcaaataaaagtgaattttctgaaaattatattgtataagaatgtttttagcattagaattgatataactattctttttgaagattatatgatgaatactgtacctgaaaactcttccacaatatagttagccatgttcctaatagtattcaagaagatgaaatacggcttgtaaagcatttaacacagggccaggatgtgctaataaatgatgctgttattattgcttgtgattaataaatgctgtcgttagtacagttgttatggatttgtaacgtctttttcatcctatcctccagtgttttaaaattacattatttttgttttgatgagacttttataattttggaatatctttcatactcatatgatagtgtccagagtttcatgaacggaatatttcgcaaaagaatgagtacattagcatgattagggaattctcctgaaagatagttgtctcactggcagaactatatcactgttaggtgaccaaaaatatatttccaagaaaattgtatgaatctgctttctttgttgcatcagattttgaaacaaattaaacaaccaaaaggattttttttaacgtggtgccctaatttaaattcccagatgggttttgtatgtgtgtatttagttggctacaaatgtaagaaaaaaattttagacagaatgttttgattgaaactaccaaagcaacatgtgtgaaaataactgtcttatgtcttaattctctgtttcttatctaggcgagattagtaatgatcccataacatttaatacaaatttaatgggttacccagaccgacctggatggcttcgatatatccaaaggacaccatatagtgatggagtcctatatgggtccccaacagctgaaaatgtggggaagccaacaatcattgaggtaatttacacctagaaagagcaaaactatacatatatgtgtgtgtgtgtgtgtgtgtgtgtgtattgtaatttgagttttaagtgttgaaactaaagttacctgatggtggtttttaatattttgtgcatggaaacacagtagataacatttggaaatgtgccattcttctctgtttataaagtttttgtttcagcttttatattaaaaatgacagtctaaatttgtgaaaaaaatatgaccttaaaagagattattataatatgaattctatttgagaaaataattgtagacttgatagacttatttgctctgtattttgaattcaagttttatgttcattgaaatatagccatcaacagacatatacccctgctacttgccaagcattgtgataggtgcttagggatagaatgataaataataggtgaatcttgcccagtcttcttacaattcaggggttggaggactgggatgtaaacaaatacttagccaacactgtaataactgctatagtaagaaggtgctgtttgatgcagagttgtaagaaggtaaagaatttacttgacaaagtagaaggaaggccatcttgggcggaggaaacaacacatcaaaatcttagaggtataagaaaagtcacatggtctcagagaactataagtgtggctggaataggatgtaccctagtaggtaaatgatgggaatgggaggcgttgatgctggtaggggcagatctttgagggctctgtaagccatcctggtacgtttagcctttattctagaagtgatggtgatgttaccattcatcaggtcctcaccagcacctagcattgtagctgggagatactagaaattaacaacaacaaaacaactgttacattgaatctttagtaggaattaatacaatactttaaaaaaatgaatggatgtataaactaaaagaatacagcctttcagaggattacatactatgaatttttctccaaagttttagtcagctgtgtactgtggatgtgagcttccacattggccaattcagttggaattgaagtttgtattaactgttcagtgatttctatctataaatcatattccttaaggcagtgtaactataagatagacaggtacttagaagaagcatgttagtttgagctattgtcaaattaatttttttaaatattcagtaaaagttataaaagaaatatataaatgcaattcaccacattattagattaaagaaggaaaaacagcataattgtcatgatagttatggaaaaagtgtttattaaaatttactacctattcttgataagaaaaaatagctcttggcaaactaggaatagaagtgaagttccttaatttgccagtttttaccaaaagtaatagcaaacatcattcttcatagtaaaatgttagagaaatttcatttaaattcaggaacaaaacaagaatgactctgtctgataaatctattacagaatgtattggaggtcccagccagtacagtaaagaaagaaaaagaaattaaatccctaaggatttaaaaagaagaaatggaaaccatcaatgatataaatggtctgtagactattaagaatcttaagaaaggctagcagtgaactgtgagatcattataaattactgttatatttctacacatgaatagcatgtattgagaaaatacacgtttttaaaaataccattgttaatagcaacaaaaatgttgaggtactaggaataaatctaacagaatatatgccaggtctcaagtctaggtagattagggattacatgtaaaatgcaaatttttaaacaattatattaaaatgtagaaaaatctctttgacctatggatagggaaggatttgttaagtaagacctaaatatttttaagagaaaaaatttatcaatttcactatatgaaatttgtgaatgtctgtttatcaaccattaaaccagagcatgatttaaaaagacaacccacaaactgggagaagatattttcaacacatatagctgactaagagtatctaaaataaaaacgaaatcctgcaatttaataagaaacagatatttcactaaagaggagacacaaacgccaataaacttaagtagcttgctcttatgggtaatgaggaatattcagatggagatcacaatgaaaattttgccatcagtaaaatgcattgcaggtggatgtgggagttggcatcactactttggaaagcagtactgaatatctcatacagttgagtatccctgtaccttattatctggcagtcctacttctagcaatatgccccaaagaagtacttgcaaatgccctcctggaggcaggtacaatcatgctcatcaagcaacatttgtatagcacaacactggaaagccacaaaacaatagagacccaaaagtctatcagcaagagaatatattaatcttggtgtattcacacagtgaatgttcagagcaatagtgaacttaagcttgcccagcaatatggataagtgttttaaacacaatgttcaattaaaaaaaagtactagaagaccacctgtaatagtttgccattttggtagagctcaaaaacaggcaaactaaaccatatgctttaagcattcatgcaattataataaaactgtattttaaatgaatggatcgttaaacaccaaatccagaatgactacttctggttggggagaggtaagggcttaggctaggagagaaacacatgtactgggatggtttcataagagttcattgtgagtgcattcattatatactttatgactaacatactgtgttatgaatatgtataaaaatatagtaaaaagataaaaaaaagaaagtttaccatatctttcatataatatagtgacttatctgtaaatagctcattttcacattcatttatagtaacaggtatagtattttaaaatattctatttagtcaagaatttttgtatcttaaatatataatatttaatcatataagtctactaattcattcagtagatttttatctgaaatatttagattttaagtatctaaaatagatcagctctgttttagaaattggggaatcaaaaataaagtatgcacacgtagacactcacattttcttctgctttgacggtcttcacatcatcataataagtaaaatctgaggatattacagcagttaaatgtctcattggaagtgatagaaggactacattctgttatagctgttaaaattaagcatcaactataaaatcaggtaataaaattcttcctcctgatatgaaatattcttcactcccttcaatagtctgcattatttaaaaataaagacatttattggaatttatgaaacttataataatgaaatttgtgatgattaagggaaggctacccataaaaatattgctattaatttgaaaaaatctattttttttctaagctgaagcttcatgatattgtaacaaatagtagaggatcatactttttattgaaaatgtgattaaattttttgcagggtaaacttttcaaatgattaagtttctcaaacaaaatctattttgcattttttgtatgtttcatttgagcaaaagttcctagtttgtttaatggctagtcttaattttaatgtccggtgtgaaattaattgatcatgtgtcccaacagataacagcaaggaaataattaaatatgatggaaatttggcaaatcctggagagagaggttcttttaactttatggagtaatatgcctttcaaaatatataccttttaaacattgttaaaagtttaaaattatttatttcaaaattcttactgttctaactcagtattttcaatgactgcaacttattttttgacacatgtaatgtataaaaatctttgatatttgttttaaaatgcacaagatatttatttttagttgaagtcagttttatcctactcttttgtctcagtgtcacctccagctgcaatcattgccagaaggttagtgctgggattctaagattttgacacaatcatttgtttttttttttttttttgaggtactgcagatgtgtccgaatgatttaatatctgttataaagttaaataggccttaagttttgaagccatatcctgttgttggcctttgctttgtgtgttgtttgcactggctgtttctgaattgactttgatgtaagtctattggctctgcaaatgtttactaatatttgcccgtatgaagggattgatttgtgtttttgagcatgttccataagcttcatggactatgatccttactactttactcccatcgtaagtgagatatgatttccaaagggttatttatgacattttttgactgattggggtgcagtttagtactaaatgcaaaaaaacacaaagatatgcttgttttaaagtgtacttttcattataattcttaaactccatttaaaagtacaaaaattattgttttttttttgaaatcttagaacatcactggtaagtaattcataatggttaatccatttactaatgatgcatctgcattgctaccagtgcttaatggccttctatgaaagagtctttctgattttaactttttgtttcagtatattaaatagacctgactaattatttattttcccataatattgctaaaagctctgagttctcattgcccagagaaggaatattttgtaagtatatcaacaaataatgaaaatggaaagaatgacaatttgttttcattttaatccttaatgaatttcattttacaaagaacatttcacttctttaatatggttttccttttataatagataactgcctacaacaggcgcacctttgagactgcaaggcataatttgataattaatataatgtctgcagaaggtaggtatgaaaatatgttgatcatttcttatttataagaagtatttcattatgttttataactacataaaatatagtcaagaattttaaaatgccacatacctaatataactgatgaaataataagatatagaaaagaaaactaagcaatatgtaatttattatgaaatattatggtgtgttatgatggtgaaaactcagataggaagccaaacagatagtcctcttatttctctaagcctttttcattaccttaaaatgggactaacagtagcatttctcttataagtgtggggtaaggattcacaagttaaggctggagcactgcactccagcctagctgatagggtgagagcctgtctcaaaaaaaataattactaactagttttattattttatttaaaaatttactgtaggtaatagtctaagtatatgtgataatatagggtttctggaaaacaaataaaccataacttagggtacaatttccttcctaaatagtttatagtgtattagtaatttgtagagtctttcagcaatttaaagtttcatatgctcaaattgtaagtgatttcctaagaattttgaaggttagggataaggaagtattctcagaattacactctcaaatattttaatcaattgggaaaatatcaccaaatactttgtagttaattttctttttttttttttttgagatggagtcttgctctcgtcacccaggctggagtgcaatggcaccatctcggctaactgcaacctccgcctcctgggttcaggtgattctcctgcctcagcctcccgagtaggtgggattataggcacctgccaccacacccggctaattttttgtatttttagtagagatggggtttcaccatgttggccaggctggtctcaaactccggacttcatgtgatccacctgccttggccttccaaagtgctgggattacaggcacgaaccaccacacctggcctgtagttgaattgtataaatcatggaatgatcctccctatgttagatatcatttatgagaatgacaggagggaaactgatccagaattttttccctctaaaaacaagaaaacaattgtgcattcttgataggggaatttttgcttctatttactagtgcaactaaaaacaaatgagcaaacaccaaacattttatcagaacctactaatttagcattaatgataatgcagtcaaggctgggttaaaaattacttttacacgatatgaaagaaggaatttctgtaaaattaaacgtgtatggagagattgcttgaacacttaaacccccttaagtgaatgttttcccccaggtgtttaccggtatcaattgtagacaacaaatgtgcaagtttaaaatttaaaatgaccttcatatatgaaaagcaagtccaagtgccagttctgtgggcctggactgaagactccctgtccactctgccactccccaaaggcttttggtaggtatttatgtttggatcagggagatttttgttcttgactacagtggtgattggatgcttacatgctgtctaagctggccctgtagaattggaatacacttaatgagcagaataattgaaaagtttccttcctccttaggaattcatcattacagttataaagttatactacagtggccttggaccatctcacctcaccattatgctctcaaagggactcgaaactctgtcaggtgtgagagtccctacaaattgaaagcttgttctatagtttgaacttcttccttctcaaatctagtctcagtgctgtagatacagattactcaaggcatctcaatagatgttgttgttgacgtatgaggacctgtggtcaagtagatactaatggaagactgctagacaactgtaggattgaaaattggcagcagggctctttgtctaaataacgggtttggaaggtgtgctagtgagaaggagtagtagacaggttttagaagcctccacctttactccaggcagtgcttgttcctctgctttttgtgtagggttagtggcccaaacctatttgaaccactgcactaaagtccatgcatttgtccttgctggtctagacagaaatgtatatgtgcagtaggatgtacatgtttgagcatggcctacactcatgttatttatcccagattagatttaggaaaagaaataacaaaagttatatatcagggtaatcatgctctgtccaactccctgcccagctgtctcctgttctgagagatctaatgggaaattagtcatgtagactcacaccgcatgaagctcaaggagagtacataaagtgattctctaaattgggtttagtgcctcagaggcctgccaccaatctgttggcctactgttctcttggcctctgtgatttccaaatatagcaggcatgggatttccccagagttagaaagctgctgtgactcatctctgggaggcctggcagcagctcttggatgggtagatagcaggcagctgcccagctcaaagcctctgaggggtgtggtggcaaccacaggctttgcagcaggtctcagaaaaggagccatgaagctgggtcacgtggaacaggaaaagccagataataattctccaaaaagtagcactgatcataagaaaaaagttttagatactttttaagaaaactggatgtaaaaacattgaatgaaatgaatagattttagacttctggcatattcaaaagctgtatttgtattatttataaatattttattatttattgccaagaaactttctcataacacatttctgcatgactatttctaggtatgcagataaatgtagcatgattaagctatttatctgtataaaacaggaaatatgtctataaaacgaaatttatttgcatatatgagaataaatatattttaaattgcagatgggctatacattaaggaaatctaacaaaattgtaagcagaacaagtgacaatataggagataagcaaagaactttctatgattagggctttgaaaaactaaatctttaaaaagtgatgaccacactctagaaaactctgttgaaaattctgaagcgttagtttcttctttgacttcatctcaggcatcaaatgtcctttaataggatgcttcataagaaataagttaaccaagattttaggtacttaatgtaatttttattttttgttcattaaataaaagtggaatatcttacagatacatgaattttattgaaataaatgagaggatatacatagtgtaattactactggggactttaaatctgtgtagcacctagaaacattttcttgtctttttaaagtaaaaattcagataatcaaccttttcatattattataattagagctaacatttaatattttataggctcctactatgttttgggagctctgctgagcaccttatatatgcagtctcttttagcatagataaaagtcgtacaaggtaagttcacattatgagataagcttctggacctctctaaagataagctttcacgtatgaaagtacaatgaaaaacacaagcagctacacaccctcttgttgtgagaattaaatgttctaattcacctaagtcccctagcttggcctgcctcacagtacatacatttaaaaaattaacctttattcttacagaaatattattaaataaacagaaagctattatttatcgtaagagaacaattagaatatagagagtgatgatttgtaattgaagagtagcatttgagtaacaaattatatttacttacagtttctcatattgaaaggctgaatttgacatggggttgttttaagatgttaatcatgaaatatttagagggaaattttgatgacacattgaggaggaaaaaacactaaatctccaacaatgtgaagtggaattccatgagaactttataatttttctagaatatttaattatagtgtgattaaaaactgtggaattgttctggtttttagaattccttttggacatataattgatttttatttcagaaaaagtaatattttagcatgctccccaaaagatcagtaatattataaatttaaaatgtagatttagcttttcttagttgttttgccaaattctataactataaattgccctgatgagcctctgatgagccttggattttattatattgtagataaagttctgtttctaatgtcagttatgtttttagatacatcctctgttaaacagaaagcctttaaagtcagtattaatattgcttcctgctgccaggattatgacagaactcaacaaatcgcaaattgttcttttgtttcctttttaaaagactacttcattaaagatatgcatgccctttttcaccaaaattagacttcccgttgccatatcaagcagaattcttcattaagaatatgaatgtagaagaaatgttggccagtgaggttcttggagactttcttggcgcagtgaaaaatgtgtggcagccagagcgcctgaacgccataaacatcacatcggccctagacaggggtggcagggtgccacttcccattaatgacctgaaggaggggtaagcagatctttatctcattgccttaaatatagatttttaaatacggtgatcttatcaaacttattatagatggaagatggcctattgcatttttcgttttaataagaaatagatattgtaaagatatgaacatactagtaattttctatattggcaaagatgttgtgttagtggttttttatatctcaagttcctggtctgtgaaatctaattgtagatgaggatcagcatcataaattatagcactaagtcttttgtaccttccattaagaagctgattatttagggccatgaatttcaaaggaaattgacgccccagttattagctgcagaaggatgcacagactgctgtaactttattctaggaaactatttcttcatctttaacattctttccaccatgtgtcagtgactgatggctggggtggatttgaaacccattcctgtgacacaaaggcctaaagcctgaccttgtcactcacaagctgggtgacactgggcaaaccctgaactcctcagtgcctcaacttcctcatctgttcctgtggggatatgttctccctcagagttgttataatgattaagtgagataatgcatttgaaaggtatttgtcagttctgaagctgtgcagatagaaagcatgacttctgaccttgtggaggtcaagaaagaatcctgcctgggtaaagttattatcaagacaaactttgatctttaatttttaatctgtaggttgaggcagatttgcttttcctacctcaatcctataaaagtatagtctgtggaataaatcacattttgcatagcatattcccctttcaacttcttcgcccataatcctggaaacacttttatacaggtgatatctagaattagctagaatacctggattagtaagaattaaatttaaggatagctttaaaggagaactatgtacacatggatgcagtctgtgggtaggtaaaaggcagatggggaaaaacagtgagctgtaaagtccaacttaaaaatttcagaattaaattttatcttctgttttatagcaatggattttgaaatcagtcaagcatacatagaagtcctttgaggaaaatggttgctttatctcttgtctatgtacctagttggctttctatatgaaaacataattctagagcttaaatttttacttcatagttacagttacaacatggttctctttcctataaagtaattaaagcagaaccgtggaatgagatgaatgggggtatcttccctgaaggcattctccaaatatggggtttttaaaacagttttcttaaggtaatgtgttccacaattgttaaaacaatgaccaaataatgttggaggaaacagcacaaaaacaaggcattggtagagtttttcattgttgtgctttattctggtctcactttttctcgttagtagtgcaggtcccacccgtcgaggtacttttagaacctgaactaaactaaattgaaccaagcaactccataaaccaaactgtgacctaaagcactgctttccaactatgtctagcctgaaaattgccaatagaacattactaaaaatatagataggttcctggcctttgttccccctagagactgattctttgagcctagggctgggcctgagcatgtgactctatattaagaacagaatttttgtcctacaagtacttgtttgagaattcaatcactaactgactgacccccaacacccaacacctgctagagggtggcacatgccgtcagatatttgagagaatcagtcccgtggcatttatttggactcttgtctcagatcccttcccaacttgaaacgctttccatgagttttaatttaatgttaagccttaacctttacaaaatattcatatggagtcttttaaaatagcatttctataaattgtacgcaatgccagctctattactccagtgtgtctgtatacaaacactcataaaataaaatcttacttgagttataattcgaaaaaaaagtttgtcgctgcaaatgattttgcatgttttctttagttgttatataaaatcatggtaatagaaacaattttttagccctgttgccttaaatttagaaaaaaaatccaatgcttaactaatactttatttcctttttacctgtgtatattatgatttttaattcacttaatatgctttctgcctttgtatattcttttgaaaatatcaggggctataaatcctttaaaaatgaaatattaaaaagatcaagaaataggttcagagctagcaaaggaattatatcccttgtaaaaatttttgtttaaaaatatattcatacacttcagaagtattaactaggcacctaataaatgtgctttgtgtaatacttagcataagtcttagtcccagatttaagaaaaagatctccatgaaattatttcctatttattacacatgtcagccacaagtaataagtgcaaaatttttcatatttcatatgtatagtcagttaaacagcagatgaccaagagtagccctcagtagtagaacctcagagtaaatctactaccgttctactgcctgaagtgtcattaagtgtcagtccccatgagcccaacctgcagcatctgagctcctcatccttcttgatgagcattttttttaatctctgcagaactcactgacagctttcaaacttctcctaaatcaaacagaaagtgattatgaagatttacttcaaagtgaataagctcctgcaaaggaaggctgagccctctgaaaagattcattttcacttgccagactgataaccccaaggcaactgtgctgtttctgggcatggtcttggtgctacttttcctcctgatgctgagccagaggctaaggccttgtggatgtatttagcctgggataaagctggtgggaagaagagcaggttcatatttcattccaggcatgtcatggctgccaaccacaggcgagtgatgtagtgtaaatggtggctatgaagggaatgatggggtgtgaggattaaagaatatactcacttttcctaagagattgtcaaacttaccactatttcctctggttaccaaagcatgtggatccagtttcaatcaacaacagagaatcctattttattctctagaccatctcacaaagtactcccactgattgtctgctttttgctgtatgtcaaaggcctcagtgagaagttatacttgaggaaaagaatggaagtcaatggctgcccaatattggtctgatggaaagtcatgatcctgggccaatttcagtagagttctgaaattgtctctatctatggtaacttacagaattgccctttatctatctatctatctatctatctatctatctatctatctatctatctatctatctatttattttgagacagagtcttgctctgtcacccaggctagagtgcagtggtgggatctcgactcacagcaacctctgcctcctgggttcaagcgattctcctgcctcaacctcctgattagctgagattacaggcacctgccactgtgcctggctaatttttgtattttcagtagagatggggtttcaccatgttggccaggctggtctggaactcctgaccacatgatccacccgccttggcctcccagagtgctgggcttacaggcgtgagctactgtgcctggctgaattgccctttattcttaaatgatgtccctcctataattttggtacaaatatcctttattttatggaatagtggtgatatagaaatatttgcaaatgcctttaataaaattggaaacctgtatcaatttttataacaaaaaaacaaatgaagtcaatgcaactatatgtttaatatctactcttctgagttctatcattttttctttcatagtttaatgtttattcagtatttttttaatgggagaatattttattagtctttggagtacagtgattttaaaaacacaatctaggcttgcagtctactagggagcaggcaaataatcagataattaaaatcagtgttttaagtaccacaattgaggcatcacagagagggctcctctctcactacatttctacacctgaaaaaggtttatagaggagctgaaggctgactgagttgaaaatataagtacaaattagcctgctgagaaaatgagaaatgggaacgctatgcaggggaaagggcttgggcgagtaccgaaggtaggagagagcatagtggattcagaactctacttagtgtggaaatggagaaagagatccagaaggggcaaagaccagaccatgtaagacgttgtcttctgggaaaagttatttggatttcatcctgaagcattagggacctgtgcaggaaatggttgatactaaaatttttgttttagagagatcacacttgtagaatagggaagactgaatggaggaaatgctgtgtggatataggtgctgggattttaggggacccaatagcatccattttcccctgccagaggatacatgaacaagaggaacatgaacacatgaaaaaattcttttagaatttagtgccaataaaacatttaggtctctaaggaatagtcatgctttcccctctctaatgatgagaactatgacatttactgtgtttttttttttttttttttttttgatttcaatttgggtacaagaaaattaagtgccaaatgcagtgctctggcttgcaagagaattattagtcctgtcaagttttcaatgttttcctaatttctggtgactttttcacttgtttattttattatatgtgttttgctataatcccatacatctttcattctttattttgtatcttactttttgattgattaattgcaggtatgtacattagaaagaagttgggtggaggaaaaggcaggaagttttgtgctgctgcttttgagtgctcaacatttcccaggcaacatgtaacatatatggacatattcttctctaaactgtcttttatcttctatatacataaaataacaaagtatattcattaattgggcaattaggaaaaaatacaatcattggatccatatatttggctattgctggaaacagtggagtttctacttaaattgtttaccattacttgtttcttcacattataaatgtaaaggcctcaataaatgcattttacctcaaagaagagaaattgaattgttgggataaaaaaaattcttcacaagaaacaactctatctagtgcactccagtctctagtcttttgaagtaccaggttttgttagcattcattgagagccttatacttgataatagcctcctgtctcatctgtttatacacatttgaaatttgaaaacatgtgctagggtcataaaggtaaagatcattctcattttcacttcatacaaattttaaattttgacaacaactagctgaaaggaaaacaacattatgaaaaacataattttagcatgtgtagcatagttattattattacacatggactcagacaaaattacatatttttaaaagccagtgtgttcaaacttagtgattctacaaaagaagccataaatatactttttaaaaaaacttaatgagacaaatccaatatctcctgcttctgagcatgacatctgtgttccgtttgtttttaaactggtataatgcttttcattcatgcattcatttagccagtaggctacctgaggacagtggcaaagactgggttcaaggagcaccattaaggggctgttccttcactccctgtggaaggtgatggtgactagaactacagttgtagcagtgggacaaaacaaagtggacaggtgtgtatgagagttatttcagggtaaatgtcagagactgatgatggattgaatatgtggagagaaggagaggagtcaaagagatggtgcttgagttcatgacttgagcatttggggatgtcaatcaccaagagagaagaagatagaaggaggaacaggtggaggtggggtggggtaatgatgagctcagtttggaacatattaagttgaaaagcttatggatcatccaagtagagatgaaagtagtttggcagtatgtgtcaactgtcataaaaatgtttccacttctagacctctcttttaggatagtcacattaaagaatatgcagagatagtctttgtaatattatttataacttcaaaaaattggaagcaacttagttgtccaactctgaaataattgcggaataaatcatgtgtacttaaaaagaaattatactgccataaaactataattacaaagattacaatgtggaatatgcttatgatgcaataagtgaaaaagcaggatacaaaattatattttagagattattgcaattagattaaaatatatgcatttgaaaaatattctgcaaggtacattggaaaatgaaaatagttcttttggcaatataaatgagttttgtttttatacctcaggttttctgtaatgtttttatactggttttataatttaagaaaaaaaacatttcaaagcatgaaaatctcttatgcccatttatgttaccttgagaggaattaattaaaaatcttactaattgcaaatacaaatcaatgtcttgtctaagcaagagggccattaacagttgtaagaaacattcatttaatctcggtccttacaaatatatttcacaattaccaaggaaaaatatggtgttgccttggtagttactaaaaggatagaaactgaatgtatgcaaggcttaaaagtaataacttgttttaaatcgaatatgtttatatcctctgatcatctaaataccaatggtttctcatctctacttttgttctgaatttttaatttgatctttaattttgcccattatttactatttgtttcccaaaggtacaataggttttttaaaagataatctttcaaatgagtcttaaatcctaatataaatttgatgtgtagagcaaatgaatttgtgtgaacatattctcgaacacagttgtcatctctggcttggtcatgacttcatatttacatttacatagctttgaacttttgtgctgtacttttatttcatttcattttaaaaaaataacagctttattgagatataattcacatatcatacaatgcacctatctaaaatgtacaattttaaatcgtgacttttagtaaattcacagtcatgcaatcattattataaccaattttagaaagttgttattatcccaacaccacacacccacccttgtacccattagaagtcacccccacccccacccctacccctaggcagccactaaggaacttgctgtctctataaatgtgcctattctggacattttgtataaatggaattatataatatgtggtcttctgtgactggcttctttcactttgtataacattttcaagtttcatctatgttgtagaataaatcagtatttcatttttaatcatggaataatattctattttatggatatgccatcttttgtttatccatttataagttgatgagcatttgggttgttttcacttgttgaccatgaatgatgtcattgtgaacattcatgtacaagtctttgtgtagacatatattttcatttttctgaagtatatccctaggaatcgagttgctgggtcatatggtaactctgtatttaacattttgaggaattgccagactgttttccaaagcagatgcattttacatttccaccagcaaaataggagagttccaacttttccatatcttcaccagcactagctattatctgcctttttgattatagccatcctagtgaaagtgaagtggtatctcattgtggttttgatttctattttgctgatggccggtgatgttgagcatctcttcatatgcatattagatatctgtatatcatatttggaaataggtctattcatatcctttgccatttttaattgaattattcattttttgattaagttgtaagagtttttatatgttctatatacaagtcctttattaaatatatgatttgcagttattttctcctattccatggattgtcttcacttttcttaatggtgttctttgaagcacagaacttttttattttgatagagttcaatttattttttttctgttactgctggagcttttagtgtcatattttaagaatcattgcctaatccaaggtcatatttacacctgttttcttctcagagtttaatagttttagctcttaaagtctttgatttttttgtgcgtatactatttttaagagaatttttaggtttatagaaaaattaagcataaggtgcagagattgcttttgcatcgcctcccccattatcaacatcccccaccagagtggtatatttgttacaaatgatgaacctacactgacaactcactatcacccaaagtccctaccttacattaggtgttactcttggcggtttatattctgtgggtttggacaaatgtataatgacatgtttccatcattatagtatcatacagagtagtttcactgctttaaaagtcatctatgtcccacctgttcatccctccttccccccaacttctggcaatcattgatgtttttactgtctccatagtggtttttcttccagaatgtcatataattggaatcatgtagtctgtagcctttccatatttgcttatttcacttagtaatatgctttgaagtttcttccatatcgtttcatggctcgatagcttattccattttagcactgaataatattccattttctggatgtaccacggtttaattatcattcacctactggaggacatcttggttgcccccatattttggcagtcatgaacaaagctgctatagatatccatgtgcaggcttttgtgtggaaataagttttaactcctttgggtaaatatagggagagtgatagctggatcatatggtaaaagtatgttattttgtaagaaactgccaagctgtcttccaaattggctacaccatcttgcattcccaccagcaatgaataaaagttgctgttgcttcacatccttgccagcatttgatattgccactgttctggattttggccaatctgtgtgttgcgtatctcactgttttcatttgtctttccatgatgatatgtaaagtggagcatcttttcatgtgcatatttaccacgagtataacttctatggtgaggtgtctgttaaggtctctggctttttgttgttgttgttttttagacagagtcttactgtgtcacccaggctggagtgcagtggtgcaatcttggctcactgcagcctctgcctcctgggttcaagtgattctcatgcctcagcctcccaagtcaagtagctgggactatagaagcatgccatcttacacagataatttttgtattttcagtagagatggggtttcgccattttggcgaggctggtctcaaactcctggcctcaagtgatctgcccaccttggcctccaaaagtgctgagattacaggcttgagccactgcatctggcctctggcccatttttaattggattgtttgttgttttatgttttaagtgttttttgtatattttggataacagtcctttatcagatatgcattttgcaaatatttccttgtagtctgtggctttttgtactactggcagtgtcttttgcagaagagaaatttttaattttaattaagtccatcttgtcaattctttctttcatggattgtgcctttggtgttgtaactaaaaaatcatcatcaaatccaaggtcatctcgattttctcctctattatcttctagaagtttcatagttttgcattttgcatgtagacctgtgatgcattttgagttaatttttgtgaagggcatatgtatctagattcattttttacatgtataagtctagttttttcaacaccatttgttcaaaagactgtctttcctccattgtattgcctttgctcctttgccacagattagttgaatagatttatgtgggtctatttctaaatgtgtattctgtttcattgatctattttgtcaattatttcccaatactacactgtcttgattgctgtagctttatagtaaatcttgatgttgggtagtgtcagtcctcaaaatttgttcttctccttcaatattgttttggctattctgggtcttctgtttctccatataaactttagaataagtttgttaatatctgcaaattaacttgctgagaatatgattgagattacattgaatctataattaatttgggaagaactggcatatggacaatatttagtcttcctatccattaaacatggaatatctctccatttatttaggtcttctttgatttctttcatcagttttgtagtcttcctcatacagatcttgtacctattttattagacttatatttatatttaagtattttattttggagggtactctgtcgcccaggctggagtgcagtggcacaatctcggctcactgcaacctctgcctcctgggttcaacccctggctcagcctcctgagaagctgggactacaggcgtgtgccaccatgcccagctaatttttgtatttttagtagagatggttttgtcatgttggccaggctggtctcaaacttctgacctcaggtgacccacctgcctcggcctgcaaaactgctgggattacaggtgtgagccatcacacccggcctctgtttttaatttcaagttctacctgttcatgctggtatataggaaagtgatggactttattatattaatcttagtatcagctctatcagctcttgcctcatgtattttgatgctttctgttttggaaggttattactgattcctgcaacgttgctgtaatcactcactagttttaggagtttttaatcaattcttttgaatcatatcatctgcaaagaaagacagtatttaatcctttcaaatctgtatactttttattttctttttgtcttttattacattagttaggacttccagtatgatgttaaaaaacagtgatgagaggcaacattcttaactttttcctgatactagtaggaaaacttcaagtttctcatttagagtaatgttagctgtaggtatcaaattgaggaaattcccctctattcctagtttactaagaattttttttttcacaaattgccattggattttgtcaaatgcatttcctgcatctgatgatgctgtcatgtgatttttcttctttagcctgttgatgtgatattaactgatttttggatgttgaactagccttgcataactggggaaagtcccagttgatcattgtgtataattccttttatacattgttgaatctgatttgctaatattttgttgaggatttttgcacctgtgtttatgagagatgctggtgtggtgtgtagtttcttttcatgtaatgttgttttctggttttggtattaaggtaatttgggtttcatagaatgagataggaagtattcttttggcttttgtcttctgagaaatattgtagagagttggcataatttctcccttaaatgtctagtagaattcaacagtgaacccatctggacctgatgctttctgctttagaagattattaattattgattcaatttccttactacatataggcctgtgcagattatctgattttttttttcttctgcttactttggatttcatttgttcttctttttctagtttcctgagggggaggtttcaattattgattttagatctctcttcttttctaatgtatgcattcaatgctatgaatttccttctaagtattgcttttgccaaattgtaaacattttgataagttatggtttcatttttatttaattcagaatattttcaagtttcatccaagatttctcctttaatccatgtgcaatttttgaagtctgttgcttagtttcctagtagtttgggatttttcagttatcttttgatactgagttccagtttaattctaccggggtctgagaacagacagtgtatgatttccattcctttaaatttgttaattttttatggtctggaatgttgctaaatgtttcatgtgtacttaagaagaatgtgtattctatttttggatgaagtagtctctaagtgtctattaaaacctgtcgactgatgatgatactgagtttcactatgtctttaccaattttctgcctgctggttgtgtccatttctgatagagagatgttgaaatgtccagctataatagtggattcatctatttctctttgcacttctatcagctcttgcctcatgtaatttgatgcactgttatgaggcatatacacattaaggagtgatttatgttcttaaagaattgacctctttatcattatgtaatgcctttctttgtctctgataagtttccttgctgtgaggttggctctgtctgaaattaatatagctcctcctgctttttagttattgttagcatagtatatctttctccacccatttacttttaatgtatatgtgtcttcctatttaaagtagatattttttataaagagtatagttggatcttgtttttcaatccactctgacagtctctgtcttttcaatggggtatttagaccattgatgtttaaagtgattattgaggccagccatggtagctcacgcctgtaatcccagcactttgggaggcagaggcaggcagatcacctgaggtcaggagttcgagaccagcctagccaacatggtgaaaacccatctctaccgaaaatacaaaaattagctgggtgtggtggcgggcacctgtagtctcagctacttgggaggctgaggcaggagaattgcttgaacccaggaggcagaggttgcagtgagctgagatctgcactccagcctgggtgacagggcgagactgtgtctcaaaaataaaataaaaataaaataaaataaaatataaatctactatatttgttactgttttctgtttgttgcctttgttttttgtttctatttttgtcttccactcttttcccactttttatagttttcattgagcattttttatgattgttttctctcctcttttaacacatcagttgtattttttaaactgtcttttactgattgtcttagagtttgtaatatacatatataaccaatccaaattcactttcaaataacactacactacttcctaggtattgcaggtatcttatgataaaataatccctgtctttccctcatctctcttgtatcattgctgtcatttattttgcttatctataagtgtatataaacatatatgtagatatatacatttatggatatatggtgaatagattgttgctattattttaaacaagttatctgttagatcaattaagaaaaataaaaggttttatcttcacttattccttctctgatgctctacttttctttatgtagatctgagtttctgacttatatcattttccatctctcaaaagaagttattttaacatttcttgcaaagtagtttcactttattcattagagccctctgcatattagtcatagttgttttaaatttctggtctgataatttcaacatctctgccatatctgattccggtgtgatgcttgttcagtcttttcaaactgtgctttttgctgtatagtatgttttataatttttttcttgctagctggactaatgtatggagtaaaaagaatgaatataagtagatctttagtaatatggtggtcaggtgttgtgggaggggaagaattctgtaattctatgattagttttcaatcttttagtgaacctatgcctcaggaccatgaatttcacatatgcttctcatttgccttcttaggtaggacgggatatgtggatatccagtttttccagcaccattagttataacaactattatatatatatatatatatatatatatatatatatatatatatatatatatattccagcaccattagttataaaaaataattctatgattagttttcaatcttttagtgagcctatgcctcaagaccataaatttcacatatgcttctcatttgccttcttaggtaggacaggatatgtggatatccagtttttccagcaccattagttataacaactattctttcctttttgaattgtcttggtacctgtgatgataatcagtttattaaatgtgagagtttatttctggattctcagttctattccattgatctgtctgtctgttcctatgcccgtaccagatgacttgcttactgtagctctgagtaagttttcaaattgggaattgtgagttttccaaatttgtttttccttatccaaatttgtgtgtgtgtgtgtgtgtgtatggctattctgggtgctatgaacttccttaggaattttaggatcagttagtcaacttctgcaaagaaggcagctagaattttgatggttttacttcattttacattgtcatttttttcctagcattgtcattatgaaaaggaacagtatttacttgtagtattttcctggttttctcttttcttttgaaaggccaatgagattcctatcttctcaagctgctccaagattatttaaatactgttgtcactatttcctgttgtgaaatctttttagccagttaagtagagatctttccccataattcccccaaaccaacaaaatattttgtttgcctctttgtgtttaccaaacaatagttttacccttatattaatgtcttagataaaagattgcaaggccttctaatgagagaccaagcatataggggtttgtgtagtagaaaaactaacagaactgataggtaaaatagtaatgtctacccaaagctccatacctccagggatgtaatttaaaagttttattacaagaaaattaagtgaaatgtattacttagttatttattattgtagtagtggggttatttcctaatttaccttaaggataatgttttaatgtaaatatctactaaatatagtaattactaaatatagtaatcagaatatgatgcatgtttatattgaatgaaaataaatgggatgaaataaagtttttagaaattaacatagaatggagagagtatctggtataccaaagcactcagtaaatattggttgaataaaggaatgaatgaaaggaagcccctacatgaatcattgtttttagagccgaggcccctacctcagggatgagtctagttaatctctcaattcaaaaggctaaatcctgcttttaaggtggattgttttttagtgttttcaattttcttaaaggataacctgagagtttcacatttttacagcgtttatgtcatggttggtgcagatgtcccgttttcttcttgtttacgagaagttgaaaatccacagaatcaattgagatgtagtcaagaaatggagcctgtaataacatgtgataaaaaatttcgtactcaattttacattgactggtgcaaaatttcattggtaagtttttattttgtttttgcaagtttagttaaaaataatgtggctggagttaacgtttgactaaaacctgaactgcttttaggaataaatcctaggtttactttaactgcagttgacttcccttgagattaaggatctggtaagctcgttgacagtgcatccgtttaggaaagaatatatccacttttgtacttattctatccttgattaattgctggggctggattagcttggcaggtggtccaaatgaaccccttgggcatccatatagctgctaatgagcacagatagtggagttagtatgatatgtgcagaaagattcttcttaaatattctgccactaacccactttggaaggaaaggatggagtacaataataaatctgaaaataaagcagtattgtgctatgatttaatgttctgacaactcaaattatagggaaagtccaagaaacaagagacaattccaagtgaagaaagttagaatcttacccataattcataaacataatatttctttccaaatcacattttaatttgcatgttaacagatttaggaaaatgtaaggtttcaaatatatgtaagatatgtgtaatattttacatatgtttgcatattttatattatatgtctgtatataatattttgatcctgttatctgaaaagcaggagagttgtttcaattctttgttttttttttcttttcatattaatgtatccaactgatgttttaattatttagtgatcttttagatataacttctgtcaattctttatgattggtggtgagtgaattagatctaagtttaaagttgacatttgaacaaagttattgacacataaacacaattatcacttcatgtcttagagagccagctgcatcctggagaacatattactcacattgcaacacttagcactccttgtggccttttgccttgaactctccttctcatgcctcttgtctcatggcctttagaaaaatggccttctttgccttcctaaatcaagtaaaattattattataggcaaatttgctcaattattataggaaaatttgttcaatcatggtgctaacgatacaagggtgcaggagactgagcagctgcaaccataacttaggttcctctcccagcatcatcagtggccaacagaccctaacaatgccattttacttgtggttgttctggaaaatgagtttatgtttaggactattacccagtctctaaaagttaaaaaatgatatactccttgaagatttttgtttatctgttaaggctttataagtggaaaggttgggaatttttattttttattttacatgtatttatttttatgccacatcttgccacaaaagatttcagaaggttaaataagattcatacagtaaacataataaataaaatataaaagaaatggaaaatcaggacctaaatttcaccccccaaaaataagcacaaggctgtgttggacaacaagccgccaatgtgcaggacaaaaataaatgaaattcatatttagttctcatttttaaaaaggaggcacatcaattccttggcagaaaacaaaagtttttactaacactgtattattaacaaaatttttcaagtggagttttttgggagaagatactgaataatgctgcaactaattctccccagcattttattttagtagcaaatgtagtagcaaatttcacatggctatatttttagtgtccttcaataaaaaccttagcataattaaatgcaactcagtgaaagcagctcaattaatgtggaggtaaattaacatagtgcaactgttgtagtttttttttttttttttttttttttttttttttgatactgggatagaattaagtaagactgggataggttccatattccctagactatcttccataaaagttacttctgtcagctggaaggcagaaagatcaaggacgacacgtttggaaattgtccctcttttttttttccttttttcttttgctaaacttagaaaccatacgtgcatacctggttttcagccagttttaggtttggtaaaatctgcacttgagctttgccactaggaaataagacatttacatggtagtgtaaaggactactgctttagaggaaggaaactgaaaaagaacaactacacgtataggcacacacgttaaatatgtacacatgtaaatgtatatgtatatatgttttaggaagaacatagaaagtagaccaaagtaaagcctttattactttcatttgttacattccctacctccaataaatacttgcaaattcaagaggtgataaagtaattggaaaagatggctttttagataatttgtcaaagaatgctttagtgtatccagatcttaaaatctcataatgtttgcaacgattaatttgttgtgtaattgtcttcttttatatcaggttgataaaacaaagcaagtgtccacctatcaggaagtgattcgtggagaggggattttacctgatggtggagaatacaaacccccttctgattctttgaaaagcagagactattacacggatttcctaattacactggctgtgccctcggcagtggcactggtcctttttctaatacttgcttatatcatgtgctgccgacgggaaggcgtgtgagtactttaaaactaataagataattagagatcctgctaagataacaacatagaagattccattaaaagcaaagtttcatttggttcataaaacactttgtaaatgaattgaaattgtgtccaaactgcaatactttattcctttaaaatgaattaaaatagttttgagtctagtaaatcaaattaggggatataattactttattcaaaaattattaaggctagatgtaaattcacactggcaaaacagtcccaagaataattgaggctagatattttggttatacaagccatcttgcatgagcagagactgcagaatctactgacatggtaattgcacttaaaaaaattgtgttagtttgatcagaagtgatggtcaaaactcttgaaatcattctgctgtcaaacagggtaacacaatttaatgtttaaaatatatttttaaaacccaacttaggagtaaattaatgaaaataaggtataatttgagtaacaagtcttcacttcatgaatagttagtaccttcaggacatctatgtcaattaaggtaatctcccaagattatctggaagtcagggcaacaaagcaaaggataaaaaattaataaagcagcaagtaacaaattctttcatttttacatgtagcttgatttcattatgtcatagaatttatttcaatcaaggccttgattcttaatctccatttttttcatttttctatgtgtttctcatcagtattccatcgctgtatgtgtactcatccaagcaatgtcataaacctggtggcaaatgctgcctggttgcatttaatagtgacaatgtcagcatttccacatcatgcaagatcccatgagcatatagtcttaatgttccaaatatcaatgctattatttaattcataaattttgttttgtttctagggaaaagagaaacatgcaaacaccagagtaagtgtcttctttcctgttattttcttcatcattttttcccacctctcagttgcccatcatgctccatacatgtgtgtcaagctttttttcatttgtcatctttcatagtttatttcataaatgtgaaagctgctttctaaatagagatatttaggaggggtagaaactaaaactaaaaagggtttgaaaactaagattacacagataaaaattaaacctaaaatatttcagattcagaatattaacttaccatttatattatgtgatttccaatctgcatttctataaaccagagaacagatgaaaagacctttcatacaagttttccagaatctacagtaataacctaccataaaatgaaacttctgtgagtatttataaatgccccaccagaagcaaaaatataaaagctatggtagttttatcttaaatcatagaaaataaatagaaaactagttggttacttaggacagtaatattaatacaatgcttcatagcttagtttaataaaacacctatgtattttaaaatcagtttataattttcagttttgttatattaaaagtatgtgagatgtatgcctttctgaaatagtttattgaatgcccaaagtgccataatgtcttattattttaaaagataaaaatacttcataagtttttcaaattgatgacccatcaggctaatatatgattttaaatatatgttgttttatttctttttgacctagcatccaactggtccatcacagtgctattcagaaatctaccaaggagcttcgagacatgtccaagaatagagagatagcatggcccctgtcaacgcttcctgtgttccaccctgtgactggggaaatcatacctcctttacacacagacaactatgatagcacaaacatgccattgatgcaaacgcagcagtaagtgtccacttagagccataattattaatatgcatgtatatttttactaatatctgtaaagaacagagctttctgttgttgtgtttgtttgtttataactggaagagaaaataacaaaaggacattgtgtaaatctcacccctactctcctgaaatatacaatacaattacttttaggaaatgcactttttttcccccactgatccaaacaagactacatataccttaatatttaagaaattgacactgatattaaactcaacattacatgtttgctcaaagatgagttaattataaaaaaaagaaccatatcctaagcatttcaaattgattatttttagagatattagaattatttggtttaaacctattaaaatgttattaccatagacctttgtaatctaaatttttgcctcagaattaagggtgtttgggttgttttttatgatctgcttgtatgtcagagcaagcagctccaatttggactataaacacctattttattagtgcaaaccttgtctagtgctatagggatcagggttagaaaggctagaaggactttgtaaggagtagacaagggtgaggggtgaggaaactgtacagttgcatttgggagaccatgctatataatgctgtaatgcagcattatgctacatcatatattgctgatataatgtagcctagtggccacatttttatataagggaatggtgggtaaaactgttatttataagaatatgtctctttttttcttttttttttttaagatggagtttcgctcctgttgcccaggctggagtgcaatggagcgatcttggctcactgcagcctccgcctcccaggttcaagtgattctcctgcctcagcctcccaagtagctcggattatacgcacctgcccccatgcccagctaatttttgtatttttagtagggatggggtttcaccatgttggccaggctggtcttgaaatcctggcctaggtgatctgcctgcctcagcctccaaagtactgggattacaggtgtgagccaccatgcccggccttttttctttttaaccaaatgttaaaatgagttgaattcaattgccctaagcactagaagtcatgaagttggcttttgaggtcctcctctttttcactttacttttatagatggaatggctatgcagaaaaatctctctttctcactctctcagtctctctttctctctctctcatacacacagacacatacacaccccttaggatataatattaaagtgaacacatttacctgggaactctgctgggtacatttttcccattgagtgcttattctgtaaccaggtagaatgcatgtggtaatttgaagattaaataataattaatataagtagtatagatagactagataagtttatccagaatacttcagaaacccaaaagtattatgaatatttttctaaagttctctaacatcacttagggtcatacagactaaggtgcctgtttatgtgcatgtgtgtatgagagtgtaagtaatgggtagtgggtaatttaagaaatgggtgaaattgcatatgtttacaattttgaatttttgaaacattaatatatcagggatataaatattaaagtctacaaaatttagttgtactgaatgcaacggatgggtttctatgctctctggtggtcagtagcccacctattatgggtcatcataaaacccagtttaccgggattagatactgatgagaaaaattggtaaaatttcaagaatattgtaataattcagaatttaacaacctcttatccctttttagatgaaaattatgaaatggctttatcattcattttcaaaatgaaaagaatttgtacttattctttaaggttattatttctgatattgtttaccctagcgtgccagtgaaatgttgacagatatccttcaaaaaaatggaatgatcaaatacacttggaaaaaagtagtagcaacactgcagaattctaacatgaaacaaatcctgtagctaaccaaattgtttatgaatgatgaattcagtatacttagtatgaatgtgaagatgaaatgcatgcccttttaagaagggttaattaataagtacaaggcagcattatccaagcatatacctggttatcgagtactgtaacgtaaaggttttatttctctgttttttaagctacaacagtcttcagtcccttagtgtgttgatacactttgtgaatccataggaaaaggtcagaataggtaactcttcaaagaacacagtttgagaaatgcttctgttgataatgtaacaaacagtgctgtagaattttagagtagaaaactagttataatgagtaggggaacttgaatatgtttgtaaatcaataaaactctattgctagtgaaatttaagagcggaaaaaggttgctgtcattttaagataaccctttctaaccacatatattgaaaataagaatagctccttaaaaagtattttgattccctgtggttagaattttgcaatgttgctactaatatacaagcaaaataaaattttctatctagtttacaccaaatggatctttctggtccttccataaccccatcaagactgtcattaggttgatcagatctctctatttgcaaatgcaataggctattatattgaacttgcaacaatttaaacacatacgtatttttaagtccagaaaaccttcacattattcagatttctgctaatggaaaagctccattaactagcacttctatataaatagggtacacagataattgatgatgttcacaatgattattctgaggcactgcaggatcatcaagtgcgtctgactcatcagaggaaaattaaattacattcggtgtcgtttcagtgttgagtgtatattatctttcttttattcttagaaatggataatatgtgcacagtctctatggtaactccctataagccagaatatgtgattaacctcattttccagccatgccagataatagggaatttattgtatggggttcatcatagctgtcctttatgcaaattcaacttttactttttaccagaaaaacagctatgttttaaaagttttacttcagcactgagtagacacacacaaatattttggtcatttggattgaattgaattctcaagattaaaatgtgatattatattttgggaggcattacagtactcaataaccaggtatatgcttggataatgctgtcttgtacttattaatttacccttcctataagggcatgcatttcatcttcacattcatactaagtgtactgaatttatcattcataaacaatttttagctagccaaaggatttcatgtttattcttcagattgataccggaaatattcagacatggatatggctaaaggtttatattggcttctaagcaagactcaagaatattcaaagctttctttcaaaactgcataaaactagtttgttcctttaaacaagtcaatttacatcaaagttatagagaactcacaatgttatgtaatgaatggctgccaccattatcaattacatagtaatattttctttttggtagaatgtttcacagagctccagactggcaccataaattagtcagtaagaaaaaatgtttaatcatttgcagatgataaatttgagacactgataagagacaaagttaaattaggtcagaactgagattagattatttacctatcctgatatctaggcagggatagatagtgtcggtcattgacctcagaaggatctctgattcaggttataagcaaaatgaataaagaggcagtggacagggaagctggagcagaacctggagatgtagcacatgcctagaaatgaggtgtttcattttgtactgtgtttcttttgcttttcaaattacagagacaatataaataggctgttaaaactatcacatagtctagaaatgtaaggccaacttaatttgatcttggctaatgtgtttattctttaataaactttttattttggaatgattgtagaggtacaggaaagttacaaagataatagagagttcccagatacgcctcagccagtttctcccgttgttaacatcttacagtaccatggtacatttgtcacaatgaggaacccagtttcggtactttactgttacctagacttcagacttttttcagatgtcattcgtttttccactaatgtcctttttctgttctaggattccatctaggacacaataatcactatgtctccttagtctcctcaggtctgggcattttcttagacctttcttgtgtcccatgacctcgacagtcatgaggagctatagccaggtattgtgtagtatgtccctcatgccctcatatagtaagtttttctgcatctgtacttagttatctttgtagcctagtgaataagtgttgccattaatagcagtaataattttttcccctatagacatttgtcttagttattaaaattcattcctggaaatcacattgtaaagtaattcttaaaagtaaattgactttgcccaaagaatcattgttgtgactggtgttatgtttgtgaccaaagacttcacatcaaaaatctattacgtatttgaccggtgtacctcaatgattgccctttctaattatttaaatgaaaaaaatttaattccaagtaataacattttaggtcatcaaaggaacgtcaagagagagtctagccttgttcccaaaccacgttgtgtcagaatcaccatagagcttttacagtacacattctggggctctgagtatgggaatttggagtctggtggaagtgtatgttatggtagagctcctgcagagagcttctcaacaaagattgagaattcctggcttaataatcaaaagacttaagtttcaggattggaaaatccagagctctgagtaagaagggttgttattcacattcctctacatggagttttaaaaggggaacagtttttcctaaattcccccatgtgaaactgaaagaatagcagtccatgcacattgtctaggaggttggagctgtttgggagtttatacttctcagcctctagactcttccatacctccttaaactgcctgaggaaaatggtgtggagaggttgagagatgagagctaatcagaaaacagtgcctggaacagctaaaagccattgaaaaaatgttattttgtagtcttatgcttggggaaagggacattgactggaggatcccaaatatttgattttctaaaaaataatttattattatattaaatttgtagtgaggtatgctgtcttttggggaaagatctgcctcttcactactcttttcttatgccaacatcaataccaattgatttttttggagtggtaggcatcttcatgaggccccttaggtaatgaataattggggaatagtactccacacatttttcaggaagatattaatttgctacacaaaaattttccttattcattattctaaacataattcctaatccaggataattgggtctctctcaaaacaggagataggttgtacttaatcttttgaaaattaacaagtataaaagtagaattaagtcttctaattgaagacagtatctaatcattttagcttttatttaaatatttttccatttgtcctgcttttggtcacaatgacaactaactttatggtaaaattccataaataaaaattaagttttaataaaagttaatatcagttgaagacagtgtttcaggggactaagattatggtgtcctgttgagaagtatcaggcagccaagaatatttcagagccattgttttccaaaaatatataactatttcttattgttaaatgatgtcaccatactaactgaaaagtgaaatgttttgtatttcacacaactagtgtcattttctttgaactctggcatggattctgtggctttatgcaaatcatcattttgctttttagtttgaaacaagtagcaatataatcagttgataatcatcaaccttactcacagaattacggtatagggtatccaagaatgtcaaattactttaaaatggttgtacacataagaaataattgtgtactccccccaactcacttatttattaatttgcaagttattactcttgcattcttaaagaatgaagtttgtgcaatgactaatttacacaattttctatttaaatgcatgaaattaatgaacataaaatgagaaaataattaatgctaataatttagttacagttttcttaaatttctacataatgcagtttacacataataacttttcacttagtctaataatcattaaattgttttatgacttcattaaggtccctccttggaaggattatagggcctctatttgaagtcgaccccccgctcctgtataattgcctttagcagcctgctctcaccaaagatgagaatttgccactttcttcctgcattctctgcatcttaactagcagagttgggattgaaggcattttttccagtatgcctgaagcagtgctgttataaagtatgtcccttcaactcttaaatgaaatacacagttttaaatatgcccatcatagatacattcacactttaatacttacaggttcacatttagttacaagtttgggaagccacaaaaacagagctatgtgcacacatcttggagactcaagggtctccttcaaaacaggagataggttgtacccaatcaggggatgttgaatctcagtatttttttggttgagcacctttttgcgcacacaagcatttttaatataactcatctaagtttcctttgaaactgcaaggagtgcatgagcattgttcaaacacaaccacttagaacacccactatggatacttttcagtctctaaatcaatataagacacacagttgctttcttatgcatcttctccgaatttcttgctagtttgtgtgtggcatttttctcaaccagccatgtcttttcacctagcccagcccattgtgatttagaaagtttagcaatgtagcaaaagaggaaaaaacggaggctagaaaagaaacgacagggcataggttgactttgatcagtggtttccaagctaaattccacagaaaggtcagttgggagggccaacaagagaagtggggggcatccaactacctcatccaaatgctgattttgaatttggaggatccttaatctagtgcttttggaaaacatgtgtctttgtttactaaccactacctatgttagaacacctacattctatattttctttatcctgtttgatttttgtattttgtcagaatgtgttgattcaatctgctgacaggctaggtagagctagagatggtaaggaatgaggaagtgcttgtgtgtggtgtgcgcctatgtgtagaaggtgcactgtgttcgttttgagtgtagaatagacccagatcagttatacctgagtaggtaaaataaaacacatcctcccaccctgtgtgagatgcccatctaattgcattttgacttctgtagtaaagatatttgccttgccatctttaaatgtagaacttattccctctttgtagtttataaattgatctttttacttttgtgaccaaaaccaatataaatacattgtgtgaaattctgaaagaacaaacaagctaaaaaagaaatactcctctagcctacacaaggataaggctgataagtaacaataaaaacgaatataatcgtcgggatgaattattaagtaacttcctcaaattgtgttagagttgagtttattatttccctagtaatatctttaaagtggaactgaaacattaaaaaaaactctcaaaggtgttacctatagattaagagtttaaacagcatttaactagcacgcactgttttccactttagattgttgtatttggaacataatatttgcctggctgaaataattcatatcaatggttttcaaactgttttttacagatttcttagaattgctgtaggggccagcatgagggacaaagaaaacaaagctgacaggattcctaactcccttgtttcaacccaggcaacctcacatttatctcttttgtacatcacagttctgcttagggtttcaattaagaggaatcccagtgctaaagagaaaacaaaaaactgaaaatccccagcttggatcaaactttattacaaaggactgactcctggagtttcttccatacagaacctaaattgtacattttcataaactaattttagtatcaatatgtgaaactaaatctgtaagttaataaatgtatatactttataatgcttactgctgaggatactaaacaaaatatgatggttcttattcttaatatactttggggcaattaaatattatatacagagaatacaatgacaatcagcatgtgaatgaaagcatgctaaatggtaacctaatttgtgggttgcttagagagtgaggatgcataggaaggtggttcttgagatttttttaattaaaaataatatgttaaaaattttaataacatttctcatgggaatttttaaactataagagtaatacctgtatgctgtaacaagttctgagttgagttagcaagaacaaatgggagctgattgtgtacaggacatggtagttggttgttggcttcaagcagacatggggcactccatgtaggagtgagatatattgtggctttccaggccacattaagaaatctgaaatttaatctgcagatagatacaaggaaatattgaaatgtgtgttatttaaatgacataatcagatttgtgtcttagaacagtggtccccaagctttttggcaccaggaactggtttcatgtcagaccaggagtgggggatggtttggggtggtccaagtgcattgcatttattatgcactttatttctattattacattgtaatatataatgaaatattatataactcaccataatgtagaatcagtgggagccctcagcttgttttcctgcaactagacagtaccatcagggggtgatgggggacagtgacagatcatcaggcattagattctcataaggagtgcacaacctagatccctcgcatacgcagttcacagtagggttcatgctcctatgaccgtctactgctgccgctggtctgacaggaggcagaacccaggtggtaatgcaagtgatggggagcacctgtaaatacagatgaggcttcgatggcttacctgccactcacctcctgctgggcagcccagttccgtgtcccaggggttggggacccctgtcttagaagattattctgacagcaatgtgcagagtggattataaggggacaagaatgtaaatgaggaaacaagtcaatccccttacaaggatccaagtgagaaatgatgatggcttcaaccaagttagcaatggagatggggaggaatggggcagatccaaatgagacaaaaagaaatgtcaaaagtccctaagtgattgaatgtggggactgaaggagagggaaggaacaaggatgacttctgcattccgccaatgcatctggatgcatggccagtgtcattcctgacacgaagataaaagagcacagatgtttgggatagtgaatgaaggtggttatatatgttgttccatgaaaatgtgtgatctggatctgaaagtgtataggttaagagcacaagccactgtgttcacatctttacctaccatgtcctagctatgtggccctggatctccaaggctatttcttcacccataaaatgggaaaaatattaacacctacctcttagggttgttgtgaggtactttagagtatagcccgcagtgaaaatttcatgcatgttatcaaatattgttaatttttattctcctcagacctcagtttcctcatctgtaagctcatgaaaggggaggggaattgtgctggattacatgactggggtcatagtttacccgtaaagtttttcattctagtatgtctgctctctgtttacaagtgtgtaaacaaacagttttactcaaaaatgttcatcatttctaggaacttgccacatcagactcagattccccaacagcagactacaggtgagtgctaagaataataaattaatgtttatgaatgaatctaatagattaaaagataattatggcactatataatttatgaagctttatcttcaccaaataaggcaaaacacttgtgtcattccttaatcagacttaaaacctcagaataatagcttagattattacatagattggcatcagaatgataaacacagggtaaatgatcttagagcaaaagcatccatggaggtcctgtctaattaaggaagactgaatgaaacccctttccttcagtgaagttccctattcttccccttggtatgaaagattcttagcttggatgcatccaggatttgtctcagtaagtgagcagcttgaagtttcaagctctcttacaaaaggaaaccattgtgactaatcactgaggcttcagggggataaatgagaaatggctggcctggttttaaagccgctttaaaaagctgttataacatgaccaatgacaacaagatggcggacaattctccttggattattctatttccctaagacttgctttctttatttctttcaagtgtccctaaaaattttccacagccaattatttcattcatctctatactgagtagataacttattcatgattgtcttctaattagtggttgattcctagttctaattgccagggaaccattaatgcctttgtagctcttttggaaaagcaagagaagttttaaaaatgtaagttgggtgtggaattctgagtatgaatagcggcattgtggtagggaaactattaagtaagtctcttaaaaacttcaggcacattcagaaatgtgttggatgttttcattcagaaattatcttctctattactgctttcgtgaatttaaggagattttcgtttgacaacttttcaaagatttgaggcaagtataatgaaattgttcatcagatttcaattacaagatgtttatcagaatttttccctacaattttgattacttgctttaattaaatgctaacatgtttcaacaagactgttcaatatattgatgtgttggtgctactttgtaagcattcaggagattgatgaaggaacaaactttgttataaaaatgagtcacctaaagagagaaaaaagataaatgaatccctactaccactaatttcacagctattttttaaaaggaaaatttctaaaagaatacttctacgatagaaatgatagaacttcttcgttattaaccttgtagcttccatctcgcctaagatttctatcttctgattcttaattatttcaggcatggagtgagtaggaagcaggcaatttctagaaaaacagtaaatatttattttgagtatttaaaaatccagattttacttacttacccactaggggaattaggaaacttgagtagatgatattagggcaatttgtttagtagtcacatagattttttagcaagtactcttgttaacttgctacattttagtaatacagagcacttccaaatacaaggacaatttatgcctaaacaaatataagagccaaagagttttcctaggggattttaaggttgtttaacctaatttataaaattatttttctgaaacagattttagggagcaggtattttgcttgagtcaagaaagctttgctctcctttttagttaacactagagcctattaccttcttgttttcttacatttttctgcaatttggatcatattatagactaaagtacagtatctcctcttggttgttttgttgttattgttttatttagtgagtccccaaaatatcttaagtgccaaagggagagagaccaccctagcatttttttttataattatgcaagattggtgtgtttgtgcctctggtacatttaaaactaaatggaggctgggtgcggtggctcacacctgtaatcccagcactttgggaggccaaggcaggcggatcacctgaggtcaggagttcaagaccagcctgcccgacatggcgaagccctgtctctactaaaaaaatacaaaaattagctgggcatggtggcatacacctgtaatcccagctacttgggaggctgaggcagaaaaatcacttgaacctgggaggtggaggttgcagtgagccaagatcacgccattgtactccagcctgggcaacagagtgagactctgaatcaaaaaaagaaaaaaaagaaaaaagaaaacctaaatggaggcatgcctcctggagagaagggctgatgggcagtttacattccttatttccattctgttcatttaaatgaaaaagtttatttctcaatttctaaattcttctatctgaaaatgcatggatttagtgctgtttatatatttttgtgagtacggcagcttttcttttcttttaccctgattatcctaatactgcatagaggcagctacatttatgcatgattatcatcaaacagtaactggagttttccaagtaccacagaacattatgcacatgtcagttttctttatgaaggtaatttaggcacaagagtttgcgtcttggataccaagtaattttatttgtagctacctatatggaatttatcaggggaaagtatatcttgaagttgttgttttttttttttttttttttttttttcatttagttccttgttttcttttaaattcctatcaaagctttaagaaatgaactagctgctggtgttgtgttcctggacttgagcactagctgggataatagagcagttaaaagctgacaattgcactaacttttggactaggcccaaaccattaggtttgatgccccttcaggttttctcattttctctgccctaccagcccacatgatatttttttaaaagccacgattaaaaggtacagttatacatcctgcagttaacctccattctttttgtttattgtgggaggaattttcagactgtacctcttgggaaatacaaaatattatagctttggtccaagaaggagaagactaatttagaattttttcttttgttttctgttttttaaaaaaaccaaatacagagaaataatgcaatgtaattattttacattgtattaagaagatggaaactttctccttgccataatttgctttgctcaaaatctaaaagtatccatgccctgactaactcctgcccatattcattcttacacattgcaggtaaatggtatccctgaagaaagaaaactgactgaagcaatgaatttataatcagacaatatagcagttacatcacatttcttttctcttccaataatgcatgagcttttctggcatatgttatgcatgttggcagtattaagtgtataccaaataatacaacataactttcattttactaatgtatttttttgtacttaaagcatttttgacaatttgtaaaacattgatgactttatatttgttacaataaaagttgatctttaaaataaatattattaatgaa

SEQ ID NO: 36639 - DNA, 31134 bp, Homo sapiens
gaacagcgaagacagcgtgagcctgggccgttgcctcgaggctctcgcccggcttctcttgccgacccgccacgtttgtttggatttaatcttcaggttgccggcgcccgcccgcccgctggcctcgcggtgtgagagggaagcacccgtgcctgtggctggtggctggcgcctggagggtccgcacacccgcccggccgcgccgcttgcccgcggcagccgcgtccctgaaccgcggagtcgtgtttgtgtttgacccgcgggcgccggtggcgcgcggccgaggccggtgtcggcggggcggggcggtcgcggcggaggcagaggaagagggagcgggagctctgcgaggccgggcgccgccatggaactgggcccggagcccccgcaccgccgccgcctgctcttcgcctgcagcccccctcccgcgtcgcagcccgtcgtgaaggcgctatttggcgcttcagccgccgggggactgtcgcctgtcaccaacctgaccgtcactatggaccagctgcagggtctgggcaggtaaggagagaccggcgggcggtgctccgggcccctggcctcggtgtcggcctcggagagatcaggccaggaaacggaccgggagaagggcgagacccgtccgtccgggttcgccgctcggggacagccgggctagggcctgccatgtgcacccccgcccgggcggaatgttgggcgggagaggccgtcgggaccttccaggggaagaggtggagatccttgggcctaagcccgagccaggcccaccttcacccctttcggattgctccgtactctccttctatctctatccctggaagctctttggaatctacccccgcggggaaaatcaggctcttctaggcactcactttcaccctttgctaaaccatcctcaggatcttcgtttgctgtgatctttgttccttctcaacaaaggaccatggcattttctttcctggcgtttatgtaaaatcatctcagtccctcgccctgtgcacattcctgatgtccactctgctgctttcctaaggccaggtctttttacccaactttcagaaagcttcctgggcttttcctgatagcaaaaaatgcatcccacggtgtttcccgcggaagagctactttcccttcaatctctggcatcccgtttgctaagcacatgtcttgtgcgtttcccaacttctgaaaagcagaaagtgtcctgttcaactttcatcccgactctgtctcagtacttagaacacatgcttttattttaggaaataccccaacatttgccatagccatcataacctgcaatgtggtccaaggccatgcccacccactccttttttctcctttgcccaagtgctaattgggtgttcagagtggcaaagtgggatctttgccacttgtggtgtggcctagaaatggtttctggcagcctggctgcttcttaatctcatggcctatctcctgcatgtgaccttttaattatatcctataaatcattcatggtttatttctgttggtttcagtgattatgagcaaccactggaggtgaagaacaacagtaatctgcagagaatgggctcctccgagtcaacagattcaggtatttaagtctgctgtgtggggagcaatactctgaatttcctgaaacatgccttttcacccaggaggttagttttggtgagaacttgaggaagtcatggcattgggtgataaacttttttttttttttttttgagacagagtttcgctcttgtcgcccaggctggagtgcaatggcatgatctcagctcactgtaacctccacctcccgggttcaagtgattctcctgcctcagcctcccgagtagctgggattacaggcatgcaccaccacacccggctaattttgtattttttagtagagacagggtttcttcatgttggtcagcctggtctcgaattcacaacctcaggtgatccgccttcctcggcctcccaaagtgctgggattacagcgtgagccaccgcgcccggtgataaacattattgagaacaatacaaaggagcccttgtggctgtttatgaagaaaggaaataggtttcaaatgtctataaggaggtggtgtgtgcttgcccttgaaggatgggtagtaaagtataattcaccataccactgtaagtggcattcaggcaatcttactggttaaaatacaggatcaaatgattggaagtacagtgtcatgaaatcatttcagtgatgctgctatggaggaaattgccagtgcatttcattcttcatgaattcatattactgcagagtttatctgtatttgtacagataagaccattggtgcaaagatcctttaggttaaaggaactgcaagagcaagtcttaaaatgtaatgtaggcttctgtatgtagaatgtaatttaatatagaactggggataggattatcacttgtagcagtgtggtgagcaagggctgtaacacctcactttccataaggctgtatagacacatgagctatgggtgggtgggtctgcgtcatctgagctggcatattagtaatgctgaacagtgtctccttcaccctgctgccttttgtgagatggacaccttggtgtcattttgttaaaggcagcaagtgcttgccttgcatgtcatgaccagtagttgtatttttctttttcattttgagacaaggtctcaactctgtcacccaggcaactctgcctcccagatttagagaattcttctgcctcagcttccctagtagctggaattacaggtgtgggtctcaaacttctgatctcaggtgatccacccacttcgacctcccaaagtgctgagattacaggggtgagctactgcacctggcctttttttttttttttttttgagacagggtcttgctctgttttccaggtctcaggctggtgtacagtggcacaatcagggttcactgtagcttcaactttccgagctcaagcgaacctcccactccagcctccccaagtagctgggactacagacacgtgccaccacacccaactaattttttttttaactttggtagagtcaagtctcactatgttgccccaggcttgttttgaacttgtggcctcaagccatcagcctgcctcagcctcccaaagtattggaatcacaggtgtgagccactgtgcctggtcagtagttgtatttttcaagcctcatatgatttgacaaggtaaaacgtttaaaaactatgccaagaaaatctggtacctattgtttctatggttggaactcacagaaagttatctgggtcacctctatctgaataaccaaacaatcatgatatgaatcagttttattcaccctcttctcaaatcctatttcccttgatgttatttgcaaataggagaaaaaacagtaaatacgctatgaaaatattaagacttgtacaaacatgacatttttgacaatctaatagacgtaacatcaattctggcaaaagtacaagccatgaatatttgttgcctgacttaaataaagacccaggtactttgtttagtgttttaattttaatgacaaaatggtgttttttgtattatttcttgagaggttttttttttccccataggtttctgtctagattctcctgggccattggacagtaaagaaaagtatgtattcactgctttcaaatgtttatatgtagaaaaaacgtgtctaaacttaaataccttatttaaatgaagttcttcatacactggactggagccctggatttacctgtgcctagaaacactctggaatctcaagaatgaatagtttgtgtcagcaattttcagaactttttctcctttattttagctataattttggtgttctgtttgggtcttacccaaacccttactctgtgctctgacatcatagccttacaagaacatgtggggtttttttgtttgtttgtttgtttgtttctgaggcagagtctcactctgccgcccaggctagagtgcagtggctcactgcaacctccacctcccaggttcaactgattctcctgcctcagcctcccgagtagctgggactacaggagtgcaccaccacacccggttaatttttgtatttttagtagacacgaggtttcatcgtgttggccaggccaggagttcgagactcctgacctcgtgatataccctcctcggcctcccatagtgcccatagtgctgggattacatgtgtgagccaccgcgcccagccgaatgtgtgtattttaagaaaagacatgggtttgttttttttcacctagaagtctagtgttgggggtgctcctgagaacaggacagcttcagaaatttattctcccatctcttgcctaaaatgggagtctgtgactgtacccccaagctacaggctaaacactatctctctgctaatatgaatacctctttacttgttttattctcattatttaccttctgatctcattacagccttgaaaatcctatgagaagaatacattccctacctgtaagttagttccttgtttattttgagctaatacctgttatctgttccttagctaccagcatgaccttgataggagacttaatttagagagtaaaaactgcttttctttagtctcttttgagacaaggtcttgctctgtcacccaggctggagtgcagtggcaaaatcttggctcactgcaacctctgcttccctggctcaagtgatcctcccacctcaacttccagaggagctgggactatatataggtgcacaccatcacacccggctgatttttgtattttttgtagacatgggggtctcactctgttgcccaggctggtttcaaactcctgcctcggcctcccaaagtgctaggattataggcaagagccactattcccagcctttccttagtctcataagtactcaagatgttcggtctggaggaatttgtcctccatctctaacagagctttattaaaccaggaagggttcttttgatgcaaatgttatttggggattgatttggcactgtaatccctgttgaggggggcactgtagaccttgtgaggttagctgtaaacccatggaatggaaacttctatgctgtgtcctggctgtgtcctggcaaggtggattcctggccacatttactggttacctactgcagtgtgtgaggagctagtctaccccctattcaaccccccttttttttcttttgagaactgaattttccactgaaattttatttgtgtgccttaattattttccttttttactttgatagcagaagctgttgggatgtagtccagctctgaagaggagccattctgattctcttgaccatgacatctttcagctcatcgacccagatgagaacaaggaaaatgtgagtgtgacttcaatgtactaacctgaggcagaggtgaaacccacaggctgtcagtggcttagaagtggctgggctgctttctgggagactaaacttggccattatgtgcggtctttggagtcagagaattctgggtttggatcctgcttactagctgtgtgatgttggcaaattcttctctttttaatctttgctcttttgtaaaataggagtagtaataccttttagggatgttgtggcaataagtaagattatgtatgaagtattgaaaatggtgcctgacaggcgggagttgctcagattgtagctcacaggagtaattacatgtacaaatagtgtttgtctggaaggctctgcccaggctgtccttgcctctttgctctgaccctgaaatgaattgtaagcttaggaaaaggctctttggcagtatttgtaagaacggggtcaacaagttctagggaatctcagagtaactgaaatggtggcttggaaggtgaatttctggttatctaccctgaatgagcctggcttttttgttcttttagacattgcacagagtaggcatccaaaacagttgtaattttttcagccttctctctactgtatttctatatatttactttctccccttttccattcctgctgaaatgccacagttcataatccttgtccttacaatcttcaggtttagtgtgaaacccactgcctccatgaactctcctgatgatttctttatcaacctgggaagtgtcatgagaaagaatatggaaatgagttccagccttgagtgcttggaacagtgtatcagcctctagtgctttttaccagggcaaagctgtactgatgcctggttttcccccgaaatagcttctcagggttgcttgcctggagctttgttttaaagggaaaacagcatagatggtggttaaagagctctcactctggagttgtcctgttttacttcaatattttgggcacattccttaacctgcaaggtctagttttctcacctgtaaaatcgggacaatcaggttgtatttgatggttaaaaagttaatgcacagaaagtacttagtactgtgttggcatagaaatcactgtaatattagccattactgctttttttttttttttgattcttcatggttttatttctctcagaactttaaaatgtgaacattctataattcagccagtctttacttccaggtaacttctttattgggtcgcaatacccttttaaataacatgctcttgttccggaaggtagttagccgttcatcactctttctgtctaaataacatccagtgacaaatcccatagggacaagaacatgaacccagtggtcccgcacaatctgaagtaagttcaccatgatagctgcagcctcagtgccgaccgcgaccccgagaccaagggcaacggggaactcagccacccacgccagtgctagccattactgcttttaatacttaattatgagttcttaagtgaatattttagggcaagggacctgtgagtgttttcattccataaagtggaatcatacgatatgtattctatcatatctggctttaaaaaacattatgcttgtaagaatcgtccacgttgagtaaaccagtagggcttttttttttttcattgcttttagtatagaatagaataattataagtagaaaaaattatctccagttggtaggaagaggtggaaaatatgaagccctgaaacagatggacctagatggaaaattttgacaactattcacaggcaattatattagattttatttatttttgctttagatttcagaaagtttgtgatttagcttattcatcgtgttttgtatatttggcagatacttgtgttaggaaatacagtatgacaagaaaaagatgttactttagaagttagctgttgacagagccttggaaattcttagttacgcagatctattgttggaattaggtgaaactttaatttggaggcagaaaggtgatcagtgcccactttcttgcctctttcacccaagctgaggcctgagttggttttcatggacagtagatgtctcaactatgtcttgcaggaagcctttgagtttaagaagccagtaagacctgtatctcgtggctgcctgcactctcatggactccaggagggtaaagatctcttcacacagaggcagaactctgccccagctcggatggtatgtgctctggctttcataggggaattcctgacaggaagaaaggattaaaacaccttctttcatccagaattgaaggcactacagtagcactagctgtttttaccttgactttgtcttttgaaattagactgtcaagcattcttggtggttttgctgtgtctggagaacagacaggcggtagtaagagtgggagatggtgtttgaaatattggagttgtgcaaggaataatcgaccttgttaatctgggaaatcctgggtcatcctaaatgtatgtatggtgggattatatctcttcctatttttttctttttttctttttttttttttaagggctttctggcaaaaaccggaaagcctgcgagacaaattttaaaagagccgtaacactagatctcttacttaaaacttggtctttactatgcattctaagtgcttctcaaggaactggagagagagcacttgacttcttccaaaggtggtttgttaagaacagttatgggccaggtgccatggctcatgcctataatctcagcactttggaaaactgagacaggaggatcgcttgagtcctgggcagcatagtgagaccacatctctattttttttatttttaatttttttaaagaactattatggattacagtgaatgctcaggctgctgggcagttttggggtcactcgtttcagggctatgtatttgccagacagggactgtcattacttccaaagtttcctgctgttggtctgaattggattaactgatagcatctatagattggagaggcccaacttgagcaagatgaccacatttggcttccaggtttacctaggatcttaaatctgaaaatatacctttccaatctgctttgtgttctgaggttcagccagtattgttactctgtctatcatttgcacaaagcacttttatatgttcttgtcttgtgaagtggagttaatccacttgaacagattaggaaagtaccactagagaggtttggatgatttaccaaaggatatacataagtaggaaaccaggatttaatgatctctggctgggtgtggtggctcatggctgtaatcccagcactttgggaggccgaggtgggaggatcacatgaggtcaggagttcaagacagcctgggtaacatagtgagaccctatctgtacaaagttaaaaaataagctgagtgtggtggcttgttcctatagtcccaattagtcgggaggctgaagtgggaggattgcttgagcccaagaattcgaggctgcagtgagctatgatcagaccactgtactccagcctggacaatgaatccctgtctcaataaacaatctctaaattcccaagtacacagtaatgctttaagagttgggtatcagaaacaatatatttggtgtgtgcttagcgactagagcctgtatcacatctgcacctaggaatcccagaacatacctcacaaatgttggtgtgatatagtgtgagctttcgtgataaaggtactgccccataataaagttatctacccctaggctaaaaaaatttgccatttcccagagtgtgcacttggggaggactagagactgctcagaacttgttttatattgtgaagcaaagctaatgccagaaccagaataggccagctgcagagaggattccttggtgcatgatccactcagaaaatcagagggccacttaactaacaacagattcataccccaaagagatttggattttaaggattacttgtaggtcataacattgggactaccctgctactgtgaaaaaaataactctaaacttttttttctggatttgaaagtgcctagaaaataaataattcagtattagcagtgtttgtattggtaggatttatcttcaggtgtggatttatgagcagtttttctaaattttctatattccatgtttagaggtttcccaaaaaaagtatgactataggttggctaatgaggtaccgccattttaattccaggaatggttttctcctagggagatagtgtggtgagaagagtttggattttggagtcaaacagatgaggtgtataatcttggtaacctcttaagcaccagtttcctgatttgctaaagaaaaaggaaaggattagctacctttagtgtattgtgaggcttctattggattatatgtataaagattatatcgtagtatctggcacacagtaattcctcgtttaaaaactgagcatttaaatcccaagtctaaagaacgaggatagattttatagaaggaagttaccctttattcccccctgtcagaactggagttatatataagtgcattctctaggccattttatggtctttatagagatttgcatctgcttgccctaactcatttcagcagattctcatactgtcacagtcctcaatgctgatcggtgttcactgatgcaaccttctaataaaagaaaccttgttcttcacaagaggctatctctagtacccattataaggtgaattgcttctggcaagagttctctgtaaaggctactgactactcagggctgtgtgtggtcatcaaatcatttataatcttgggatacattttcatataatcagtaatggctaaaattttgctttgtataacaagtataacatagtatgttttcatcataaaaactagtgacccattcaaggaaatgaaagtggatcagagctctcattattaatccatgaattttgtcttacagctttcctcaaatgaaagagatagcagtgaaccagggaatttcattcctctttttacaccccagtcacctgtgacagccactttgtctgatgaggatgatggcttcgtggaccttctcgatggagagaatctgaaggtaccgtgtgtgtgtgtgtgtgttcctatttgttctactaattaattacctctggagaaggcatgtgatgtgaaaaagaacagcaacagcagttccccggggcttgcttagctgatatttttgttcatttggtgataattcatttaataatagggctaccagccttattaaatcctttggattgggggatgggggcatcaaaagaagacacatgatccttcttaccctgaaggagctaactaacaatctatatgcaagaaacatgaaatcagaacggtataggatggtacattaaggatacttcctatccaggcctatctggtattgttcagggagaaacacacctaaagcacttaaacaaatgttagtctctacaggctctttttaaaatcagtttttctgtttctttagaatgaggaggagaccccctcgtgcatggcaagcctctggacagctcctctcgtcatgagaactacaaaccttgtgagttgttctagtgtgtctggaggaagccctgcgtgattggggcactggacagagtagtccttagttgagtatagccaaagattgaaatgcatgataggatttggggatctgggttttaggcctcactttggctacctacaaattatgacctttagtcatgatatctctctgcatgtctcctgatgtataaggagtgtgggttaggagggaccatggtcattcctagcttttaccatctagtcagtttgaaaaaagcctatctgaagcctttagcctgaatactttactttttttaggttattctcatttatattccacagaacctagcataaaattagacaagcaacagtaactcacaggattttttttgtttctgtgttttttgtttttttttttgagacggagtctcgctcttgttgcccattctagagtgcagtggcacaatcttggctcactgcaacctctgcctcccaggttcaagtgattctcctgcctcagcctcccgagtagctgggattacaggtgcctgccaccacacccagctaatctttgtattttcagtagagacggggttacattatgttggccaggctagtctcgatctcctgacctcaggtgatctgcccacctcgacctcccaaagtgctgggattacaggcatgagccactgtgcctggctggatgttttttgttgctgttttgtttgtttgttttgttttgttttgtttttcattgaaaatacctacctgaggctgggtattttcaggtagatattttcgattttaaaaattatatataatatatattttatatatatatatatatatatatatatactcacacacacacatacacagtatagatttgtgtttccatcagggatactttcaaacagaaagcatagtatatgtagatacagaatctatagtgtatgtgtgtatatatattcaaaatcacatatatatacacacacatacacatgctatagattcgtgttttcatcatagggatactttcaaagttagaagcaagaatgtgcctatacagatatatacacctgtatgttcagagatatacacccttaggtacacatctaaattgataagttcatattttttaattctcaataacctgaactataattacagaacaaatgagctacagtttttttgtttgtttgttttgttttgtttttgagacagagtctccctctgttgcccaggctggggtgcagtgcagtggtgtagtcttgacttgctgcaacctctgcctcctgggttcaagtgcttcttctggctcagccttctgagtagctgggactacaggcttacgccaccactcccggctaatttttttggtatttttagtagagacgaggtttcactatgttggccaggctggtctcgaactcttgacctcaggtgatccatccacctgcctcccaaagtgctgggattacaggcatgagccaccgtgcccagccaagctacagttttgagatcacttatggattatagtacattcatgtgcatagcttttgagaaaatatgttaacgcagtacaaatgttatgagtaaatttaccaggtcattttgataggcataaaattacataaaatgtgagaacactttggaagtggctgttagttttatagatttgattttagagtcataagcatgggcttgtaagctcttaatagtggggaaatgtcttccacaaatggttattacaaactaaccattgctgggagctgtaatggaaaataaacttcacacaaaagaggaagaaaatccccggtctctatgggagcagatgtgggagtgatccattctactggggactatcaggaagatttcaaagaagtgacattgaaatgttagcatcaacttgaaaatgaatggtttactgagatgtgaaaggacattctgtgcagaaggaaaagccaggccaagacacatggagtcgagaataggctgagatgcgtttagagagctgactcttgctaccactggtcagattggcttcccttgggctctggaaaatttgtctttatttatttatttatttattgagacagagtcttgctctgtcacccaggctggagtgcagtggtgcaaatcttagctcactgcaaccaccacctcctggtttcaagtgattctcgtgcctcagcctcctgggtagctgggattaaaggcacgcaccaccacacctggctaatttttttgtatttttaatagagatggggtttcttcatgttggccaggctgttattgaacttgtgacctcaagtgatcccacagtgttgggattacaggcgtgagccaccgcgcccagcctgggaaattagtctttaaaagaccaagtagaaaaaaagactttgaacacaattttgaaaggcatttgctactctgcccatccccactccctccaaatttaccatcttaactataccttaaccaaagatgcccccatttttattataacctggctactgtgcatcttttctggatttaagtggggtatttaaacccgttgacctgcttaattaagcaaggtgcaagtaataaaatggaggggaagataggcaagccaaaaatgtgttcctgactggaaggtcacacttctcttgacgcaggattatgtagacagtttttgtgagggcaaaggacgttttgctcatctctatataatgtcagctgagtatatattcattgagcactaagtgctcagtgcctactatgtgccaggccctgtgagagttgctaggactagatgaatcggcagtgtctgttggctaatttagaattgatcttagatcatcccaggaaaccttcggtttatttgtcttaccattcaagtgaacaggttttaatgaaagatgggtctgtctgttttttttcctgtaaggacaaccgatgcaagctgtttgactccccttccctgtgtagctccagcactcggtcagtgttgaagagaccagaacgatctcaagaggagtctccacctggaagtacaaagaggaggaagagcatgtctggggccagccccaaagagtcaactaatccagagaaggcccatgaggttagtttcctaggttcctttttgctctagcacagatactgtatttttcagttctaaaaatttctacttagtggttcatttattttctttgctaagatttgctggggttttgtggggttgtgtgtgtgtgtgggtgtgtgtgtgtttcttttaatagagatgggatctagcgatgttgcccacgctggtcctgaactcctagcctcaagtgatcctcctgccttggcctcccaaagcactgggattacaagtgtgagccaccacacctggctgatacttggctgttttcatgttggtttttcatttgctttgagtatgttcataattgcctgttgaagcatttttaagatggctgctttaaaatctttgtaagacaaatccaacatccatccatagtgttgttggcatctgttgattgtcttttcctgttcaagttgggatttttctggttcttggtatgaccggtgattcttccattgtctcctgtatatttgtgagtctccggtctatgtaaattttacgttttagcaggcttcctctgatactgcaagaaaggcatgggtggaagtccgggttccccagcacaaactccattgacaccttgggtggggacttgtctcattattgctgggagggagtggaagttcattccatccccgtggggtggtgactggggcactgtatgacagctgggcaaaggtggaggcccccgcttgctgttggccataattgtttctgtgttgactagtagaatgattattgtctaaaagtcttctgcctcaataggccatcctttgcctagggagagcaggcttttcttggggcttgttgtgttgctgtctccagcttcatgagttgaatggttaactcattcgtttttaattttcttatttctggataaatctatttgaatctatgaatttcccactgctttagatttgtctcataacttttgacctgaaatgtttttattatcatttgttgtagatattttatttccttttaatccagacctatcatggcctattaaatacttgatttttataaaggtctgtcttttttttttttttttttgagacgctctgtcgcccaggctggagtgcagtggcgcgatctcagctcactgcaagctctgcctcccgggttcatgccattctcctgcttcagcctcccagtagctgggactacaggaccccgccaccacgcctggctaattttttgtatttttagtagagacggggtttcacagtgttagctaggatggtctccatctcctgaccttgtgatccgcccgcctcagcctcctaaagtgctggaattacaggcgtgagccactgcgcccagccctgtctgtctaattcttcaagttaattcattgcattgctcatagttgtataggctgttttgttgtttcctgtttctgagacagggtctctctgtcacccaggctggagtgcagtggcatgatctccgctcactgcactctccacctcccaggctcaagcagtcctcccacctcaggctctcaagcagctgggactataggtgtgtgccaccaaacccagctaatttttgtattttttgtagagacaggctttcgccatgttgcgcaggctggtctcaaactcctgggctcagggcaatcctcccgccttggcctcccaaagtgccaggatcataggtgttagacacagcacctggcatgggtgagctagtgtcatggttgtctgggcctaagtcctatggtcctttgtgttattttttctatttattctgtggctagacacacaaaacactggtttatttgtatgtttttccttcattatactgtccttatattgaggtttggtattaagcattataaaatggtgaactacctgtgttttctgtggcatgaaaaggtttaagtaaatctcatcacagtcttaaaaggttagagagatgacagctaggaaaacatttagcatttaggcctactgccttatcgtatctgcttttgtttttaatgctttatgaatgtttttaaagtattgttctaaaagaatattttaataattgcatagtatttttgttttgggagagttgtttggttttggtttttgttctttttgtttgtggggggcacagggtctagcgctgtcactcaggctggagtgcactagcacgatcacagctcagtacagcctccatgggctcaagcactcctcccgcctcagcccccctagcagctgggactacaggcatgcaccaccatgcccagttaatttaaaaaaaatttttttttattttttgtagaaaagaggtcttactgtgttgcccaggctggccttgaattcctgggctcaagcagtcctcccacctcagcctccaaagtatctgggactacaggcacaggccagtgcacctggccgatagtgttttgacttacaagtatactagaaataattgaataaatcaccttctggacatttagaatttcccttcccctgattttccttttatttctaattaaaaatgaaattctgggttataagggcaagaacatttgtgaaactttacattgtatacatgtcagaaaatatctatcaatatttaataatattctggctgagtgctgtggttcactcctgtaatcccagcactttgggaggacaaggcgggtggatcacgaggtcaggagttccataccagcctggccaatatggtgaaaccctgtctctactgaaaatacaaaaaatagctgggtgtggtggtatgagcctgtaatcccagctgctcaggaggctgaggcaggagaatcgcttgaacccgggaaatggaggttgcagtgagcagagatcacgccactgcactccagcctgggtgatagagtgagatttcatctcaaaaaaaaaaaaaaaagaatattcattttctttttctttctttttgagacacgctggagtgcagtggcaggatcttggctcacggcaacctccgcctccccagttcaagcaagtctctgcctcagcctcctgagtagctgggattacaggtgcccactgccacgcctggctaattttttttgtatttttagtagaggcggagtttcaccaagttggccaggctggtcttgaactcctgacctcaggtgatatatccgccttggcctcccaaagtgctggggttacaggtgtgagccactgtgcccggccagaatattcattttcttttaccgtaatagagattgacctttttatttccatatttgtaaaactttttttggataaaataatactgttaataattattttgtatatatattggccctcatgttttggtttattttcatatattttaatttttagtattttaaattccattgtggagaaaatgtcaagcattgctagagtacagttatcatacctgtgatattgtgaaatatatatttagtcttcttccccttctgtcatataactcctaaaatctttggaatatccaaggtcatatctttttgtatactaatgattgatagcttcagggtgggactggtcactggaaagacagagacatgattagaggttggaactttcagccccaccctccaatatctacggaaaggagaggggctaaaggtcaagttgatcactcatggccaatggtttaatcaatcatttctatgtaatgaagcctccctaaaaccttgaaaggacagggttcagagagcttctggatagctgaacacatggaggttcctggaggttggggcacccaaggagagcatggcagctccatgtcccttctcccatacctcaccctatgcatgtcttcttctatatcctttgaatatccttcataataaactggtaaatgtgttttcttgagttctgtgagccacttctagcaaattaaacccaaagaaggggtcatgggaacccctacttaaagctggtggtcgtagatcagaagatccagaggcccaactggtgtctgaagggtggtgtggttttgaggactgggccctcaacttcctgatctgacgctctgcaggtagatagtgtcagaattgaattggacggcacccagctattttccactgcagaactgcttgcttgcttgcttgcttgctggtagggagaaatcccctcatatctgggggtaacagcacttctgtcttctgttgctgttgagtgagggaataagaaaaatcactttgagtttgtggggtgttttcctcacacaaacatatcatacagggctaaatttctgggtgtttttttgtttgtttttttttttgagaccaagtctcgctctgtcgcccagactggagtgccatgggtcgatctctgctcactgcaacctccgcctctcaggttccagcaattctcccgcctcagcctcccaagtagctgggactacaggcgcccaccaccacgcctggctaattttttatatttttagtagagacggggtttcaccatgttggcaaggctggtctcgaacccctgacatcaagtgatccactcacctcggcctcccaaagtgctgggattacaggcatgagccaccacgcccggcagagctaaatttcttactatcaaatgtcaaatatccagtctgggttcagttttccccagttgtctcctaagtacttttacagtttatttgttaaaatctggatccaaataaagtctatacactgtagttggtcaataggtctcttactcttcagatttcagtgctccatctgtttccctcttgcatatttttatttgttgaagagctcaagtcatttgtcctgcaaaggttcccacagtcctgtggggtcttcagacattgtcttctatcccctatattgccttaacctaactctggaaaggatggattgaattccagttctatttgtttggcaagaatatcacataggtgattttgtctactttgatcaggaagtataatgtgccaggcagccattggtgattgctgcccagattttttacttcatttcaccagggtttcagaaagatgatactgcagtttttacattctttcctcattaattagctagaatatatctataaagagaaacttacactcatcaaacactgtggttacccttgggaaaggcaggatgaatattggatctctttatttgccagtttccaaataatgccctaccaagcatcttccaaagttgaaagcaagacttatagttgtttttcaataataatcaggaattcatgggttaaaacatttaatgtgtttctgtgtattacaagtattatccttttactcaaattatcccctttttaacagctggcttcctcttctcattgaataaagctaagacgtaggccgggcgcggtggctcacacctgtaatcccagcactttgggaggccaaggcaggcagatcacctgaggccaggagttcaagaccatctggccaacatggtgaaaccccgtctctactaaaaatacaaaaattagctgggcgtggtggcgcacacctatagtctcagctgctctggaggctgcggcagaatcgcttgaacctgggaggcagaggttacagtgagccaagatcactgtactccagcctgcactccactcctgtactccactgcactccagcctgagcgacagagcgagactctgtctttttaaaaaaaaaaaaaaaaaaaagttaagacatactttttctaaacttaatcctagttttaaccccccttgtttctttctctttttctggagatagtttcagtctgtcacccaggctggagtgcagtggcaccatcaccacttgctgtagcctcgacctccccaggctcaggtgatcctcccacttcagcctcccaagtagctgggactacaggcacacaccaccatgcccagcttgtgtgtgtgtgtgtgtgtgtgtgtgtgtgtgtgtgtgtgtgtgtgtggacagggtcttgctctttgatctggtctggaactcctgggctcaagcgattcacctgccttgcccaggctggtctggaactcctgggctcaagtgagtaacccaccttggcctcccaaagtgctgggattacaggcatgagccaaaccacctgcaccccctttttttttttttttttttaaggaaggaaggaaaacttagtttcagagcaattcggttagacactggaataataggagacctagtcaataacccacatctgtttttgttcactccagattcaataaaataaaataaaaacttcttactaaatgtaggcattaacattttagtctcctcgagacatgctccaagtgaatgttttcggaagttccattcagaacccttgtctcattctctacctttgatttgttacagactcttcatcagtctttatccctggcatcttcccccaaaggaaccattgagaacattttggacaatgacccaagggaccttataggagacttctccaaggtaattgcaagcagagctgctctggcaagtgtaggagggagtgtgggtatttagaatcccactcagcctgtctccctccccagggtggttcctggcatacctccaaaaggacacagttaaaagaatgttaaaggtagggaagcaaacttagtttctcatgatcaggtatatgttggtttctgagactgtagatatcactatagctgatgggcagttttaggtagggagctgtccaccaaccaccttgattgtaacccaaagactaggctctctgggaactgtgttattataaaaatagtaattagcaggatagtgtacagcagaaataaatctgtagccacactacaagtctgcatgttgaaaggttatcttagaaggtctgggattgagactgaatttctccgttcagagaagcttggccattgagggaaaagaccctccaggaagtctagaggaagatcttctaatagcctgatatactacatgaaggcttggctgcagtaaaatacaaggctaggacagggaatgtgtcaatagcagcttctttaatcacattttgacttgaaggttaccagatcaatgttttattcattaatttagttaacatttattgaagcacttatgtgttaggcagagattccaaaatgagatacagttccttccctcaaagaatttagcatgtggttggagaggtgagacgtgaactacatgtaccacatggtagactgaaataaattttagtgaggtgtaaacataaacagcatgccgtgagaagtaaaagggtttatcttggctagggggttggggaacgtctggggttgggccgttgatatttcagcccaaatgggttttgaaggaacggagaatgaagagaacaagcaaagatccagctgtatcctcagttttggaaccttctcttgtttggcagggagagatgtggtcttactatgttgctcaggctgtagtgcagtggctattcgcacatgctatcatagtacactgtagcctcaaacttatggcctcaagtgctccccctgcctcagcctcccaagtagctgggactacaggcatgcaccaccacactcagtggaattttcaacttgaattgaggcctggttatatttgtcttaatgggcctatgcatggggatagatgaactcttggctcagccagtcaccctaatgagtaattgctaatgtgtgcatcttcctcctcaaggctgggctaggtctctttttttcctatccccagtgcctggcaccatgctggacatagcaggtgctcagtaaatgagtgaaatctgtatgtttaagtgctattcgcagtctaactactgacgtgtggattcttgacaaaagcaggaggaaaatgagattacctgaggtttctttatttaaatctgccttactagctaggtaaccttggataaggtgctcaaaatggggataatatacctcattggtttgtgtgaaaattaaatgtcaggatgttaatgaagtaactagaagagtaactagtgtgtactaactaatgtttgtttgcttgtttgtttgtttgttttttgagagggagtcttgctctgtcacccaggctggagtgcagtggtgcaatctcagctcactgcaacctccgcctcctggattcaagcgattttcccactccagccttccgagtagctgggactataggtgcatgctaacgcccggctaatttttgtatttttaaaagagttggggtttcaccatgttggccaggcttgtctcgaactcctgacctcaggtgatccactagcctcggcctcccaaagtgctgggattacaggtgtgagccaccgtgcctggccattaatgtttgttttttaaaagatgcctcctaccagccagacaaaacagtataagtgtgaataatatataggctttcagattctctaagtatctttttttctttttaagggttatctctttcatacagttgctgggaaacatcaggatttaaaatacatctctccagaaattgtaagtccatccttttgaaacccaccacacatcgggtacttgaatctagttttccctgacggtcaaagttgattctccctaattttctctcaacagatggcatctgttttgaatggcaagtttgccaacctcattaaagagtttgttatcatcgactgtcgatacccatatgaatacgagggaggccacatcaaggtatggattcctgagacttgctgtagaaggagccctaaacaggatctgtggttttaaagtggggaggacagtgacacctggccacttagctcatatgctagttgttagaattttgaaacaatacagtgagtgtggaaggcatttgattccgggtgctcttaacgaatgttcccttgtctgcaatactctctaccaccttgtgcacagttattcttcatgtttgtccctcacaccatcattatcaaggacacttgtaggaggtacccactgatgtttaagtcattcgggggacaagaatgggtttcatagcatttaagaggcttgggtaccaatgtctgagcaccccagggctcctgatgaggagaagaccatctctggcaacatgtcctggtgtctgtgccaggcctagtgatgcctccaaagttgattgttcagcaagctgcctggtggaggggcgtgttgggacacacgttcccaagaagaaaggaactgattttgccattttaatctttttttttttttttttttgagacagagtccgctctgtcgccaggctggagtgcagtggcatgatctcggatcaccacaacctctgcctcctgggttcaagcaattctcctgcctcagccttccaagtagctgggactacaggtgcacgctgccacgcccggctaatttttttttttttttagtagagacggggtttcaccatgttgcccgggctggtctcaaactcctgagctcaggcaaaccgcccgcctcagcctcccaaagtgctaggattacaggcatgagccacggcgcctggcctgccattttaatgttttacccgattaatagtgtttaaatatagtaaggaggtactttaaatacgatgttactgtttgccattgtcttgtggcttttgaaaatccccaaatttataaaactacctataaagtgtaccattgtcatatttgaattgcccatttccagtccccatgtgcattactgtatgatgaacgtgtacggacccacaaagctccattgagatacaggtgccaaatggtctactgggctattcagctagaagaactgcaaaaatcacaaactggtcttgtggacttaaagatcactcttgatgaatcattacatcttgctgaatcattacttcatgtgtgaaacgtgcaggttccaagggtctctgttgtcttcacagggtgcagtgaacttgcacatggaagaagaggttgaagacttcttattgaagaagcccattgtacctactgatggcaagcgtgtcattgttgtgtttcactgcgagttttcttctgagagaggtccccgcatgtgagtgctgcacggaactgggttctggggcacaggctccatgatgcttttgtgggacatggtggtttgtggcttgcacttggagcatattttagcatatcaagcaacctctggcacataacaagccattttcatatgtaattttatcctgaggtgaactttggctcttccagtctccccgactgtccttagtctgatctgtggggctactgttctcatgtgacctccttcaagtacaaagtgaccgttccttatgcaaatgccagaaaagtgtgaagttctcattctgtaaaacctcatatgatatgatgctttgaaacacttgatattattaccaatttcagggtgaaaagaaaaaagggggccaaagagctgcccatcagtcatctgtgtccattctaaaaggattgcaagcctgctgtttgtcaggcactgacaataaaaatgtaactacagtaaaacacagtacagtaaaaataccacagcgagcaggaccaacaaggaccctactgcagcagagatccaagtggggatccgtataaatgctaggaggacaggcagagaggtaggacagagagtgcagcttaactaggatggtccaagggagacttctgcaggaccacgttcttatgccacctttttattttgaaccaatttattttaaaaaacatttttaaattaaaaaatttcaattttttttttttgacggagttttgctcttgttgcccaggctggagtgcagtggcacaatctcttctcactgcaacctctgcctcccaggttcaagcagttctcctgcctcagcctcccaagtagctgggattacaggcatgcgccatcacgcccggctaattttgtatttttagtagaggcagggtttctacatgttggtcaggctggtcttgaactcccgaccttaggtgatccgcctgcctcagcctcccaaagtagtgggattacaggcgtgagccactgcacctggctttttctttctttctttctttcttttttttttttttttttgaggcggaggcacactgttttcacccagactggaatgcagtggcatgatctcggctcactgcaacctccacctcctgggttcaagcgattctcctgcctcagcctcctgagtagctgggataacaggcgtgcaccaccacacccggctaatttttgtatttgtagtagagatgggggtttcaccatgttggccgggctggtcttgaactcctgacctcaggtgatccacccgccttgacctcccaaagtgctgggattacaggtgtgagccaccacgcccagcagaaatttcaaattttgagatggggtcttaatatattggccaggttggtctcaaactcctggcctcaagcaatcctctctccttggcctccaaagtgctaggattgcaggcatgagccactgtgcccacccctttgaacctttttttttttttgagacggagtctcgctctgtcacccaggctggagtgcagtggcacaatctcgacttactgcaagctccgcctcctgggttcatgccattctcctgcctcagcctcccgagtagctgggactacaggtgcccaccatcacgcctggctaatttttttgtatttttagtagagacagggtttcaccattttagccaggatggtctccatctcctgaccttgcgatctgcccgtctcggcctcccaaagtgcttggattacaggcgtgagccactgcgcctgacctgaaccattttaaagctcaagaagaggtgaggttatggctgggcacagtggcacctgtaatcccaacactttgggaggccgaggcaggaggatcacttgctcgggagtttcagaccagaccaacctgggtaacacagtgggaccacacctctacaaaaaataggaggtgggaggatcgtttgagcccagcaggtcgaggctgtggtgagccatgatcatgccactgtactccagcctaggtgacagagtgagattctgtctctctctcacacacacacacacacacacacacacacacaaaggttatacttgcacacacttcacctgattttattaatttttaacattttgtcacatttgtatgtacatgctctacacacaggcaactacagtacaacttgacacttttgactgtcatctcataagtccttcaaacatctgtctccaaaggatgctcattcatgaatggaattattcactcagcagtttttttgtttgtttgtttgagatgtagtcttgctctgccacccagactggagtgcagtggtgcgatctcggatcactgcaacctccacctcccgggttcaagcaattctcctgcctcaggctcccaagtagctgggactacgggtgcatgccaccatgccaagctaatgtttgtatttttagtagagacggggttttgctacattggccaggctggtctcgaactcctgacctcaagtgatctacccgcctcagcctcccaaagtgctgggattataggcctgaaacaaactaatctggacacacatacacacacatgtaaattgtttttaaacccacaaaagatgctgctctcttttttttttatttttgagtcagggtcagtctctgttgtccaggctggagtacagtggcaggagcacagctcactgtagcctctgcctcccaggctcaagtgattctcccacctcagcctcccaggaagctaggaccacaaacatgcatcaccatgcctggctaatttttgtattttttatagagacagggtctcactgtgttgcccaggctggtctcaaactcctgggctcaggcaatcctggcctcccaaagtgcttggattacaggtgtgagccgccatgcccagcccaaaagatgctattctcttaatctctcatttccccatcttcctctttaacacctctaatataaaggacattattataccatattgaaacttcacctagatatacagaaaacgccccatctctgtattctgtatttgcaagctgcatgtttatatcaccatctacagataccccttacacttcgttccccacttgagtttcgccatcactggctttctgttgttccactggggaaagatttgggattcacaggtgaactcttttttttttttttttttttttttgagttggaatctcgccctttcgcccaggctggaatgcagtggcacaatctcggctcactgcagcctcctcctcccgggttcaagcatttctctgcctcagcctcccaagtagctgggattacaggcacctgccaccacgcccagctaattttttgtagttttagtagacacagggtttcactatcttggccaggctggtctcgaactcctgacctcgtgatccaccgcctcagcctcccaaagtgctggaattacaggtgtgagccaccgcgcccagccaaactccttttaaccacaggcaaatggtttaagctacgtgctgcagaggaagctgctgcccatccctcatgagcagctaacaaaggccccaaaccactgagcttcaagagaaaatcagcagatactcttggctcttgtgtaccagatacctttctagatactgagggagaagagcagtgaacaaaacagaccaaaaaatctctgccttcatggaacttacatttcggagtggacaggagatcgagaccagcctggccaacatggtgaaatcccgtctctactaaaaatacaaaaattagccaggcgtggtggcggacacctgtaatcccagctactttggaggctgaggcaggagcatcccttgaacccaggaggcagaggttgcagtgagccgagatcgcgccagtgcactccagcctgggcgacagagtgagactccatctcaaaaaaaaaaaaaaaaaggtgactgggtgcggtggctaactcctgtaatcccaacactttgggaggccaaggcaggtggatcacaaggtcaagaggtcgagaccatcctggccaacatggtgaagccccatctctactaaacatacaaaaatcagctgggcggtggcacgcgcctgtagtcccagctatttgggaggctgaggcaggagaattgcttgaacccgggagacggagattgcagtgagcctgaggtcacgcccttgcactccagcctggtgacagagtgagattctgtctcagaaaaaagaaggtgcttcagaggaaaataaggccagtggtggagctcccaggcaggctggaggaacagtagtggggctgcaggggctggcgtggggtgaacaaggggcagagcagcagtaggggcctgtagagctgtaggcctctgaaggacttggggcctcgggctttttcaccaagggcgaggcagtaagcagccattggctggatattgaagaccattcagtccaagtagaggatagaaacagggccccgaggcaggagcaagttcagcctctttaaaagccacagaaagaaacaagcccacttatgtagaaggaggtgagtgagggagcctggctgaagagaaggctggggtggagaaagcaaggggaagctggctcatatagtgaaaacttgccacaaactgtggtggtgaaggtgctgggcaggactcagatgctaggattgttggagaaaggaaaattggggaagagaccatctactggcactggctgtgagtgctgctcatgtggccaggaacttgcaactcagcactgattgtttctaagaataaatgtcaagttgggaagatgtgtataagggggacttagaccacaactgctgctttgactgcgttgccttgttgctgtgctggaaaagctaaccctgctttggccttccttcccctgactaggtgccggtatgtgagagagagagatcgcctgggtaatgaataccccaaactccactaccctgagctgtatgtcctgaaggggggatacaaggagttctttatgaaatgccaggtaagactggggttgtggagagcatctctcctcccctgcccccagtggtagactaatggatctgtctggtggtcatgactttctttccaggggtcgggggacaaggtgggtatctgctgaacccaaagaaagcccctgtagaactggctccctaggtctgcctggccgctttcagccttgtagccctaggcagagaggaaaccaggttgtgggtgtgaggcaggtgtaccctaaccttattctctcctgtcccctcagtcttactgtgagccccctagctaccggcccatgcaccacgaggactttaaagaagacctgaagaagttccgcaccaagagccggacctgggcaggggagaagagcaagagggagatgtacagtcgtctgaagaagctctgagggcggcaggaccagccagcagcagcccaagcttccctccatccccctttaccctctttgctgcagagaaacttaagcaaaggggacagctgtgtgacatttggagagggggcctgggacttccatgccttaaacctacctcccacactcccaaggttggagcccagggcatcttgctggctacgcctcttctgtccctgttagacgtcctccgtccatatcagaactgtgccacaatgcagttctgagcaccgtgtcaagctgctctgagccacagtgggatgaaccagccggggccttatcgggctccagccatctcatgaggggagaggagacggaggggagtagagaagttacacagaaatgctgctggccaaatagcaaagacaacctgggaaggaaaggtctttgtgggataatccatatgtttaatttattcaacttcatcaatcactttattttatttttttttctaactcctggagacttattttactgcttcattaggttgaaatactgccattctaggtagggttttattatcccagggactacctcggcttttaatttaaaaaaaaaaaagaagtgggtaagaaaatgcaaacctgttataagttatcggacagaaagctaggtgctctgtcacccccaggaggcgctgtggtactggggctgctgctatttaagccaagaactgaggtcctggtgagagcgttggacccaggcttggctgcctgacataagctaaatctcccagacccaccactggctaccgatatctatttggtgggaggtgtggccctgttcttcctcaccccagttccatgacattggctggtataggagccacagtcaggaaagcacttgaggcagcatctgttgggccacccccggctcagtgctggaatgttgcagtgtaggtttcccagggaaggggggtgggggtaggtgggctccacaggatgggggaggagcatgtccactgagtatcttccttatgttgctgtgatattgatagcttttattttctaatttttaaaaaatggtcatattatgagtcaaagagtatcaaatcagtgttggatggaccacccaagggtgaggagaggggctggaagccctgggcattaggagaagggagtgggtgctggcatggacatgactggatagaattttctcaggagggagcttggtggattttgaaggtaaaactttctgggtttatcatgttttaattttagagacagggagtgatgaatcatcaccggttgtccccttatctaactccataaaagtgggaatttcaaaagaacacctcatccaaggagctggggcagacttcattgattctagagagacctgtttcagtgcctactcatccctgccctctggtgccagcctccttaccatcacggcttcactgaggtgtaggtgggtttttcttaaacaggagacagtctctcccctcttacctcaacttcttggggtgggaatcagtgatactggagatggctagttgctgtgttacgggtttgagttacatttggctataaaacaatcttgttgggaaaaatgtgggggagaggacttcttcctacacgcgcattgagacagattccaactggttaatgatattgtttgtaagaaagagattctgttggttgactgcctaaagagaaaggtgggatggccttcagattataccagcttagctagcattactaaccaactgttggaagctctgaaaataaaagatcttgaacccat

SEQ ID NO: 36640 - DNA, 9131 bp, Homo sapiens
ccgcgccgccgcgggtggccgcgcgggtgaagccggaagcagcagccaggagggcggggccgcgtagggcccactggccagggagggcgccgcgcggaggcgcggggcgtgtctcctgtcaaaagccatgctcggcaggtctgggtaccgggcgctgcccctgggtgattttgaccgcttccagcagtcgagcttcggctttctgggctcgcagaagggctgcttgtccccggagcggggcggcgtggggacaggggccggtgagtggccgcctggcacggcggagccgggggggaccggccggcaacccccaggcccgaatctctgcctccgaggagtcggccggcccggtgccgtcgcaccctacgaggggggactgagaaagggatacgatgtggagagggggctggacccggcgcctggtgctagcgccgatccgccctccctagggtcatggggctttggccccagagccagccagcgttgctcctatcttccaaaacctcacctcaccacatttgtcctcggctcttatcagccctttaggcctgggaagacgtttcaggtttctatttcgcatagaagaaaccgaggtctaggcagaggaggccaccagcaccctaaaggcacctgctgcagggaaatggaagaattttcgccctagggggcacctctagaagcccgggaactaggcatctcctggatgtgcaggccaaaatgacaggtcctcagctgcctgttggatctgccctgcttctgtcttgccctcaaagtcttctgtggctcctttggcctacaggccagatcccacgctgttcagcctaaccgcctaaccttggatttgatccctccctggccttcctgtcctgaaagctctccctatccagaagtctcttgagaggcctggtggatcagagccaggcacaaagtggagcctcagtgctctggggcttagcccagagggcagggcttcctggaagaatggagcagggctcccgactgcttcctgtccagggttgggaggaaagcggcaaataacctcatcccagattctggagctgtctcggctttgctcccaacttgggctcctgaatctccaggggccaggacatttggcttggataagcctcatctttctagccctgcccctgaccccgacccctaacaattttcttgaattgaaataggcagggtttttttttgtttttgttttttgttgtttgttgtttttttgagatggagtctcgctctgtcccccaggctggagtgcagtggcgccatctcgtgaaataggcattttttaatggtcattaaggcattaaagttgggtgtggaatagaaaataataatctaattcctcatctgtggctcccgttgataagctatttatgatttatccctgtaggctaaggcatcatcttcataaggactcctggaaagcacacttctggggctgatggtataggaggaatgtgttttgccagcagtattcagtgcatgtttacagatgcccaggtgctcctggctccatgccaggtatgggtaggcaatataaattaaacgagaggattgacccctactcagtccagtgaggagagcatcatcacgcggactggattctgagattgaatggctgttgcctagcagagaataaggccttgtgagggttgttggacttgggacaaatgagtgttgatgtatgggaggagggaacagaccctaacttgcagctgcccaaagatacgggaatattaggcaaggagccagattgagagccctgagaaggaaggagcctctcgaggggaaggtgggcgtaaggtacacttgcccaagttcactccgcttggcagctgtcgtgcaggtccagttgaccacctctgctctcacctgcagatgtaccccagagctggccctcctgcctctgtcatggcctcatcagtttcctggggttcttgctgctgttggtcaccttccccatttctggctggtttgccctgaaggtaaggctggctgggtcagcccccagggtggttgggccacactgagagctttggcattgatgaataaatttgcctatcctctgtcccctttccctaaatattattacccctttgtgtaatgggctaggcaagaaccattcattcacattggtcaggggaggaaactaaggcttgggcttgtctaaagtcatactgggagccagtagggggtagaagcaagtcccaaactcctaagtcctgggatctggacactggctttaaggtacacgcagatgtctttgccaaattatcttctctttgggttagaataaattagaaatgaaaacacccaacttagcccagctggtagtgcataataggaattcaggcctcattttccataaggggtggtacagtgggaaaaggatgaaccatggagctatagttcagcatcgcacgtgaaagctgggggaaggtggaagcccaaggaggccttgccctttgtgtagccctaggcaacagtccctctctagaaaacctctgggtttggtgtggtctgcaagggggtccttaaatggccttatatcctagttctaaaactgccacagaaacaaatgccatgtgaccttgaacaggtttctttgcctctctgggccttcatttctcaatttggacatcactacttctctaggaggtccagggacctaaagttgacaaagccctttccccgggggtgctgttagggcagccgagccttttctcctaactaatccaaggacagacagtttcctggtatgagtcatgtctaacttcagaccacagagatgaaaagtttctctaaggatcaagtcaatacagtgcagtagttaagacacatggcctttggagttattcagaactgcattcaaatcttcactatttcacttagggctatgcaatttttgagcagtcacttagcttccctgagccttggttttctcatctggaaacagtgctagggatacctaactgtgacccaggtgaggaggagagaagtgaggaagggacctaggcagacagcattggccagcctaggctgaccactttcaactctttcccttgccattgtggacagattgtgcccacctacgagcggatgattgtgttccgcctgggccggatccgcaccccccagggacctggcatggttctgctcttgcccttcattgactcctttcagagggtggatctgaggacacgagccttcaacgtccctccctgcaaggtgaggggcttctcagctgccttgacagaggaactgggggcctgtccagaatgtactgtggtgccaggacctcagcctgtgagtcaccatctgaggggggaagggggaagaagagaccagaaaattgatggaagctaggaggacatccttgcttcatacacctaaccctacatacttggtgacaccatttgcccttgaggagctagctgccaagcaggtggttcaagctgggtggccccagtgggcctgacctccctgcacccccagccccttgagtgtctctctctcatggcctcccccaacagctggcctctaaggacggggctgtgctgtccgtgggagccgatgtccagtttcgcatctgggacccggtgctgtcggtgatgactgtgaaagacctgaacacagccacacgcatgacagcccagaacgccatgaccaaggccctgctcaagaggccgctgcgggagatccagatggagaagctcaagatcagcgaccagcttctggtaggcagcccctcacaagacggagcttgaggggtggcaccggcctggctccacctgccaggtcactttgagaaaagagtcagaccactctgggcctcagtttaccatatgtcccaatagtgtaaccacctttgaagagccagtgcctgggtggggccatgagttgaggaatggcaggtgggcgtagaccataacgatcctgggcaaacttgtccctgagaagaggaagtggccccggcagacattcttggggtctgccccttagtttttacccctcactgctctgccatgatgacactggcttctacagctctcattccgggcctgactcatggggcaggcagatgggtgatggagcagggaccctcccagcccagtcacctgctggggaattccaggctcaccatgcagcgtgtgcatgcttgtgatttttgtttccttgtttggaacagaacaaaggaacatgaggacatttggatctttttcctgcctcttctccatgtgtatattggagtttgccctaaatctcttctgctacaagatggggtagaaataaatacacatgcagagttgtgtcccctgcagccacactcaacttgtgcttcctcttgtgtcctgacaggggaatgtaggtgacatttctccccattcctcttggctctgctttgccctggggaatcaaggttagaggacagtcgggggaatgggataaatgccagtcctggaggtcccactggaagcagcgaggggaaattcctgaggaaatactatttgagatcctaacagtagctcttacgtgcttagcagtttatggtttacaaagtccttttgtctggcccagcatttctgagcttgacattttttgctgcaagtcggtactactgttttattttggagggaggaagctaaggctaagaaataatttgacttgcctctgagagctatggtcaagggcagagctgagccatagctagaccacctgcctccatcccaccatcgcccctcaatccagtgcttgatctaacacaactcagatagcaagtggataacaacttttattcataaaaccatgccccgtgttaattcacctttaggaagagaaaactgatctcagtcttgttgcacattgttttgatgtgagacaggcagtttggggaggtcagttccacaccaggatgtgagagtcctttaagtcccatttcccagactgagtgagcacctggtagagtgagagctgtgcctgtggttgagacagaacctcaggaggtccagcacaccgccctcaggccctggttcaggcgtacacttattcacatgcccctttttgcctgattttcttctagagaaatcagagtccccacctctcacttgctggaccttccttagccagttaccactccttacctgccagtgctccaggccagctgcctcagcccttcactgccctcctccagccccaccactgctcattgctctctgcagcaggccttgcctcctaacactcaggagaaaaactctaggatgagcactctgcttcctccagtttcaccccttcaaacccacctgcctctgtgctgctttcctgcctccttgcccttctgcctcccctctctgaggctcatccctgtactgcgcagtgctgtgggccccctgctatcccaggatgccttccctccactccatgcactctctctctgtcacctctcctttctgtgtagaaatgtgccctccctttgccacagtgccctctagctcccactccctttctccccttttcttctgcaagactttcatccatgctcccagcccctgcccctacatccttcatcctggcctccttgggctcccaagacagcgctggccaacatcacagtgacctcccacatgccagcccagtgggcacctctcagcccttcccttacatcacctggtggcagcatttgacatggtcgacccagcccccagcccccagaaccccctgtacttcctccttccctgtcatccctggttactgccacttattctcctgcccttgagtttccagggtttcatcactggcctcttctcatctgtgacctccctgggagagctcatccatctgggctgtctgctgcctgtggatgctgattattcacaatgtcctgccctagccctgatgcttctgtaccctgggccatttctccagctgcctactggacaattgactgccccacagacacctcaagcttacagtagtaaaaaaaaaaaaaaaagttgccatccctcccttcccacccccgtgtgtcctctctagtgaatgccacactcatccattcaggagcctgactcctccccactcccgccccctctcatatcattgcacacatcgaggcagccccgagcctggtgcttgcacttctctagtgccctgttgtggctcagtacagttgatagaggcatgcctccctcagtggatcttggcttcacagctcccctccaccctcgccagagctgcatcattccttggctgtattttgaaacaatgtcttccttggtctccatccctcccctcagccccctataatccagcatccacagcagccaggaggatcttgccttaaagcaagtctgctgtatcacctccctgctcaaactcctccctggggctctttgttgcctcagaataaatcaaagtaagcagaaacaccccacctctgacccctcagctgtctccagtcctcagccgacatgtgagggtccagctaaatggaactctggttcctcgcagctccacgaacatgccaggttttcttgtctggggttttgcacatgctgttcctgttgctggaagggtcctcctccacctgaggactccctcctgctggcaccaccctcctctgctgggggctcaccacaggccttgcttctgtcttggcacttaccacagctgaaaggtcattgccctctgcctgtgttcccaggctaggagtgtctcaagggcggtgtggtgcctccatgtccatgcacggccacacagtctgcccaaagaaggtgctcaggaaaggtttgttgaattaattacatttctcctcacactgtcctccagctggagatcaacgatgtgaccagggcctgggggctggaggtagaccgcgtggagctggcagtggaggccgtgctccagccgccccaggacagcccagctgggcccaacctggacagcaccctccagcagctggccctgcacttcctgggaggaagcatgaactcaatggcaggaggtgccccgtccccggggccaggtgaggagccctggggaggagagcgggggtgtttaccagcttggtgccagcacagactttgctcactatcccagcagctctgtgcagtacacaccctgcacagatgttcagcccacactgaccacagccaaggcagtgagaggaggccaggtgtctgagtgtgtagaggccattggcagcctccatgggaggaggcgacatcaccagaagggcagctggaaagaattttatatctgaggctggagtagtttagaaactgagtttgcagtttaggctgaaaactcaggggcacctttctggtagaggaggaagttgaacagaggcctgaaggggatctaagaggaaactgccacaaaaggtgcagaggccacagtgagtggtcctgaccttggcaacacgatgacctcctctctgcctccttccccaaccctgttggccacccccagcagacaccgtggagatggtgagtgaagttgagccacctgcccctcaagttggtgccaggtccagtccgaagcagcctctggcggaggggctactgactgctctacagcccttcctgtctgaggccctggtcagccaagtcggggcctgctaccagttcaatgtcgtcctgcccagcggcacccaaagcgcctacttcctggacctcactacaggtgccgctgccctccttgcctctccttcccatccagcttgctaggtttcttgttacctaccccagtggtgctctcgtagactgccccctgctcctgccaataatttggggtgaacccatggcaggcaggggctcagacaccatttccaggcattaactatgccctggtctccccgccatccgcaggacaatgcagccaggcttccaataccaagaggcctgcccgtgttacaggcctgctgcctgtcaggctctgtgccaagtactttttgtacattatctcacccacttctcaccatgagcctatgctttaggaattgtcatctctaaaggaattatcatcacagatttggaaactgaggatccaagagttcacacagccaataagactcaaacccagggtattagaacccaaactcttaaccagtactctcctcccaatgggaaataccagcccctcccacccccatagatctccttcacgttcctccattcccctactgacactcggttttcttttgccccacaggacgaggaagagtgggacacggggtgcctgatggcatccctgatgtggtggtggagatggccgaggcagacctgcgggccctgctatgcagagagctgcggcccctgggggcctacatgagtggacggctgaaggtgaagggcgacctggctatggccatgaagctggaggctgtcctcagggccttgaagtagcagccttggctgactttccagagcccagtcccaagcctggcaccaagcctgaggggcctcttggaggaggaggtgttcatctgcaccacagagagttgaggccctaacaaatttcaggcccagccaagagcccatgaatggaggctgcaggaggctgagtccggctgccatgcacgtctcccctacagtggttctctggacaaggctttgtccatcccggtccccagctgagtgcccagcgctgagctgggtgcacggtgtgattccaggaggagagccaggcctgccctgccctgctggcttcctgactggagagacaggacccacagaaacagcctgacagcagctggtttggtccttgtgtgagggaccaagcatgtggcccaggctctaagctctgcggggattggagagggatggggagggaagggaaggcagctccaagaagaggtccctgtggcgaagttacctggggatcctggctggcccaccttcctggctgcagtccaggcccgtgctggcgggattgggcatgggaaggagcagggcctgctgcttccctggcgctgctcccaaagatttctgactcatctgccagctctgtcctgcatgcctggcgagctggggcccagggcagcatgaaggagagccctgcgttctgtgcttcttaccagaggtttgcaagcctcagacaaataaatgtggtgtttacaatgt

SEQ ID NO: 36641 - DNA, 72313 bp, Homo sapiens
tcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaaggtaactcaggtgtggagtccgggtgggcttctctagagaggaaaatctatttcttttagagaacattccctttgcaatgtcatggctttttttttttttaacttcaggtaagtaaatataactaataggagagtatactgaattaaataaactgggcaaatgctaattttgcatccaacaatgtagtttatcattctgagggtttagaaagcaccctatttgattggttagatgctaccttcttttcaagtttattttcaatacagttttgttagtatgtttgtgttggcttatatattggttaattcaaaggcaccaggcacttgctccctcattagcccttcctgcaaactcctgttccagatttttagttgtatagtatttttatgagactcctagttacatattatttattccattgtctacatagcttcatcttctaaaactaaaaatgaacaccttgtgctttttgtcatataattttattgctgccttataaatgactttcaaaatatcatcagttcttgtatgtttttgtactttcaccttttttctgcttcatatttgacttatttatcctattgaatgtgactcttcatttttttttctctctgttcatcatgtcctgggatatggtttaccttggctacttaaaggcatatgtaactgagaggaggtttaattcagataaaatactatccttgagttgcaaactattttttctaattgaaatgttaaaaataagacttctcagaaattaactaaatcatacagtctattcaatatttccagttagttattttttaaatggtaaacctgctagtgtgactcactttttttccttacatcacacttcattatgaaagatgtgttcctcttttacaattacaaaaccaaagtaatctgccaaaaaataatgtaatattttgagatcttttagtgtataatattaacctttttaaaactctcattgtaactgggttattttggagggtattacataccatcttggtcttataataagaagagatccctccttctcaaaaataatcattttaaatatcgtacttcaaagtgataatctaggtcacacccacaccctttgggaactgccgtaagctaaaaccccaaggaaaataacagtccttctaacactaatcttgcctgctcatgagtagaatgcagacttggttgttggctttcttgtagcatgctgggttcatgcttgggagttttttctcttgtctgtagttagcgttgaaaataacaagcaaaataccggaggcagaaccagatagggcaaaggtctgattcacatggtgagtacacagggaaccatgactggtcattctgtcccctcatcctgtgggtaagtttccaaagttctggagattcgttcctctggtaggaattgttgagtcaaaaccatagaaacacaacccagacaaactgtcatattgtttaaccctaaatcatatcatttctctctagcattttcttatgaaaaatctaatccatatatctggctgcttaaactaagaacttgttctaacttgtcctgcccctagagctatgatactcactaggtgaatatcaacatagccaactccatcttttggcaaagtgtattttagcacaaagcagacatctatctacttatttcatataatattagcaggacaatgccttttaaaggtaaaatgtatctattattcttgctccaagtctaaggtgaacactttcaaaaatttccttagaaaacttgtttagtcactcacatgtatacaaagagatattgaagaaaagatatacatacattttccttctagggttctagctttatatgattttgtgattatgaacaaatcatctttaaacaatccttataaatgaaaaactcgtcgtacacattgtttgaattcatatgatctgtaactttttaatcagatagattattttccaatagaaattgttcagatcaaaatagacatacctcagtatgaatacacagcatacatagtaaaaacatgttaggaaacatctctctgttgaaattactccacgtaagagactgatattttttagtaaagattttacaccatcatctacatttctgtattaaagatctggggcaggggaggacaataacttttcaattgtactaaaaataaataaataaaaatggacttccacattagggacattagtatatagaatcctggaattcttaagttagaagaatgctaagagttcatttaattcatattcaacttccacgctttaaccttctacttttcccctttccctcagcaccaatgaccttaccaagtagttgtctaatttctacttgaatgcttccagtgatggagaatccactaccttctctatctagctattctaaaagtacttacgtgcctcctttaattctgcccccacatattaacacagtttctgtattccacatattacaatttgtgagcattactgtaactacagatttgtttttgctttctgagaaaacctgaagggtaaagactaactcttattacatttacaaaataatattactagctaacatggattgagtatttctagtgtgccagctctatgccttttgcacatatcaacttatttaaaattatacaacaattctgtgaaggagatttcagtattaatctcatttcatagttgtagaaactgaggcacaaatggatgaagtaaacttttcaaagtaaaacaataagaggtagatataggcttcaagtccagagatactgaattcacagcctgcaccctagccaccgcgctgtatagaagtcatggcatatgtgggtgctgttatgtcttgattatggctgggccactgtccccacattaggaagcaaaacaaagccactctgatcaactgatttagacatttgcaaggtattttctccaaattctctttccttttaccctcatctttgagtttaagacaaggataagactgatttgcctttagaggtacagaacaataacaacaacagcaaaaacaggaaagtaacccaccactcacaactctccctgttgtctgtcctctctctaattttatttaaaatcatgaatgcagtggtttcacattttttaatcttggttctgccacttatcaactgtatctcttggacaagttactgactctttccaaaacagttttttcatttgtttgtttccaatatgaatcccagggcttttaccccattagccatctctcacctctcaactagaaataaattccaccaaatcaatactttttcacaatgttccccagtagattaaaactatatttgattgatcagttgaaaaacagctcatatatttattcataaaggatttggtcatattttaatcatataaaatctaaacctacagtttgggtttctactgtgatattgggttctttttagaaaattgattctgaggaatgatattagggtagattaacttgtgaacaaatagttatcacaacaggatatttttgaagagaccaataattatttcattaactttacttattgatcatatttataaaactgtggacttctgaaatacaataaagatactggtattctactagaagtctgaagatatgagagatctactttttttgtaatgtgagaaatagatattgaatatgcctttcaaattagtttttgtattttatttccagtttgaatctttctgtaacttcctttaagaaaattgtctacagagagtatgaaccatattttaagaaagaaaaaccacaatctaccatttcaggtaagcctgaaatatacttttttaattttaaagataaatttctatgggtaatttggcattcacatgcatctaaaatatccatttactgaaaatttatagaaacgtgtggttttttttttaagaagtactggctacataatatgtggggcccagtgcaaaatgaaaatgtgagtccccttgttcatattattgaaaatttcacagtgactgcaaagcattaaaccaagccaggggccctttggggcatggggccctgtgaaactgcccaggtcacatacccatgaagctggctctgtttttaaccttgattaaaataactaaataaaacttataagtgtttgaatttttattcattcatctaaaaaactgttattgagtacctggtatgggctgggcattgaaataggcattgtggatgcaatagtggacaagacagtctcatatcctgggttcatggagattatggtctagtttaatgagcatagatgtgccttcgcaaaatgatattttgcttccatttggctccctagattcattcaaaggaactatgtatggctgactcttttgcatctctttcccgtctattcttctgtttatttagtgtgatatatacaatagccataatttttaaagaaaatctcttattttttcctcatctcttcctttatcaagaagactgggttgaatagggttctaatatcttaactatgataccatattccgcagggatgatagagaccatcaagggagaacttcctccagttgaatccccttgtcagtaattcacctgtccctttccccaatcagatgaagacctgctgtctttcccagaatcatcctagtctgtcctgcctcttctgatctcctttaatcttcaatatttagtcaatgggagtcttcctttcagttaaaaatcaacgactaaaccaaaaccaaatcaaaccatgtccagttaactcctatctagaaaaagaaaaaaaaaaatctccccttgaccctgcctgccttttccttttctctcctttccttcactaccagttttctgtatgagaactctgtatcattctctacatttcttcgcctatattccttccctaatctgctttagtatgaataagtctactaaaattactctcacaaaagggcacctaggacttgaggtgccagagcctatgttcttttactactagacattactaggacatttaacactcttcctttctgaagctctcgctttacctgttttttctagtgccacttccccttggttttctcagacttctcttaccactcctgctcagtatccccaccagatattcttccccagggttcgaatctcacccaaaaccaaggctttcactactacctacccagaagccactttccctctgaagctacattgacaccccctcaataccagcagaattaaatcttccctcttctatacatccccagtaccttgaattaatccctaccttctaaagatattaagaggatcaattgagttaataagtacaaagtatttataatgatgctgacacataataggcactcagtagaagttagctacattattgttattgttgctgctattactaatcataacttagatcatatatatcatagtattatggatatctatatatctatatttctccactcatttatatagtcttcacatgtgttcatttatatatttatttaattttaaacagatctgcatttaaatattcttttatttttaaataattgtgtattgaggccaggcgtggtggctcatgcactttgggaggccaaggcagatggatcacttgaggtcaggagttccagaccagcctggcccacatggtgaaaccccgcctctactgaaaatacaaaaattagttgtgcatgatggtacatgcctgtagtcccagctactcaggaggctgagacatgagaatcacttgaacccaggaggtggaggctgcagtgagctgacatcgcatcacttcactccaacctgggtgacagagcgaaactctatctcaaaaaaaaaaaaacaacaacaacaacaacaaaaaagtatattgagaacctactacattctaggctctgggataaagtgaataagacatggaccttgatttccaggagccaatcagctattggggataacctatggatagacaagcaatgacagtagagtaataaggaagaactatgatgaggattctgtagtaggacataggagacctatctccagtctggtggtcaggaaagtatttctatttctagattgatagctgaaaaaagagtaggatcttggaaagccaagtggggaggcaaggggttgggtgatagatgcattttaaaccaaggcacagaatgtttaaaagtttggaggtgagagtatggtatatttgtggaaccataactggatcagcacagttggaccacaaacttcagggaaggaattaacaagagatgcaactagatggggatcagggatccatgctaggctttatattgagaggaatagggagtccctaaaaggatttcagcaggagaaatatttgtcctttagaaagattatgttgtccaattatagagaatagattggagaaagaccagtccagagccagagaaagtagtcatgggactgttgtatcaatccagatagcagagaagctgagatggagtccaaagatatttaggagctaaagttgattaaacttggtgactcattagatgcagataatgaggaagaaaagggaattgttatggacttcaaggtgtctggtttgaacagcagaatggatagggtgccattcagtgagaaagaaaatgtaagaaaaggagatagtttgtgagagaaggtgataagtatagatttggagtctgaggtgtgtatagaatatctacctagagatgttaagtgagcagacgggtgtagaagtttggccctcaaaagagagatctgagctagctgtcaacatttgggagacatcagaacaaagatggcaaatgaagaatttagagggtgtgaactcacccagggaggatgtgatgagaagagaaggctgcagacagagctcaaagtagcagcaaagtccaagggatgagccaagaaagaaaagtttaccaaggagcttgagaaagcctgttcagggaggggagaagaaatctagagaatgtgttatcctggaggcaaagggtcaaatgctattaatataagggtcaaaatatggtccctttgttatggaatagtgggacaagaccagatggcagggtgttgaggagtgaatggaaggcgaggaaactgaagcacaagggtcttatagataactcttccctgaaacttggttccagatgggaggagagacagggtagtttcgggggtgggggtgggtactgaggagcttaaggacatttgagaattttataaaaaggaatacagagacttaaatatttaagggaagactctatagaaatgccatgaagtcctttccaatagaaaatgtggggataaaacatctgagagagaatgattaatggagacttagaagaagcaggaagcattgggattcaaaccttgggctggcttggccttaggtagaatggctaccaccttcatggggggccaggaaagcagaggataacgttgcaaataaaattaagtttgtagttatgagtaggaagttgaaggatgtcctgtcctatatcacagagtctattcattttcatagctccagctccaagcttagcatgtacaatagatacttaagaactatttaattaaattaaattgtaggtagatgaagggaatataaggtgggaaacatactcattagggccaggaaaagaggattggggccggtatttgaaggtgtaccttttgtggcttttgccaagctaagcaaattttaatccctttgctgtgtgagacattgtgctaaatgccataagagacggaaaggactaattccaggctgaagacttttaaacaataaaaaggcatggatagcttttgaagaaaagggttctgtgatcaaagtcctttcagatgattaaattttttagtgatttcctgatttaaccttgttagaggtagactctgacagttggtgagaacagtctccaatttatgtgtaaggcctttgcacctttctgtcaacccctgtgtatctcagaatatatttgtttcatgtggacaaaggtgtttcgacgtccattttaatgtaatctcttcctgaatgtccaaagttgcttaactatgaacttatgaagtgcaggagtggtatcttattcacctttgtaactctatagtagttgatacaaggaggcaaatctggcgtgaaggaaaagccttttattttgactgagaagatctggatttgaacactgccattaactatgtggcctctcccattccccagactagtcctgtgttatttgtacctttcccctatgtcctgctccactcatctgctgggtgtgattctagctgagccctgaaaaagtcatgagcctcactcctgcagcatgaactattgttgttgttagttcttgtaattgtagggggctgggctgtaggattggaggtatgaagatgcccatccaataaggtttgtggacatttgggcaggtgagggagtacagctggggtcatttttaggaattctgtcttgggctttaaaatggctagtcttggctgggcatagtggctcatgactgtaatcccagcactttgggaggccaaggtgggaggattgcttgaggccaggagttttagaccagcctgggcaatgtagtgagactctgtttctatttaaaaaaatacatacatatatatatatatatatatatatatatatatatatatatatatttaaattagccagacatggtggtacatacctgtcatttcagctactggggaggctaaggcaagagggtcatttaggacaagagcatcacttgagcccaggagttggaggctgcagtgagttatgatcacaccactgcactccagcctgggtgacaaaataagacctcatctctaaataaataaataattaattaaattggctagttttgagtctgcatatttttcagggacaaattataaaatgtttgtccctgaaggagttttgaaatagctgcaacaatcactaccttgtgttatgtaatgcattgttcacctaagagcaggggattggattagttgaccttctgcagtcctttccagttccacaactgcactaaattgggtacatgctgtgctggcttccccaagccctgaagtaggccactcctttccccaatccagctttgggcactgaggagagggttagaagggttttaggccatctggctgttggaggagctaaagagcagcttgaaaaccatttagccatgtgttttcctacatgcgtgaaagtatttggtatgcatttatgaaaacatccttttgttttgccttaaatctgaagaagcaggaggggaggttgaataaatactccaaactgtccactgaagtaataggtcttattaggttaaataacttaggagactttctctgggcatctggtatttgcaggcatgtgatgccaacaaacaaatcaaccaagcaagagaaccatggcaactaaatgcggcacacaattggcagcatagtcagcaccctgttgggctcattggcagctggggtaggtgggaatagtcagtggaaacttccatcaggagccaagacagagggtagcagctggaagaggggggtcagtcagtggagtccgacatgtcaggagtcaaaagaggtgtagacatctggactattctataaagatgggggcctgagcctgccccgtggaaggaatagggagagctttggctcaggagtccagagatctgagttctgatcccagcaatgctaccagatcactgactgaccttgggcaagtcacctttgtcccccgattcctacctcccaggctttgttaactaaaataaggactgaactttgtgacctccacagtcctgtgtaaagctaacataaaaacaaacaaaaagcttcaggcacaagatcagaataaactccaggagtaggagttcaaggaaaggaataggacaaccgtgggtggcaagacaggggtagggaaagataggacctctgtcccagaaatcagagtttaccattgcttctgtaaccagttactgcaaacttagtggctaaaacaacacaaatttattcttttatgattatatatctgcagatgagaagtccaaaatgggttttattgggctaaaatcaaggtgttggcagagctgcattccttctggaggctctgggggagaattgtttccttgtcttttccagttactggaagctgcctacactcacgggctcatggccccttcctccatcttcaaaaccagctgagtagcatcttccaagctcttcctaactcagattctcctgcatccctctgataaggacctttgttattacatgggatccacctggacagcccagaagaatctcatctcaagattcttaatcatagatacacagtcccttttgccatataaagtagcatatttccaggtcccagagattaggacgtggacatctcagcaggggcacattattctgcctactacacccaccaaacaaagccctcccacggtgtcctccatctcagagaatggcaccctcctccacccagctccccaaatcagaacctcatcagccatccacagcaactgatgtcctttattctctaccccacatccaatccatcttcaagttccaactattttatctcataaatacatcactaatatattctctcctcatcatctcatcataatctcagtcaccaccatctctcctggagtcttctatctgttctctcaattgttctctgctcagtctcctccgagatcatcctccacaaatacagccagagattttaaaaccaaaatctggtccatgttgcacccctgatgaaaactctttaatggcttccagatactcttaggctaaagggaaaactctatgaggcttacaaagccctgcatgatgggactctgaggatgccttcggcttcaccttctgccccttcctttcacatactaagctccacctccccactggataactgtcagttctctaaaaaggccacattttctggcacctcagggcctttgcgcacgctactctaactttttagaatgtctttggccatcccttttcctctctgcctttggacctcagttaaaggattaattcctcgggaagggattccccaactcacctccaattggactagattccactgtcaaatactcttcagagtattccctccttttctgtcataatatttaccataggtttaaattgaatgtttttgtgatcatttgtttaaaatctgtctttcctactataaaaacgtataaagttatagaactataaaaatgtttgacttttataaactctatgaaggcagggagtgggtgtatctattttactcttttacgcaccattgcaattctgatgcctaggataatataggcacttgatattcattgaataaataaaggaatgaataaaggaatgaatacaaggtggaggtgtagtataaagaagtggcttaaaagtcacgatctagagacagacatattaaactttaaatcatgatgctgtgtgatattaggcaagatatttaaactctctgaggctcagtgtcctcacctataaaatgaggatcttaatatctaccttaaaaacttgtgaggattaatgtagggacttacagtgcttgaatgtattaagggaaacagtacaggaaagccttattatgattatcatcaccactgcaaacaaatgctggctgaactccatgagtgccgtgacttccttctcctgcttctaggacgcctaatggcgagaagccaatcccatgacacttgtggatggctcagaaatgacagtagttgatttctgtcacttgtctggaatggggcttttggtcatagattctcaagatttcaaagacatcaagatcaccaaggagcacacgttaaagtccagattcccaagtttcacctccagaactcagattcattgaggctgaggtgatatttggaaatctgcctcttattaagaccctaggtgattctgatgcagagactccaaggactacactttggaaattctagtacagtcatcccttggtatccacagggtattggttccaggactactcacagataccaaaatttgcagatgctcaagtcccttatataaaatttcatagtatttgcaataacctatgcacatcctctcatatactttaaatcatctttaaattagttataatactgaatgcaatgtaaatactatgtaaattgctattatgttagagttttatttgtattgtttttattgtttattttttattgttgttttttgaatatttttgatccaaaattggttgactccatggatgtgtaaccatgaatatgaaccatggtcatggagggctgactatatacaattcctcaaattctgactcagccatcaactttttccctaactccccagacagaatttgtgcttcatcctctcttcttctgtaatattttgcccatatctcagcagtcgctcctatcatacatctatctccaaactagcttgtgagttccttcagtacagggactgtatttgatccaggtagccagaaactttctaacacagtgcctggcatgtagaaagtaaaacctcattcttgatttctgcacccataacctcctgtctctgctgtgttctcccattgcagtaactaataacatcatttacccagttgttctgataaaacaccttgaggtcatccttgacttctgtctctcacaagccacatgcaatccatcagcaagtcttgtttgccttacctacaaaaatgtccagactccaaccactactcatcacgttctgctacatgtgctggcccagtacactgcagtctctttcctatactgcctaatctctctgcttccattcttgtccctacacagactattctctacacagcagctatgatgaactttttgttttaggatgaacttttaatacacgttatactatgtctctgctgtacaaagtggtttttcattttacttagaaatgctccatttcacttagacgaggcgtggtggctcacacctgtaatcccagcactttgggaggctgaggcgggtgtatcacctgaggtcaggagtttgagaccagcctggccaacatggtgaaaagtcatctctactaaaaatacaaaaattagctgggtgtggtggtgcatgcctgcaatcccagctacttgggaggttgaggtaggagaattgcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccgtagcccatagggcctcccttgttctacacacctaccatccacctcatctcttctttcttcccgtactgtttttcttactgttccttagatacatcaagactactcctgcctcagagccagagagctgtgtgatttggttcctcaattcatctaggtctctgagcacacccatgtcagagaaatctaaagtaactaccctctcgcatcaccctctgtaattgaaatgaacatctttcttaagcaaagaaagttattgctaaggaatgacagtgggtcaaagtgggcaagacttggccagaactatttctcctactctgttgacttcttttgggtccaggacaagtgtttctaccattctattgtgatctgtgtacatgtaatgttgagttaatgagctgctaaaaccttctagattgaaaataagtgagtcagcctcaggaccaggaggaatggtagcaatcactcttggtatcatctgtttgtttttcttgcttagcaactctgcctttgatgaccctgaatacagacatagtttaaatatttgttttcacaggacttcttgggcctactttatatgctgaagtcggagacatcataaaagttcactttaaaaataaggcagataagcccttgagcatccatcctcaaggaattaggtacagtaaattatcagaaggtaagataaatctaatatttttctgaaaagggaaaatgtctaagtctttaataccagcatcaacatttaaaactatactgttaaccacgtgttgttagggaaatctcttgcaactggtaattataaaaattgttgctgttgtaagttttgagagaagaaaaggaaaaggttttggagtcctctagacctgcatttttcactgggttcttactctttaatgtttgggagggcaagttatctaatttctctgaattctcatatgttcatcttaaaatgggaataataatacatacattgaaagatggtttaaggcgggggtcagtaaatttttccgtaaagggccagatagtaagtttgtttggctttgcaggccataagatctctgttgcaagtactcaactctgccttttagtacaaaagcagccatagacgatacctatttttttggctttggttacagatgccagaactaattaactttgttaccgtattctttccctcaagtcatacaccagagtaagaccgcctctgacaatacaattttatttacaaaaacaggaaattggttgggtttggcccatgagccactgacatagtgacatagaactagcctgatataggcttcctggcacatagatgacactcaataagtggtatttggtggtggtgagactagaagcattaatagtattagacttttggacatagtgaagtggttaagaaagtaagctttaaaggcagacaagttaaaattctagctttatcatttctgattctacgactttagcatctctgagcctcagttttctcatctataaaatggaaatgattataaccacccataagattgcctgaaatttaaatgaagtcacttaggtagagtactaaacatggttcctgggatcggataagctctctataaataatgatgacaatgatggcaataatcataaagataatagtcatgcaagttattgtatcagccgctgaatagtaagtacctgatgttaatatggttctaattatcccattatgctgatgttcagatcattgtaagcatagtagagttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataagtgcaaatcctggctcagtgacttttatgaagttatttaacctctgtgtgcctcatctttctcatctgtaaaatggtaataataatcatgtctctgtcatacaggtttgttgtcgtgaaatcttagaataatgactggcatataacagataataaatattagccatgatagtaaagataattcttcaattaaaatgtgttcaaataatttagtatttatcttaaaacttgttagtttcagaaaaaatcagaaagtaatttttaaatttattgttttctatataaactgttgtcaaactcatacccactaaggtataagtgactgataataggtcaatgaactaccttccttaggagtacttgcattagcacttaatctttggcttgaggaaaaacaatgaagcattaactgtggcactgagatttcttccaaagtgaatttggcaagactctgggtgaggtagtgggaacaggagtttctcctatgttcttaaaatcatacagtgacatagtgaacaaccacttcacctacttatgaggcttctagacgactgcatcagaagttcagcaatgtaaagaagaagggggagaaacctcaaaatatcaaaatgtcacatgcaggtttcatttcaaataagggaggaggtaagaattgtagactttggaccctacctgggctgtttgcacagtgaatgaaccttgcaacactatccctcttcctttactgtttatttgtccctacattccctacagccagcaattatttatgagcaattgcttaaaatgctcccacagctttcactggagacatgattattggcatataatattgcctctggtcctatgaatctaagaaaggtaaatacatattggtagggaaagtaaaattttaccttggaaatgagatgcaaacctagtaagcagatagtatcttttatggtaaaagacaagccttataagttgattttattatgccctctgcattaaaataaaacatctcctcctccatgtctgacactcaccctcacctatagcctccctctgtggtttgagctatttttttgggagtggggataaactaactgcatgctgagccagttacatgagaatccagattcctctatctcagaggtagatatttgagagataggtggtagggggttaagatagtattacactggcttgagaaaccacaacagaacataagagaactctggataaccctttttgacagaatggacaaacggtgatttgtaaaaatgcttgtaaggacatttcctttaataatgtatttaataagactgtcttagatcagggaataaagtatctgcaactgtaactaatcacttaaaagctgtcactaaagggtttcaatttgaggttaaattttcagaaactctgtaactagcatgcatcaaattgacttcaatgctgcacctttgagcaaagtttgttgttcagtaaaattttcaaagtcgttttggtcaattacctttaaaaagcttgtttcatggagaatttaatattattcttttcttttagttatattctcatattttaaatatatgagttgcatatgaatgtgatgtcacaaaattagttctataatatatagccatctgctggtaagccagctctccaaataaaacacgttttctgccagacattgttcgttgtatctaagtgttgccaaattctctatacaaaaatttgctcttctagatttttccaaaacattccaatgcttgacttaatgtaggtgattacattttttcacttctcatctgaatattttggccttatgtagagacttccttgagtatatgataaacacctgaaacaaactataacggctatagtttgtatatttaataaatcacaaaaatgtggatcccttttccaaagagacttgcaagtcctgtgcaatgaaatcagctctttataaaacgtcagcattgattcgcccattgcctacattatagcttctaaaagaatattctgaatctttgaatgtagtgaagcattcactaagtttattaacttaggagaggaaaagagttgttcacaaaaataagtaacaagggaagagttactgagtgagcaccctaatgagtaaccaaaaaggctctttatgtaacttcactttcccaaagcttgtatgcaccatttttcatttttaaaaaatactgagagcctttggcaagtaattagtacatcatgacaagaataaatacaatacaaagctgactatcgactgagcaggaaatgaacagaactgagtaaatataaatgaagagctacccttgtgtaaagattttattccagcaagcagctgaacaaggacttcttgtgctctagcacaatagttgtccctgtccatttctcttcttttcagtttagagcttaattttttttattttgattacaaagtcaaaatcacattcaccaaaactgcatctcacaaatgcttcctcttaatagctgtttgtattttatactttatattaatgtatgttgtaaaatcaaagatacaacaaacctgttttattctagactaaaggtaaaataatttgaagtgaaaagaataaaagcattgataaaattacaccccaattgtctcattagccatctcactcagtgtaattatagaatatatcctatgtacaagtctatatcattcactgtttcaagatgctcataattcaacttttagtagtatactaaacttaattaacatcattcatttaattatttgaaattcatcttatatgtaactgacaggcgaatgtgaaattctgagtaatttagtttgatcaattagacagacattaatttgtgtgactagagtaacctttcattatctatctcaaaatatcatgtacacaagtatatacaataattttttaagcccagtatgtgttaaaataaatctaggtgtgaaacattgattgtttacagataggttcaatattgttagaaaatcagtcaccctgctatacctagcacaagtgttatagcatcttgggcaatttttagatacttacattggttggttctcattccagattgacagtgtgttctaattgtagccctagaagaaatctagaggtcaaacctatcacaattagggcaccaacatgtaccctagagttaactaggcagagcccctcaggggcccaggccctgtcttctttacatttgtactctggcatttagcacagagcctggaacctagtggatgatgatggtcatgatcatgatgatattaatcattactgaactaaactgaggggccgaggactgattagaaagtaaggactatgcattatttttcccttgctttaaaattattgattttgctgataattttgagcaggtactttgtcttacttattaccaaaaaaaaaaaaaaaaagtacttttaccaaaaaagtcttatttactttcatcgcctttggaatagatacatcactacaatggattggaagtttgtgtcctccaaaaattcacatactgaaatctaacctccagtgtgatggcattagcaggtggggcctttgggagatttttttttattatactttaagttttagggtacatgtgcacattgtgcaggttagttacatatgtatacatgtgccatgctggtgcgctgcacccactaactcgtcatctagcattaggtatatctcccaatgctatccctcccccctcctttgggagatttttaggtaatgaggatggagccctcatgatgagattagtgcccttataaaagggaccctctcactcaccctctttctaccatgtgaggatacaaggagaagatggcagtctacaacctggaagagaccctgcaccagaacccaaccatgctggcaccctgattttaaacttccagcctccagaactgtgaggaagaagtgtccgttgtttataagccactcaatccagggtactttgttaacagcaacccaaactaagaaaatcaccaatttctatcttactcacatgtgttaccagaactcaagcacacttaagatctatcttatctaaagtagaacataaaggaaagaggctgtattaattgcaacatgactgggaaagaaaatacttaaccaaaatgtgaacatgtattcccacaggctatcagagcatttgttaggagccagaaattttacaaatattttccagtcttcataacccatcaaaaaggataaagttatctctagaaaaaggattatattatcttaaattataaatgaaaaaactgaggttaaagggacttcaagaaaccttcccaagttcccacagttagcaaatgatacaaccaccaagatattttcaactctgaccctgaagttcaagtgctttctcccactatctagcagaaaaaagtatcgttaaccatatagtctcacaaatactgaattacaaatggcgatgagtgctgtcaaaaaaccaacaacaaacaaacaggtatcacaatcagagatcaagaagggtgtaagatgatatttgatctgacatctgaagaatgagcacacatttacccagaaaaataaagggaggaagaacttcaaaagttatctcctaccctgcaaagaatataatgttttgcccttaggggagcttgtgaaggcagtggaaagaatatcattttctactatagaaaccccatgtgatgttttaacagttgaaacagtggaagctgcctgtccagaaacatcatttttcaactttatgaggccatgtagcaagaagcattgaagaagggctgtcatgcttgattcaaggtagatggtgcagctcatcaactagccatgctaatttcagttaatagacaagttctgacctgagagggcaactctccttatcagtcctgtttgtgctttgttaccaaagctcttttgtaatctttcacagataatgcttcctgcttattagtggagactttctccataaactttttttcttttatagactagaattatgttataacttacaggaagtgacttaagcttttatcatttctcagctcttgacagttttattatcaaagtgaaagtacagcctagagtaaatattagttattagtgtcaagctatcctttggggtgtgttgggggaagacacaacaaagtccactttatgctagcgcaaagttcacaaactcagatgcctatagtagccagataagtagttcagtgaacaaaattggtccagtaagaactgatcatcagaaagcagaaaagggcagctaagatccagatccaacaaaattctgtgcaggagtttggtcctgttgttaaccagatctccaggtttttgttttttaaagagaaaccagtaatccaaattcttatataatttctccggatgtttaatgttggcatttaatctattttaacattacgcaatcataacaacacacagccatgagctttgacttgttgacctaggctgtagcccataggaccttaaattttaggagtttaataaatattcactgagcatcttcttcatgttcatgttccatgcttctctaggtacctatggaaggcaccagagacactaagacaaatacaatccagcacttttccttgaggaactcacacttgggtgaccaaaatgtgcaggacacaaatacttatgatctagtagaagaaaatgaattagtcacataatctcacaggcatttaattacaaattgtgatgggtgctgtaaaagaaaaaaatgtgtatcagaattggagataaaggtagaagtgaacagatattcaaggtgatgtctgaatgatgagcacatatttatcaaaaggaagacgggaggaagagcactctaggcagagggaatggcatctgcaaagaccctgaggtaggacagaacttggatgtctggggaactgacaggggacccaagggacaaggagcccatagtaaacaagagaaaagacgtatgataagactgaagagagaagtagaggtaaatcatacatggacttgtggtccacgttaaggactttatgcaagaagtaaatctagatatacctactcaacttatggtttccatgctcagaacctcatgagatacattgcacgttactgtagtacctgaatccttcattgctattgaatggatgtgccttattttccactcccacctggagaatccaaacatatgctgatgccatgcaaactcatgcaaagcgttttgagtggaatagattttccacagttgggatggggaaaggtacaattaaagaagggaagctgacattgctgtaatgtaaaaaaatattttatatggaaatttagcatctcagactttggcttcagaacataaggaaccagatttaccctttttctcaacaactagacaggcagacaaaacatataaaacagaagttttcagacatcgaatgacagacaactcaagacagtaaaagaagagtaacaaaccagatgtgccctatgagcacctaagcttactgcttgaagagtgtttccagggaacagcacaagcagggagaacccagacagagtctctatgggttgaggaaatagagtttggacttcggagaagctcaaatggctagaatttgtgattttagggcagagtcctgcagaggacagtataatcacagagaaagagctctagagaatctacagagaggttttgtcaagttgaatactgatctgcacatacatgtgaggaaagtactgagggtaagaaaaatgtcacttgaaaggaacaggtggaacagtccctggaccttactcagggccggtaatcgtttatgttcctaccatcaaacatagaaagacctcctaataaatgagcactggatagaattgtcagaaggatttagaaacagtgggtggataaaattagactacaggctgctgaggaggcaacagaataaaaaacaagatttgatttcaagtatcttaactgtgaataaaactcaatactagttaacaagaatgcaacaaacaacaatgtaaattcacaatgttaataaaaataaacaagcattagaagaagcagaaagagatgactcataaccaagaaaaaactcaacagattgagaagtgaaagagagaatagaagcagcaggcagagacagtaagacagctatcataaatcttctcaatatgttccagaaagcagagaaaagcatgagcatgatgaagatagagaatataaatatgcatacacagaacttctgtagatgaatacaattgttgacatgaaaagtaaaaaataaagcatagaaaagaaaggtaaaaaataaaggataaaaaaatatattataaactgaaggataccactaatacaacaaacactggatgaaattaatagcacattagacactgtgaaaggaaatagtagaaaatattaatacattgcaatagaaactgcaaagtgaaatacagagattaaaaaggctgaagaaagtgaacagagcatcagtgaactgtgggaccatatcaagtgatctaacatatgtgtaattggatcccagaagtagcaggaacagaaaaagtatttgaagaaataatgactgaaaaattcccaaatgtaatgtaaactacaaaccaacagattcaagatgtttgacaaaactaagaagaaggaacatgaagaaaaccacaccaagccacatcactatcaagttgctggaaaccagtgataaagagaaaatattggaagcagtgagagataaaaacacacaccacatacaggggaacaaaaccaagaaatgatagcagacttatcgttagaaactatgcacaccagaagacaattagggacatctttaaagtgttgggagggtagaagataggggaatctgtctgtttagtattctataccaagtcaaaaagtcttttttaaatgaaggcaaaataaagagtgttttagacatacaaatgcagaaagaatttctcactaacagagcagaaaaaaatgttaaaggaactcctttagatagaagaaatattatgtcagagagacatttagattcataagaaggaatgaaaagttccagaagttgataaatatagagaaattttttcctcgttttaatctattaaaaaggcaattgattatctaaatgttaaagcaaaatagtaacaatttattgtggggtatattatgtatatataaataaaatgtatgacaatagcacaaaggctgggagggaagaaatggaaatatattattgcaaggttcttacaagtgaaatagtataatattatttgaaggaagtttgtgacaagttaaaaatgtactatatattgtaaacggaagggcaccactaagaaaacaaagctaagaaggcaacaatggagattaaacatcactaactatactcaatccaaaagaaaacagaaaggaaggggaaaaggaataaagaccagatagacaaatagaaaataaatataaagatggcagttttaaattcaaccatatcatcaattacattaaaagtaaatggaaagaacactacaattaagaaacaaataagattgaataaaaaagcaatgctaaactgtatgcagaatttaagaaatccactttaatgagagagacaaagataggtaaaaaataaaggatagaaaattatataccataccagctaacactaatccaacacaaaagggtgtgtaatgatgattccattgatatgacattacagaaaagccaaattatagtgaaataaagcagattagtggttgtctgggcccagagggcattggctacaaatggcatgaagaaatgttttggaatgatggaactcttctctatcttgattggaactatagctataagactgggtaattgttttaatcaaagctcagcaaatattatacttaaaagtggtaaatgttattatatgcaaattatacctcaatgaggataatgaaaggaagaaagagagggaaggagggtggggaatagggaaggaagaagacaaagaaaggaagaaaggagaaaagaaaagaaactaggaaaggaaaaagaaaagaaagggaagagaaaggaaggggagggaaaggattaatcatttcagttttcaaaaagtgtagttgcttcagtaagaggagttttattggccttttaccccatcatgtaaaacatttcaggcttttttccccagatccttgttgtctgcctacatccacactgatgttctcaccttcttctcgtaaagaatttatcaagttattgtaccaaacaaaaataactgcatcccaaagagaaattctgtcaccagctgatgatagggaatctttcacctaattaaatgaggaattcctcaggcagaggaaactgttcattccacttggctctctatggcactcacctctccccttcctgacctcacttgctccattttattattgaaaacctcacccaaccctctacacttcttttaatattgagtatctcagttccttctcttcaataaagaagaccaatttcttcatcctctccctctcctatcagtagggaaagtccaatatacatggaggtgttaatgatgtgtctttgggtgcacaaagtacaaagtaagacatctaagtttcaggggatggacacatttcatattcatacagacaaccagcctgcataggggagttagacgctgtggctcgggggaaaaaattgagataatcagatggctaagatgaaataaagagataaaacaaagctgaggatcacagcagttggaaagaagatctgaaatagcaaaacaaaataatacataaacagctctgactatcctcccatctcatgttaataggctaagtatgtcttattaaacaccacaaagaagatatcacccattcttatattctgagatggtttactaatcaaaggcgattcaattctctgattatatttaaataataattgttcaggtaccctggaaaattaacttgctaaactttaatttacaaataacatttgttattcttaagatcaccatgttatcaaagcctttgtaagtacatgagcatagaaatgggcatatgtgaatctttccaaataataaaagttcactattgaaggacatatgcatctccagagaactcatcttagctatccccagatttgagagtggtgaaaacgcaatcctcagaaactgcccacatgtcttgatggctgttactcctccaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaaggtaagaacacccccaccaaaagattcaacaactaaatgttggaatggtcaggagttctgtcatgggacaaagcttgggagcatcttggtaacttcttgtacatcaagcagaggaagacggcacggagaccagatcattgtttgacaagagaaaaaaacacctgctatttcagggtgtggatccacctctgtttcttctcattcctccttcatctcagtccttaaggttctcccaggcaaattcctgtttgagagtatgttctgatgtcatgcttgtatgatctgtaacatttacctcaaggccaaagtcttttagaaagtatacagtagcctatactctgctgaaagagctcttggaaagaactttggctaacatgtttgacatatctgaggtttgggctggtaatttgctctataaacacgtgaaatgccagcttcctttcttacaaacaagttgaaaactttgggtggtaggtttcaaacacactcaagtgactttacaagaacttttattggctgggcttcttaggagcaagcttggattttcattttatcccatgagaatccagcccatctttcattaaaacaaacaaccacagtgagccacagcatgggaaataacgtgatggactcaccatctgcctatacatacacgctcaggccatacctacatacatgcccaatgtatttactcattatacaaagactttttttccatttcctggtatatataagatactgtgatggtactgaaaaaaaccttaaaacttacaaaagactcttcttgcattttaccatcagcagcatgtttttctcatagtgagaatggattaatgctgatacttccacccaattatctaatgccccctttcatatacaaataagatgacagcattaaacttggggcatgatgcttttaccaactgagctaacgtatctatatactcttctattgagactgggggaaatggatacttgtacagagtcttgagagtcaccaaatgttttcttcccaagctggatgaaataaagcctgttccccaaagcaagaaggtatcaaagaagacagtgtggcaccagattttaaataaccctagaaccattattacttgataaatatgctattttaaaaaataagaatttcttcaagttgaaatcattatggttgattgcttgccctaaactctttgctatccaggaaagctaatgagcgtcttctatctgcagtgctactgaaaacatgtctttcctttcatagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccaggtaacacgagggctgtgtaccattaaacaacagtaaaatcattagtaatttttcggtcctgttttcttcaaagcactagagaagttgaccatactcactgttttgcaactccctatcaagaaggaaatattttctctttttttttttaaacaggaaatagaagagacaaattagaagctagagaagaaatgtgcagccttgttaggtatagtgacctgagtaggtttcaccttggcctgtactttgaataagaccttaaggtatcagctcagccactctctccgagttctgcagttcctctatatgatgaccatggcttcttcaaggacaagccctagcaggaaggatcagcaggaagattgcagtaaagatgaacagattaggagtaatcctcaacacacaaaaaaaaccagcatttcaaaaggtgacagaagagtaatattcagtggcatctagaatattttctctttccatttgcatttgggcacttatgagaaggcaaaatcatagcaatcgttaagagaaaaaataactaattcccacttagaccacatctcttctatttctctctggtagaactgacctacaactaaagatccagggtatatgatactagcctgagggaaaaacattaaaaaattaaaatgccactttactaaataaaccatatttcaaaacactaaacttcttagaggttattctctaatgccatctgaaaatcacaaatagcttcacttactaaaacacaaatattgttaagagttgagatctgggtagtgtttttaaattgtattctatttcatttgactacattttccacttggttttctgaaaatatactcatatgactctcaatgttgatcccaagttccaatactaggagcttgtaaaaactggggcttagttaactgacctcgaccttagataatctgagttcagacttcagattatcagactaccttctgtggccctggataaattagttgtctcaatgtgcttacttacaaaagtggactaaccatttatcctaacatctatttcctggcagagtgaacaatctgtataagtatatggatgccaagaaaagcaaaaccatatgcacaaaaataaaaataaattgatctgagcttagagtttacgaatttatagttcccaaaagaataattgggggtaaatgggacaaggtagggaaagaccatcagtagaaactaagaatagtaaacatttgtaaaaaccctctgccttataaagcagaataaattgaatacatatgataaatgctaacacagatatgttaattgctgaactcaatataagcatttctttggcatggataaacgcttccaccaaagcctcctagtgatgcaaggaatcctggctttgttgcaatggtctcctaaaaaaaacaagcctttgtgtgggtaaggaactgattctcaggcccattatctagtatctagtgattatgtatctgagatgtaaaacagaaacctaaaagccaaggatggagtctccccacagagcaaatgagcattttcccagtgactgtaggagcaaagaaggagcaaaactaagtttttatattcagttatcactactccttccatgaaaagctcccaatggctcagcataatgaggacttgtacactgcattttaaggagagtgtgtaaccccaaagtgatttcgttgacttgtcattaaaacaatcaaaaagtaagtaaaaataacaattgaaaatcctcatatcatcttcacatcttcttcccttaggcagagcttcgaccactacagctagagagctgagaggattaagtgcttgaactcagccctattggcggttctggtgatttgactccctccagctgagatcagactggggtgaccaaacattccattttgccgtggactttttaccagttctaatagttaaagtcctgaatcttgggaaacccctcagaccagaacagtcggttaccttcttggttcccttcttggcctaatcctttagcaatccctgtgtttttgagttcacatccaccatctctaagctctgttgttacctgtataatgccatttatcacaatgagttgtcactgcttgtttgctggtcactcagatgtctgcttttgcagggcacaaactacaactggagtgtctgttccctcaaagctttatacaatgcctgacacacagcaggtgctcaatacacttggtgagtgaatgtttgatcacagagtacttgactgaatgcttattttggcctgtgtctctccctctttctcagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaaggcaagaaactctcctgacagtcttgcttctcaatgcagaatcctttcttcccatgcactaactccctctttctcccttgccctttcaagccacctgcaccgcagacaaactttcctcagttcctaacaaccaaacttagatattttgctcttagatttataacttgctctttggggatggagaaagcgaaggaattggcaaaggttttttttttttttttaattaagcaaaagctaaagagatctctaacttcctcgaaagaagaaaagaggaagaaaacaaatgcatacatagagatattctttcttcgggttacttcatatgcaaaaaagacctagatgctagcacaagacaaactgcaaatttacagaagcactaagttgtagaaagtgtaaaagtttagcatgaaaacattaacctttacagtgggatgaacacaaagtctagcacagagaggaactcaatgaatgtgtgttgaatggatcatacatggcatatactgaggggtgagctccaaagaacactggggaattcaggtgggaaaataaatcaacccacgttatgtggtatcgtgtaaacaaaataactgattgttctactacacatttttgctttaaaactgttgagattagagttcatataaatggagactaaaatctaaggaaatgatatcacaataggaaatcattttgttaccaaaataatgtataagcaacacatataaggaagagatacttcatgagatcatttctgtttcttttcacacgagtagtcaaaattatatttgaagtaataaaaccatcatgatatccgtggaagatagagttcccaataatattaaaacaacaatgtaacttttgtttctttgttgaggataagtgcattatgtattgttattaatatttaatttttaacaacaattttattaggtactggtgctacttcattttatagattaagggacagatgacagaaaaatgagaatttaacaagacttaattcataaggtcttaagaagttaaaaattattagaaatttgcctgctcaagaagaaataaagggaatctttccaaattttttccctaacccctcctccttttcccccttttaaaattcttgccttttctggatgccacttaaagagttccaaactaaaatgttcaaaaattgcctgagcattactttcactcttattatattaatataaaccttccacaagttgatttaaaggatatgcatttcaatcaaccataatttcttctcttgagttatttcattgtctttctgtcctaactcagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaagtgagttgttggggttcataccactgggcaaaggttcaagacacattccatagggtcctagatgtttggggtgaaatgtaagttcacagctctcaaggggacacatgtattggtttctattcaagtctttttgtaaaaattaatcttgaattacccccaaatcaccaaagaaattcagcctaataataataaaaatgacaacagcagctaccttttgttgaatgtttgccattgccaagcactgtattgtccctttctgagagcttcgcttcaactctacaaactagatactgctcttatttctttttatagatgaggaaatgggtctgagagattaagagatttggaaattcaaatagctcttaaacccttgaaaagttactcaaattcactcataataacagaaatgcaaattaaacttcatgggaatactacttttatctatcacattcacaagtccagatgacatcatctgttgacaaggctgtgagaaaaaagaactatcatatattgttcgtggaagattaaattggtaaaaggattctgaagaataacttggcaatatgtatcaaaattctaaatgcatataccctttgactcagctatctcactctggaaatctaactatacagatacacttgttcacaggtgaaatgatgtatgtacaacatattcactgttgcaacgttagtagtagtaagactggaaacaacccaaaatgtccatcagtagaaaactagtttaataaattaggatacattcatacaatggaatactaagcatcaaaaaaagaggatgcaaacactctgtatgtactaatacaaaaagttctccaagatatgttattaaattaaaaagctgggatgtagtatagcgtgtatacatagctgccttttgttaaaggagtgaaagggataagaatatttatattttcttatttgtaagacataaaggtattctggaattacacgcatgaaattaatatatggctacctagaaaattcagggagggtagggaggtcattttgagagtcatcagagaaaagtgagagttttcactgtaataaaaattatgtgaatgtattttctattaaaaacaattaaactaggaaaaagaacaaaaaaaatttggccaagattatagaattgttgacagaactgagataggaatccaggagtgtttggcaacagtcagtgctttccactgggaaaaataaattcataaaatgatattccatcttaaaagattgctgggttaaatgatatttctgactttaggtcttggaggaactgccatactgtcttccacaatggctgaattaatttacattccaccaagagtgtataagtgttcctttctctccatgaccttgccagcatctcttctttcttgacttttcaatcatcgccattctgactggcatgagagggcatctcattgcgtttttctttctttttttgagacggagtctcgctctgtcgcccaggctggagtgcagtggcgcaatctctgctcactgcaagctccgcctcccaggctcacgccattctcctgcctcagcctcccgagtagctgagactacaggggcccgccaacacaaatacaaaatacaaaaaatataattttttgtatttttagtagagatggggtttcaccgtgttagccaggatggtctcgatctcctgacctcgtgatttgcccgcctcggcctcccaaagtgctgagagtacaggcgtgagccaccgcgcccggcctcattgtggttttgatttgcatttctctcatgaacactgatgttgagctttttaaaatgtgctttttggccgcatgtagttgcttttgcaaactaaggtaataaagagggcaggggaaaagtggttcatgtttctgctcccaaagtatttatcccagtagctacaaaagatgggtgaaggaggttgcttttcagtcagctcagagaattggctagatggtggaagagatagcccaatagcacagaactatgattaacaatgctagtaaatgtttcctggggttggaagttgcttttagggattaagaaatacctttaaaaccaaaaaggctatcatagaataagtgataggacagactttagaaaaattcctagtatcttttcagccagtataggccttttcccagagatatcaaatgtctgctgtagcaataagaatgacaggaagatctaagtagctgcttctaaccagttacctatgacttttatcagtgatgcaggagacaaatcagaagtttccagttttccaactagacagaaaacataaggactttgcaaactacactaagaaatttttagagaactagtatgttagctaatctaagagcagaatgtttaagcacaagggtttccccatcctaccgagatctctatttgagaaagtggtttaatttttttttacttcactttaagaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaagtaagtaacacaaatacagaatcatgggagaaattacatagtaaaatattatggagtacctggttattttttaattttaaaagaaaaagatgctcatataattttaaattcaaatgcaacttttagtttttatttagtatttgtatttatttacagcttactcagtaatacaaaggatctgagacagtttctcaagttataaaggcataaaacaaggagtctatgtaattgggatagaatacggggacaaagaaaataaagccacagataagtagataccatgtgaccctgtaaggctgtcttcaaattttgtcctaagctttatggcagtcagtgtaaaaaaggaaatatgtcagggtgaagtttacatcatctacaaaaagaaagcaccatttatcctgatgttaagatctaagaggaacttctttaatgagttctacaaaagagagtgctgagtgatacagtagatggcatccttgataaaattcttataaccagcataatagattaaaagttgcataaaataatagattaaaagttgcattaaaatatttctcattatagctaagatataacagtaaacacaattgaatagaaacaatttttactcattttttaatgtagtctaggtatgcagctctctaatggttggactctgatgaaggtaaactccatgtatcaagagcacggagttttcctcagacaattctccttaaatgtcatgtcacttcaccaagatagataagaattggacagcagagaattaaaggttgcaatctttgacaaaatcctagagtgtagttaatctacagacaaaggatgatccaaaggctttgacaatcaaccaaatagaagataggattaaggttctcttttgcagattaaagagcctaactaggactcctgtgtgttttatgcacctgacaaggtctattctgttcatttaaaatagccaaaggacaaaagcagttttttttctccatgcctctttcccttcttccatttctgatcccttttatgtgctctcagcaagtgtagacataccttattaaaagttcaggatctggctatttgtctgtgcctctcaagcaagtagcttttcccccccaccaagggtcttactctgtcacccaggctggagtgcagtggtgtgatcatggctcactgcaacctccacttcctgggctcaggcgattctcgcacctcagcctctcaagtagctgggactacaggcacacgccccaacgcctggctaatttttgtatttttttgtagagatgaggtttcaccatgttgcccaggctggtcttgaactcctgagctcaagtgatccacctgcttcagcctcccaaagtgctggggttacaggtttgagccactgaacctagctgagaagatgacttcaaagacagtgtcctaaaaaatctaccgggcaggggaaggggatcatggtctagagatgagaagcagattcaaaatgagatgtggcccaagctgaaaagagaagggcaggggaaggaggacttgcttggagagagtgatactgtgaggaaaacgtcacttctcctaacctatcctctaaagtcagacttctctttccattttccaccttaatgtgtgagtgaaacactctctccaatgctcctgccaagtgatgaggggaggttactgctcagataaacagatctaattttcctactgtgtgtacacatgtatacacacacaccatccaaaaggtgaatatgcaaagctagtatcttatattatttgtcatgatcaaccttaaatcctagaataaatttgatttaactttgtagatcgtgttcaaaaatatggccagccgcccctatagcatttaccctcatggagtgaccttctcgccttatgaagatgaagtcaactcttctttcacctcaggtttgaatctttcacttctactgaatccaactagtaacttctgagaggctgccacatttttctgctattctccttgcccggtggtgtcactactgcagtcaggtagtatacatgtaggagtatcctaaaaatcacagccaaacccttctcacttcaggagttttgtctcttagtggtaacaaaatatggtgtcttttattagtgtcatagtggcctctagtggagcattatctaatggctacatgttatccaggttccaagtagaatatttaaagaattcaattgaacaatgagaacatttagacacaggatggggaacatcacacaccggggcctgtcggggggggggggtggggggcggggggagggatagcattaggagatatacctaatgttaatgacaagttaatgggtgcagcacaccaacatgacacatgtatacatatgtaacaaacctgcacgttgtgcacatgtaccctagaacttaaagtataatttaaaaaaaataaaaataaaagaattccttttgcaatattaattggttccagcgaaagcttatttatttatttattatcatgaaataactttgcaaatgaaaacaattttgaatatattttctttcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcaaggaatacaggtattttgtccttgaagtaacctttcagaaattctgagaatttcttctggctagaacatgttaggtctcctggctaaataatggggcatttccttcaagagaacagtaattgtcaagtagtcctttttagcaccagtgtgataacatttattctttttttttttttgtcttgtctatttttatcagtaccatcactgccgaaggcaagtctagagtgtgataacatattttgtcttagtttcaaattccaggtctgttggtattggatgtgttgagcaagttgattagcctttcctaatttcttccttttatcaaatgggtaataaccctcctaaaaatgttacaggtctgtttgggggttcagtgagataccatctggtaaaagtataaagctctttaccagtctttgctatttttagagacctgcaatagggagacagaggagagattctctgaaagcaaccaaatttagagacatagttcctagtgaaattggacccagattatggcccatctctgttgagactaaagtatacagaagaatgtgaacaaagatactgaatttctgagtttgtcttcattgaagaattgtagtctcatattattaaactaaaattcccaattatgctaaactgtaaccaaagaggtcttatctcaaggcatacaaaataaacatatgcctagaaaaagcagaaatgaatttctggacatatggaagatcctgatttattgagctaggaaaggaaacaggtagtagaagcataaggcttttctattgcaaccttctctttcatcctttgcacttattcagagcatattcagtcaatcattcatgttgaaaggtgtgcaattacagagatagacagactttcagctgccatagcgaaatgagatttttcttttgggatttgttttttttttttttttcttttgagacagagtctcactctgtcacccaggctggagagcagtggcaccattttagatcactgcaacctctgcctcctgggttcaagtgattctcctgcctcagtctcttgagtagctgggattacaggcgcccgccaccacccccatgtaatttttgtattttttagtagagacagggtttcaccatgttggctaggctggtctcgaactcctgacctaaggtgttccacctgcctcagcctcccaaagtgctggtattacaggtgtgagccactgtgcccggctcttttgggatattttaatctctgaattttcttatctgttctgtttgcttttgcatattacctttagctctaacaagtgctgtgtacacaatggactctcataaatgcctgaattatatggcttcagtagttccaagaactatgtcactttggtttctgagaactcagtggtgtagataatttgctgcaatgttaatgactgaatacagcacttttttttcttttttttttactcttaagttcaggggtacttatgtgcaggatgtgcaggtttgttacataggtaaacatgtgtcatggaggtctgttgtacttactacttcatcacccaggtattaagcctagtatccattagttattttttctgatcctctccctctttccaccctccatcctctgataggccccagtatgtattgttcccttctatgtgtccatgtgttctcataatttagctttcacttgtaagtgaaaacatgcagtatgtggttttctgttcttgcgttaacttgcttagaataatggcctccagctccatccatgtccctgcaaaggacataatcttgttctttttgatggtcacatagtattctatggtgtatatgtaccatattttcttcatccagtctgtcattgatgggcatttgggttgatttcatgtctttgctattgtgaagagtgcgaaaatgaacatacgcatgcatgtgtctttataacagaatgatttatattcctttgggtacataccaagtaatggaattgctgggttcaaaggtatttctgactttaggtctttgaggactcaccatggtatcttccacaatggttgaactaatttacactcccaccaagagtgtataagtgttcctttttctccacaaccttgccaacatctgttagtttttgactttttaataatagccattcttattggtgcgagatggtatctcattgtggttttgatttgcatttctctaatgatcagtgatgttgagcgtttttttcatatgctctttggccacatgtgtgtcttcttttgaaaagtgtctgttcctgtccttggcctactttttaatggggctgtttgtttttttcttgtaaatttaagttccttataaatgctccatattagacctttgccagatgcatagtttgcaaaaattttctcccattctgaatgttgtctgtttactctcttgatagtttcttttgctgtgcaggagctctttatttcaattaaatcccatttgacaatttttgcttttgttgctattgcttttggcatgttcgtcatgaaagctttgcccatccctatgtcccaaataatattgcctaggttgtcttccagggtttttgtagtttggggttttacgtttaagtgtgttgttgttgttttttgtttgtttgtttctgttatttttgagatggagtctcgttctgttgcccaggctggagtgcagtggtacgatctcagctcactgcaacctctgcctcccatgttcaggtgattctcctgcctcggcccctcggcctcccgagtagctgggattacaggcataagccacgatgcctggctaattttcttttcttttcttttcttttctttttttttttttttttagtagagacgggttttgccatgttgaccagactggtcttcaactcctgacctcaggtgatccacccgccttggcctcccaaagtgctggtattacaggcgtgagccaccgcgccaggcctacatttaagtctttaatccatcttgagttaatttttgtatatgatgtaagaaaggggtccagtttcaattttctgcctacggctagccagttttcccagaaccatttatggaatagagaatcctttccctattgcttgcttttgtcacagatcagatagttgtaggtgcgcagccttatttctgagttctctattctgttccattggtctatgcgtctgttcttgtaccagtactatactgttttgtcctccagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcagtaagtcagagtactatttttgttcatcagtttttcattcctgtggttgaaatatgactgtgcctagagtcagagacatggattaaaatctactcgctaaggggcacctccaatcctcacttccagtccaaagacttggtgatgaaatccgtgggtgacatcatagcaacatttttaagcaagaggtcaaaggctcacatccttagaaatgcgtttgatcttctattccaagcgtgtgtgtgtgtgtgtgtgtgtgtgtgtacacagacatactctgcgtggtgaggaaaagggtgagagagtaggactaatggaaggtgttatagtccatgtcaatagtatcctagactgagttcagggtgaatatatggctaggacagaaagaaggcaagtaatccaaagatggattgacacatcaaagtagagcaaaatgagtatagggacccaagagtcttggaaaggcatgcatgaagacatttcaagtgatcagtaagattttcagaacaaaaggaattccctgaatgagggttccggcatttgctgcagttctaaagttcagtggccaaaagcactgccatggcagtctgagagaaatgtcactgagccagctggaagcaaacttctccacaacagccagggtccccctactgatcctcagagtctagagtcatggtaatcaccttctctagtaggtaatcacacatgtgaggatgatttctgcatgttctgttcatatagcttcagatgactgacagctagggattatcagagctgacaggtgccaggtcaaataattcaaacagaaaattactctcagctttctttgcataacttccttttggcagtgaatctatcatagttctagaccagtgctgtccaatagaaactacgtatgagctacatgcgtaatttaaaattttctgatagcaacattaaaaagtaaagagaaataggtgacattaattttagtaatatgttttacttaactcagtatatcctgaatattatcatttcaacatgtaaccaatataaaaattaatgagacttactttattactaagtctttgaaattcaatgtatattttatactcacagcatatctcagtccagtctacccatatttcaagtgctcgataaccacttgtagccagtggctaccatattgaacaatgcagttatagaccatttagaaaaacatctagaatgaggtataaactaataatacatcatgtaaattattaaagtcacttaagtgatttaagtaggtatttaaatatttgttaatgccagtcattatactggtactaaggctaagagtggtaatcgaggtagacatgagccctgcccttgtagaaatcatacctttggttttttactatgcttagtacataagtaaataaaaatattgcctacagcagtgtcccttttaacaataatgaaatgtatgaactggatactcaaatggaaactgtgaatactatgtagattataagacagcaataaaaactataaaatatgctaaatgggctttatttttagggacattacttcttacccaatgactaatatatcaaaaagatgaatttcttatattatgcttttcctccaagtggaattattagaatatctttaaaggcagagaatggagcacaaaatatttactatacatttgatgaatgactaaatcaatgtaaatggaaggctttatctttttcctgagatttctcctttggctaatttaggagaataatctctcatttgaaaattctgagtttgatcttctagtcacatgttagactagataaagcttatcttggataatcactgctttgacacaaccaaattaacatggagacatttatcttaggtataattagacacatgcccttttgttggcatagacttggaattttaacagattttacactttcagctatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggtgagtaagagtctggacactcacagaggaagcttgctttgaatttctggtctataaaggtctgctgcaactctccaggctaccagtgctcctctatgtatctccctgaccccctgcaggcttttctttcaatgtttctcatgatttctctttgagaaattaatgacttaaatggatccagttctttagtgtgggttatatttttccttctctgggcaaagtaggaagtaaaaatatacaacagcagaaaaataaggcataactctgaggaagaagcataaatattttggccacaaaagagcatttcttttatcaaaatgccctattcggttttttgcaacagtcatcttcaatcatcaggtacagtgccttaaaggctgcttcagcaacagctttggagtttgtcagactggaatgcaagtcctgatctgccaatcgattgctgtgtaaccttacacaagttacttggccacactgagccacaagtcatttatctggaaaacagtgtaatcacatctcacagagttactttgaccattaaaatagtaatatgcgccaagtgcctagcactcagtagacaccaacaatggtaactattggagactcaccaagaaatctttgatgttccagcaatgcatgccatttcagagattcaaaattgtcctcgtgaattattacttagaaacatctaaatgtctcttatttgtggggatagagctcatcaccatccctttaattctaagacaagatgtgctgttaggatatttatgatattaaaagtccattttattcttgattcatccctttcttaatatattttaaaatagtgagcaactatctgtgctgaaagaccttttttcccctctaatctccactaagcaacacttttgttttttattctgttaagcgagatgaacgcactggtcatgtgcttagagtcacagcaatgtcaaattgctttagaaaaacaaaagtttactaaatatttcattctcatttttctctccttgtgttattttgacccagtaatcaataggtcacagacaagcagtggtccacagcccatacttgaatattcctgacgaaagtttattagaaattacctgccacaatggattattgtgttttcatgtcttttcccagacttccagatctctcttctgtctgtctctcttctgtaggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaatcaggtcattccgaaactcatcattgaatcaggaagaagaagagttcaatcttactgccctagctctggagaatggcactgaattcgtttcttcaaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaaggtttggccagttttctccttttttattctcatttttccattactgctgaaaaaagtagctactacaattcagggggataattgtgggcaaattatactaagaacagtgtggttcccctattgcaagttggcctgttctttttcctttgtcaattccaagattgcttctttaccttagatgacccctggacaatataagaacaatcactgtgagaactctataatattctgtaattaagcatttttctgtgtcctctcctcttactacccatgtttctactgactcttattgctccaggcagagcccaacctatccatagctatatgctaatcaatatgatttaattgaagttagcctcaaatccaaactcaaatatgatgtagaaatctcctttttgcatttacttgtttagatcagaatttctaagagatccaaatcccttttttaaaagaatatttacaattcagttttgcttaggggtagaaagccatgttgaactgggctctttgttctgggatgaagatacagaaagagaagagagaggaggaaaggagcaaggcttagtcaactacaaattctcagggatatagcatgatgactgtgcatcagctgtctagatatgcccacagcttttactaaagctgttacactaatcacttaaaaaaccaaagtgtaattacagtaggcaaacacaatgtatggtgtgacttatgcatatgagttcattaatctgatgcctgacatctccacattagaactctgtttaaaacaccttttcctatgacttcctatttaaatgttgcactcaataccacatgagaacaactagctacctgagtatttctaagcaaggccccgagggagtgagatgcagggcctgtccagagtgaatagggatggaaccaccttcaaaatcttgtattccattcaaggctcacaacccacttttatggcattcggagttgctttacccactcccttgtgttctgtgagtttgcatgttatgctcagagtctggaaagatgggattagtaggggaggtagaccagaagaaaggcagaaggagattctctgttgatgactcacagtatatagcaaatattatgggtttgatgggtgagtgtttggcttgtttccacaggcttgggaaatgtgagagtcagtgggagaattcgacatgcttcagtcctagactgagccaatgaactagatggaaataatgtgctttatttatttatttataatttgtaattaaactttttattttggaacaaaaataaaatagattcacatacagtcaagagaaataatacggagagatcctttgggtatcctgagtattctttacccagtttctcccaggggtaacattttgcaaatctataatactatatcacaaccagcacactgatgttgatactgtcaagacacagaatgttcaccatcaccataaaaatccctctcattacccctttatagtcacatctgccttcctcccaccatagcccttccttattccctggcaaccagtagtctgatctccatttctataattttgtcatttcaagaatattacataaatggaatcaggcaacatgtaacctttggggactggtattttttcactcagtataattctctggagattcatctggttattgcatgtattccattatatgggtgtaccccagtttttttgttgttgttgttttatacacatttatggtgtaaacatgatgttttaatatatttataaattgtgaattggctaaatcaagctaattaacctatgcattacctcacatacttttttgtggttagaacacttaaaatgtactcagcaatgttaaaaattcagtgtgttgttattaactacagtcaccatcttatacaacagatcttctaaatttatttcttctaactgaattttatcttttgaccattttctcaatgctccacctctgtatccctttgttaaccactgttctaccttctgcttctatgagctcaatgtttttagtttccacattataagtgagatcctgcagtacttgtctttctgtgcctggcttattttatgtaacataacgacctcctggttcagtcatgttgtcacaaatggcatttcttcgttttcttttttttaaatgctaaatagtatttcattgtttatgtagatcacatttaagaaatccattcatttgtttatagacatttgggttgcttccctatcttggctaatgtggctaatgctgcagtgaacgtgggacagcagatatctcttcaacatactgatttcattttctttgggtatatacccaaaagtgggattgatggatcatgtggtaattctatttttaatttttaaaggaacctcccatactgttttccataatggctgtactaatttacactctcaccaagagtatacaagagttcccttttcttcacatccatgccaacatttatctcttgtcatttttataatagccatcctaacggtgtgaggtgagccctcattgtgattttaaattgcatttctctgattattagtaatgttgagcatcttttcatatatttgttggtcatttgtatgtcttcttttacgaaatgtctattcaagtcttttgctcattttttaatcaggctatttgggttttttgctgaattgagttccttatatttttaatattaatattcttatcagatatctggttttcaagaatattctcccattccaaaggttgtctcttcactctgttatttcctttgctgtgcataaacttttgagtttgatggcaatcccatttgtctatttctgcttttgttgcctgtactttcgaggtcaaatccaaaaaatctttgtccacaccaatgtcaagaagcttaagaataatggacattagcaaaaaacaaatgtgagaagagtggctacttttagggtacaaaacattcacccatccagtgactttcataagtgtgaccttctaattaatctgaccattgtcacctgatagccccaagctctggcactgtcccattacatggctttgtctgcctttgatcttaaaatttggtgtgttaacatacgattatatttatacattcatttatatgtttgacaaaaatttattaagttcctgctgtgtgtcagataatgtgcttaccactggagagagtactatgagcaaactaggcacaatggctgacctcatggcacttatacccagtgagagacagatattaatagataatctcacaaataaattatatataatctacaatatatattctagagatattataagaatactacaggaatttactatatatactataataatactatagaaatatgagaaattgatatagagacttgacctagtctaaaaggtcataggaagacttacctataaaataatatttgagttaggaattgaaagatatttactggcttttgtttttatccacttatatatttactcatttatccaccaagtatttattaaagaccttctctatgctagatgctatatttagaaagagacaatttcctaaattctgggaacagtctttaatttcttcttttacacaaatagtattattatttcagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagtaagtcttttgagcactgctaagatcttcggaggaatttccacaagcaccagagggttgtaaaggtgcaggtggcaagagagctataggtgatttgtttgttttccaggattaatgaataattacatttcttttcaaagactccttgccaagcaatttggcaatcttcgaactaaaaaaaaaaaagatctcattttttaaatgctgaaaactatataatctgtggaaaatctttctgtaatttctatctaaagctaacctatctaaagttaacacagaaaattaatatattcaagagcaattgaattgggtttcatagcagtggtggtggtggtggcagtagcagtgctagtagtaatagtaatttagaaatatcttcaggtgttttcctaaaaattaaataaaatgaagttaaataaaatgagtaaggaaagtaaagatgtctccatgccctccaaaagtgagcaagtttcttcagtgtcttcctagttctggtaatttctttcaaaatcttgtgtccagacccacgattataacttgcttttataacaaagtttacttccgccatttttgctaaccgctcacattcaaaaacccagaaagaaccctgattctaaagtaagctattctagattttaaaatataatctactatacctgtgtaagcattcactacattttcagtgaccatttgctctttttaaaaacgtaaacaagtacatagggatataagaatcttaattattctaaattttccatgaagctatgggaggcaatattctcttttatgattaggggatcctttttcaagatgaacgataatttaacacaatatttaaaaaacttattctaagtaactcaggaatcaaaaaccagacactgtatgttctcacttacaaatgggagataaactgcgggtatgcgaaggcagacagattggtataatggacattggagactcaaaagggaacgggggatggatgaaaagctacctattgggtacagggtacactactcaggtgacaggtacactaaaatcctagacttcaccactatacaattcatccatgtaaccaaaaaccacttgcattcctaaagcaactgaagttttttaaaaaatttaaaaatcaaaattaatgcacgaaagccacaataaacaaaacctcacaattgtgaataaagacaggataagtaacaatgttgcattgagacatactggagccttaggcaaaaggaaaaaaatcaaatactgaatctttgttttagccctggatttcactagataaaaatgacttcatttgtgtatttttaaaataattttaacttttattttagattcagggggcatatgtgcagttttgttatctgggtatattatgtgatgctgttgtttagggtatgattgatcccatcatccaagtagcgtgcatagtacccaatagtttttcatcccttgctcatctccttccttcccccttctagaagtccccagtgtttattgccatctttatgttcatgagtacccaatgtttagctcccacttataagtgagaacatgtggtatttggctttctgtttctgcattaattcacttagcataatagcctccagctggcatccatgttgttgcaaaggacgtgatttcagtctttgttatggctgcgtagtattccatggtgcatatgtaccatattttctttatgtagtccaccactgatgggcacctagattgattccatgtctttgctactgtgaataatgctgtgatgaacatcctagtacatgtgtcttttcagtagaacaatgtattttctgtctttctttcttttttttttttttgagatggagtctcactctgtcgcccaggctggagtacagaggtatgatctcaactcactgcaacctctgcctcccaggttcaagcaattctcctgcctcagcctcccgagtagctgggattacaggcacccaccaccatgcccagctaatttttgtatttttagtagagacagggttttaccatgttggccaggctggtctcaaactcctgacctcgggcaatctgcctgcctcagcttcccaaagtgctgggattacaggcatgagccattgcgcccggctgaacaatttattttcttttttggctatatacccagtaatagaattgctaggtcaaattgtagcaggacaagccacagacaaaaacccctcagacaccaagttaaagaaggaagggctttattcagccgggagctttggcaagactcatgtctccaacaaccgagctccccgagtgagcaattcctgtcccttttaagggctcacaactctaagagggtccacgtgagtgggtcgtgattgattgagcaaggagggggtacgtgactgggggctgcatgcaccagtaattagaacagaacagaacaggacagggattttcacagtgcttttctatacaatgtctgtaatctatagataacataaccgattaggtcacgggtcgatctttaactaccaggtccagggtgtggcgccgggctgtctgcttgtggatttcatttctgccttttagtttttacttcttctttctttggaggcagaaattgggcataagacaatatgaggggtggtctcctcccttaaaatagtagttctgtttcaaattctttgagaaacccccaaacttctttccacagtggctaatttacattctaagcagcagtgtataagcattcccttttcttcacagcctcaccagcatctattttttgactttgtactaatagccattctgactggtgtgagatggtatttcactgtggtattgatttgcatttctctgatgattagtgatgttgagcatttttttcacatttgttggctatttgtatgtcttcttttgataagtatctgttcatgtcttttgcccactttttaatggggttatttgtatttcgcttgttcaattgtttaactatcttatagtttctggatattagacctttgtcagatacatactttgtgaatattttttctattctgtgtctgttcactctgtagatagcttcttttgctgagcagaagctctttagtttaatttgtcaatttttgcttttgttgaaatgcttttgaggaattagtcataaattctttcccaaggctgatatccagaatggtgtttcctaggtttttcttctaggattcttatagtttgaggtctgacatttaaatctttaatccattttgagttaatttttgtatatgatgaatccagtttcattggattcattggggttcagtttcattcttccacatatgggtagccggctattccagcaccatttattaaatatgagtccttttccccttgttttttgttgttgttgttgctgttgttgttgactttgtcaaagttcaggtggttgtaagtgtgtggctttatttctgggttctttattctgtttcattggcctatgtgtctgtttttgtatcagtaccatgctattttggttattgtaactttatagtatagtttcaagtcaggtactgtgatacctccagatttgttctttttgcttaggattgctttggctattcaggctcttttttgattccatatgaattttagaatagctttgtctaatcctgaggaaaatgattccagtagttgttaaaaaatagtgttgaatctgtagattgctttgggcacaatggctattttaacaatactgattcttccaatacataagcatagaatgtttttccatttgtttgtgtcatctatgatttctttcatcagtgttttgtaattcttcttatagagatctttcacctctttggttagatgttttcctaggtattttgtatgtgtgtgtggctatgtttaatgggatttcgttcttgatttcgctctcagtttgaacattactgatgtatagaaatgctattttgtacatttgtacattttattttgtataattgattttgtacattaatcttgcatcctgaaactttactgaagtcatttatcagttcctggagccttttcatggagtctttagggttttctaggtacagaatcatattgccaatgaagagagatactttaacttcttttcttctttggttgccttttatttctttctcttgcttgattgctgtgactagaatttccagtactatgttgaataagagtgatgagattgggcatccatgtcttgttccagttctcacggggaaggctttcagcttttgctcattcagtatgatgttggctgtaggtttgtcatagatggctcctattagtttgaagtatgttccttcaatgcctagtttgttgagggtttttatcatgaagggatgttaggttttatcaaaagctttttccacatttattgagatgatgatactgtttttgtttttaatgcggtttatgtggtgaatcacatttattgatttgcatatgtggagccactttgcatcctaggaatgaagcctatgtgattgtgatgaattaatttttaatttgctgctggatttggtttgccaatattttgttgaagatttttgtgtctatgtacatcagagatattggccggtagttttcattattcattgtgtctttgccaggttttgttattagggtgatgctggctttgtagaataaaataaggaacagacaattagggagtctttaatcactagaagttatagaagggctgggaggagcttcatgggtctgactgctggggtgtgaagacttctcatatggcatttaagtcctttaccatctggccccaacctgctccttttctagcctcatttctcaccaggttccacctgtccctgtgcatttcacagcccagttccaccgagatccttgctattccccaaactcttcctttactcccctgctcacaggcatccttctgcccttctgagagtctgaaatgtctttctagctcctgttcattctatgatggccaattccatttcctctaagaaacttaccttaattcttccaaccactcctaaatattcaaccaaattgttcctccagggcattgtcatctgaacccacttagactttgtatatagcacctgttgtctccagatttgtagtgtggatgcccatgtgcatgtctgtttcagcaggagcttaaaagcttcttatgaacaagaatcaagcttctttcatcttcacatctccactacctatcactctcatttcattagtagataatgtcagtactttagccttgagcctaagaacaaatatcttttggtatttctggagaaaactacttgggccatatctcacaggatggttatgaaaattaaatgaaataatatacataagttattttgtaccttatatcttagctccgattttataaccagccattttgacttataatgctgacatttttgtggtttagatttttgttaagcttaagtacatttgtggatcattccttttcctaggttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagtaggtactttcattgaaagtttttctcattcccctaacctcgtaatctgaagtccaccaaatggaagagtcggggttatttcttgtcaaatgtctgtcttgcttttcatgaggaatgcataagggtgtggttaacagtctgcatttatcataaccagggactctccatgcagctcttcagatgacagagagagaaacatttattcagtggagaggaggaaagattacttgaatgattggccatgaattagaatgcctacatttacagaagatggcatttatttgaaattttcttgaacaagtattagctatgttctgctctttctttatgaaaagaactgcaaagtcaagactcctttatctgacattctgcaatgtatatatacttcaaaacaatatgtcatacacagtatatgcatacaattttatctgtcaattaaaaagagaaacaactcctccatttcaggcatagtggaaagagcacagactcagatttaaatttttaccctgtcaatgcataatcctaggaaattccttgacctctcttagcctggtatcagaagttaaaaatgagataacagtacatagtgcatggtaagcacttggtaaatatttgttcaatgaatgaatttatatttaccatataagatagttgtcaggattaaatgggagattgcaggcaaatcatttaatatagtaatagattctcaataaatagtatcccttatattatcaatttattattatcatcattgttactgggataaagatcaatcagaggaaggaggattatgaatacaacagaattaggtgataaatatccaggcttattatgccattcatttataatcttcatcttcaaattcagagcctatcagaaagtttccttttctatatgatgagtgattatcagaagagcaaggaaattcctgagaaagaggcaatacaatttactctgtttttccaggaaaaagatattcactcaggcttgataggtcccctcctaatctgccaaaaaggaatactacataaggacagcaacatgcctatggacatgagagaatttgtcttactatttatgacctttgatgaaaagaagagctggtactatgaaaagaagtcccgaagttcttggagactcacatcctcagaaatgaaaaaatcccatgagtttcacggtattttcctcagactttgatctaatctcctaattaaatcacactgggtcacagtgatttctgcccttagatattcacaagattagacatgagatgcttctgagacacccagagctacaactaaaaccggttccttaacattccagagggctgatgtaatctggcaggtgacactgtgggtgaggcaaaaagagaaagtctgaaagatagcacagagaagctgctgcaaaacaaaccaacagaaaaccacaacaacaaaaagccagtgtgcttcagctggtaacatacattgaaaaggaattaacattgttctgcaatttaaagttaataagcttgtttctggatctctaaaggcacaagtgtttatataaaagaaatgatcacctgtgtgtcttttctaaaataagaatgacgctaacagttttagctctcagcagctaccaggtggcacccaaagcatatgagaacaaaatgagataagaaactaggtacccaggtaataggagaatagtggcaagagagcatttgggtggtcacactgggaaaagtgtgcctatttggaaattcacaaggaaaatttgccctgtaagctagtaactgaaacagaaactgagaagagaaaggtacgagcttgtgttatgaatatgtagataggtgttctcacgcctgatataatttgaaggatgcccaaatgatctcaacccgtccctctccaaaaattcacctgcctggtttctgaaatttcacagcagttcctctaacttaagaaggaggaaacaaagcacttccttcactttggtttcagttaaacgtttggtaacactaaactttatctttacagttttgtgttacatttttaaggtgatcaagtttctcaggaactttttaaaaaatccgcgtattttactgtggggagagtagataaagcctgagaaccctagttatctaatctgagaagtgggcagaggagttgtcataccaataagagaataaacatgacttgctatggttgctggatacaccaacgataaactcctaattttataaactcctagacttcctaatttgcctgaaactttctctgaatttagaaggccttaaggtgacatgctgcatatctccttgctgactctaatccctggagtttactttgtctgcccatatttgtatttatcttttgtagttaaggaaaattaagactgttaatggaaagtatacacgggtaaagcacggaactgtaaaagctgaggaaaagagtgataaactgcttggaaagggagttccccctgccttctgctgtaggctggtgtgaatgatatgagaaggactagtggttctgctttagcctctcactaatgtgacatacaagagggccctttccatggctaggtaggcctgggaatgcagaatcatgaggaacatgggtgttgagtgggttgccccatatttccttaccactcgccctctctgtgtcaacagatttttaattgatttcaactctttgtcctttcagccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggtaaagattgggtaatgggaagaggtccctgctaagaaatacagggaaaaggcaatctgtaactccttctcatttcttccttgtgcatatacttcctaaggggtcagaacacagggttctggcatagagcctaggcaaacccatagacccaaagtatatacggagtacaaaaatgtcacctaatttatgaactatttgcagcaccacacaggctaaatgtgtgacccaactcagttgcaacataacatgcagtttctcccaagccactgtgtgtcatacagatgaggtcttaagcagatgaaaaaatgaatcccacagggctcaggcagctacagctatctctgctgggagggtttccagattcttcagttctgctcctcttctaggccctatcaccctaatatctttgggcaagtgactccaggaatcacattcttaaactgacttatagactgtttgaagaggaaaacatttttaaaaaataataataaaagttaaagaataacaaaggtatttagaacttttcatgtgcaaaataaagataaatgtagatttaaacagtctacaattatacagaagggatgtttctgtgccaatgagttgtttgtaagtgtatctacttgtgcagcagtataaaaacctaggaagtcagttaaaatgcagatgtgaaggcagagggattttgttctcagagactttaaagtagattttgggcagaattccaaggagtctgtatttttaacaagcagccttccttctattttgccttctattaaaagtaatggcaaaaaccgcaattatagtttgcaccaacctaacacatgctgcctgaggagttagtgaaggcagcccctcgacagcactttgggtgacgttgtgtgaatctgcctcagatgcaggcacagaagtccaaatggactggtttgattaagagcagggaaaaaaagagggttcttattggtttttcacatgccagtaactcactaatacatctagagagtattaattgtattatattaatatcatattaattaattaatataataattaatagataatttattgtattaaaatcagagacagaagagattcagtcaaatttactcatcttttcatcaagtattagaagatcagtcatccttcctatcagcctgcagacagactgagaagctaggattggctggtgtctctaaatctgcaaacctaaatacctgcattggagagaggaaaactggagacatttttcagtgtgtttgaggaagataatcatatctattcattttcacccacaatctgggaaacagtcataaattatagtcaacagaatttaaatattaactgccagggggtaatgttaaataccagaatggatagccagaggttttagaaatctcattctttcagtgttttttctgagcaatttatgtaaatctctattcaaatatgtaagctttatggaaaacttgaaaacatggaggaagaaggttttatttttattttcttatataaaaaagagaaaaaagcaaaaatgaaaagagggaaaggaaacatgtatgatatttttgaagcccaatgatgtcattcgaggtcactttgataattaggactgtgaagctgtattgtatgtgagttaatttgtaacattatatttagataagtgaaagtttcttctagtgaggtgtggtggtgatttaaaattttttttagttatctctgtgtatgtgttgttattgttttgtttttatctgttatactttcagtcctacctaaagaaaaatggttaaattctatttgaaagcctcttgtgaagcaggaattttaggattcttagagaactatcaaccacaatatttacttgttaatttttgcaaatgtaatgttgttctttttattttaggttcatttaaaactcttgaaatgaaggcatcaaaacctggctggtggctcctaaacacagaggttggagaaaaccagagagcagggatgcaaacgccatttcttatcatggacagaggtatcacaagagccatgtgatatttggtttggcaggagagtgcctattactagaatattaccaacttttagattggaaatattcaactctaagaactctgatgtgacaaaggcataatttgtagccataattgcttttattccggcccatggtctgattgcattgaaaacacatcagtcagatcaaaagcattcctgtcaattgggaaacctgtgtaaagcatccttcttcatgacttgtgatccatggacaagtgcatataagaaattttccagcttccaagagttgaggagggaaaaggtcacaggaatttaacaatgactgagtcactaaacttgacatttcagcatttaggaaacacagttttcatctgtccatctgttcatccattctttaagccattactaagcactgttgagtatgaagcactgtgccaacatccaggtagcacagtggctggtatcccttccttgatcaagatataaataaccttgtaactttgaggtcaacttttgagaacatagtctcatcaggactagaactttttttcatatttttatattttgtatttttattttttttgtagagaagaggttgcccaagatcaaactcctggcctcaagtaatcctcccccctcggcctcccagagtgctaggattacaggcatgagccactgcacctggccatggatggtacctaatgttgtaaaatagcataatttaagataaaagcagaagaaaatcagtttaaaaaatgattacatttcaggatttcagttgctttcttctaggatgccactatatctattaaagcaccagtcttgttagtgcatttaccattttataatcagatatatttaagtcagggccacacaaggtaggtaaaaatatctaattattgagtcagaaacataatccctaaccatggagttttactttattgtatatattttctaagcaaaaattattcattttttttctgtttttcatagactgtaggatgccaatgggactaagcactggtatcatatctgattcacagatcaaggcttcagagtttctgggtaagttgtagcaccatggtctgtgaatggtaccccctacagttgtgcagcatgcagcctatgaaaccatacatgacaatcctatctatgaatcagtttttctctttatgcttttctctactacaatgtagtgaagcagctccatttggggtacatatatggtaaaggaaggaacactatggtaggagctaaaggcctgttagtgtgctcttaacactgccacctcttctggtgtataatgatcccaaagagtcttttccaggaaaaaccgatagctgggggtcattgatttctctacataaaaagcccagcctctctgcagggatttggcaaggatcagataccttactcttatgaccacgcgcccatttccaaaactctcctcagtcatcttttctgggtttgaccacacatgtagtatttcagccagattcacagggtcttatcagccaggcattatagtccccattaatatggccctttgcctgtggcaaccattcatctattcagaaaactttgttgaacctccactatatgtgaggaactcctccaaagttttcccacactgcctcaaagcccttcccaagatcaagaggtcatgatcaagaggatgatgaggctcccatatacccttccatgtcttcctgttaggcaggcacattcagcattaggaatataaacacaacagaaaaaatcaaacatgacctgtgtgcaagaaaggggataggaggtggttggcagttgaccaaacacagacctgaagcccagatttcatcatcaaggactggcctagtagctgaggcccatgcctagactcctgactacaacacaggtcctccaaggatctggttttccactggattaaactcacttgagaaattgctgggtttttaaaaaattcagaataaatctttttcttcccttgagtttaggttactgggagcccagattagcaagattaaacaatggtggatcttataatgcttggagtgtagaaaaacttgcagcagaatttgcctctaaaccttggatccaggtttgtcttaatagactgataatatttactgctatcgtaataataaaaatgaaagtgatttagtaattccttgttattgttcttgcaatgttgttaggggaaatagcaagtactaagtgtgaggcactgttctaagtactttatatccttaaaatcaaccctctgaggttggttctaataatatcttgttttatagattaaaaaacaaaaggcacagagatactacctaccttcccaaagtaacacacagctaattagtcattgagttgggattcaaatttaggtactctgtgcccaaatatgaattgcatgtagtcattgtatcagtttgctaagatcttatgtgctagctctttagttctgaagaaagctgattgtataatgaatttaggcagtgtgtgacttgttgacaaggacagttctgtttactggctttcctatattgcaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatggtttgtgtgcatatttctatctgaatctctagactctagacttggcctagaattattatgactatacctaatgattatgtattttaaaaaatacctttctgggtattagaaatgtgaatggctttctaagggtcatatggagaaaagcagtaatatgataggtctgtgtcttacaaattaaagagagaagcagggttactgaaacttcaaaaccccacaaaactttaaaaaatcattttatcatcaaacaaaatacccagatttctcagactggccaatggtatacggcagagtagaacatctggtcttgcgcctcaaggagctcatgctaaaaattggctaccaagacttttgattttactattgtagtttgttttgttctttatttcagtgtacctgaagtaaatagtagtgttaatgctagtaagcctctgaggcagtgtgattctcagactttttggggggccatgcctgaggaatgacattctccttctggttcttccaggggctcagccataagccctaactcttctcctcctctctattcccttccccaaagaagtctgaatgcaaggagtctgcctgccattattataccaataaccttgagtctgtttctgcttatattttatataaaattatttactgtttattagttacctatttttaataattatttatactatgtctcagaaccattgaaatcctaaattatggttcttactaatcagtattatgagagaaaacacagattgcagttgagtccatagcataaagattttgtcgtctatgttcatgagaggatattggtatatagttttatttttttaattgtctttttctgtttttgataccacagttatactagctttcataaaactggtaagcatgctcttttctacattctaggagaaaatgtctgcaattggtaataattctttaaatatttggtaggaatcactagtgaaaccatctgggcctgcagatttctttttgggcagtttttaaattacagatcctatgttctaaatagttacagggctattaaaattatctatgtcatattgggtgaattgaaatactttgtatatttcaattaactggtcaattccctctacgttgttaagtttatatgtgtagagttgtttgtatattcccttatcctttttcatgtttgtagtgattttgcctgtttcatctctgatattgtcatctgcccctcctttcttttttgtgtgaatcttgctagagatttgtcgattttaaaaaaatcttcttggccgggcgcagtggctcacgtctgtaatcccagcactttgggaggccgaggtgggcagatcacgaggtcaagagatcaagaccatcctgaccaacatggtgaaaccccctctctactaaaaatattaaaaaaaattaggcagggtggcgtgcacttgtaatcccagctacttgggaggctgaggcaggagtatcgcttgaatccggaaggcagaggttgcagtgagccgagatcacgccactgcactccagcctggtgacggagtgagactccgtctcaaaaaaaaaaaaaaaaaaaaaaaatcttttcacagaaccagccttgttttattgatttttctctattgtttttctgttttcagtattaccgatacctgctccaatcttctgttttaaaaagttggctttttctgacattgctctgtcaggaaaaggggtagggcacagcctgtttactgccaagtgggggtcaaagtccaggttccccactccattgccacctaagaagggattgttccttggtggctgggtgggaagggaagttccccatttggcctccactgatactgcaggggcaggagcttcattaggggctggagatgaaagccctaaatccctacatggccttttctgacacaaccccagtgagggtgtagggtgcctctttagcctcaggagcatagaagtctaggctccccattcagcctttgctgttgtgggttggggaggggcctcaggtttttctgtggtgtttgactaaaggacagaagtcagtgtccaccagttttctatcatatctcgctatgctgccctttactggtactttggttagagaaagcagattttatttgggctttttcagtctgtactcattggtgtttccaggttgccggcttcttcatctctaagtctgggatttatgaggcaaaaagaaaattcaagacactgatcaccattttgttccttccgagaaccctagccagtctgtcttctgagctcttttcagggtcttatgtttctctgagctataatgtccaaagtttttagttgtacttagcaggaggaatagggcaaagtacatatatacaatcttcctggaactggaattatccccaagtatattttataaccaaattgatttagtttggaccccatgaaaatgtagtattacaatattaaattagatcaaaattttaatataaagtcactttatagatcattgttacataactaaactttcctcttttcttctagtattttaatggcaattcagatgcctctacaataaaagagaatcagtttgacccacctattgtggctagatatattaggatctctccaactcgagcctataacagacctacccttcgattggaactgcaaggttgtgaggtaaatggtaaggtacaaagatgcattattttctcactgccactcaaagaatcaagatttgggaggtataggagaatgagtagaatttttagttcttttcagtgacttaggctcctaggaaaacctttgtgaaacagaggttctactcaggtaaactctcagtgtgatctagaccaagaatggttctgccaatcagagtgccgacagcatctctgtgaagaaagtgcctggattatatagacacatcacaactctccaaggaagggctctaatttggaattacctccatcagcccattttcaataagacctacctgagattcaaactaggcctgactcttccaaagtcctcaggtcactcaaacttcaatgtcatgacagtatctggcaacatcactgccatatatatggtgttcaatgagtgtttttgaaatctgaattggcttcccaacttcctgaaaccacaattcttctttatattttctttcataccctgtgtaggtactcaagtcttttctatgttagctgctatttctcaggggctgtaatgtgacctgtggtataaataaatccaggtaatcataaatggtcataataaaattctactatatatagcaaggatgtttaagagtcttaactgttcttcttggactcttaaagcagtgctttccaatattttttacttcaaagcacacaaagaaaataatatctgcctggcattctgaggtaaaagaatgaagcaataaatctaaggcttggctgatccaggccccacttggctgctgaagggctggaggtgggaagagggatcaataaataggtgcactagaaacctgccgtggcacacctgtcaggagttgcagtacttccctttgggtggagagaagccaccatgattcacaatggagaaagtagctgaaacctggaatcagtttcctgttgaagcagataatggcacagtatacccttggatggatatgggtattttgccaatgtccagatagcagtagtctaaaacatctcccaaataaaacacagatcttgtatcggcaggaccactccttgaaacagttccataagtcattgcgtttttttctttccatatggtataaatagatttgttcagatcctaataaactaccctaaaatgtgacattcaattctgctaacttatttaaaacatctattttttatacaagaagcattattttcttcttattcattttcttgatacttaggtaattattagcagtgggtattatttttaggaccctttgtttttttcatggagaaagtaaggcatcacttcaagaaaatttctgcatgatttaccaacaagaacaaagtgtcacagagatgatgggtggtcagccaggttcactcactagctgtgtttcttacagtcacaggtctgccttgctgcctatgatattcaaattacaccttggaaaaattccaaagggtacataactcgaattaccctctaagggttgaaacagaaaatattaaatagtgactgagggtccattgtatcttcttggtagcttttgttagaagaaacagagtatttttatatatagataatttaggattattgtcacctgaaagcaaagaccaaagtttccaagactctcagaaggaggaagtgagtttaaatgtttagaacatggtatttggtatcagattgtctgaactcaattcagtttctgattcttgtggctgtgttaccttagacaagttactgtgttttggctgtactaaaatggagatatttatgagcattatataatacatgtaaagcctgagaacagtatttggcacttggattcaataaatcttcattgttgtggttattgtttttgtcatttgttggtagtaatattatttcttatctcctctgcagtgcatgaagccatgcagggaatattggtgtgtaattaatcacgttacttttcttttgataggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggtcaagtatactctatgcatggtgttctcttagggctccagaagaaagcaaaggccctcactaccacaaacatggaggatctgggaagcaggagtattttaatctgtttctgcagattaaaatcctaggtccaagagtccaggatgtctgtggacttgatagctttgactataactttgtctcagagagaagtcatttatcatctctgtggtttttggtctagtcttgatttaaaccaataataagcaaattaatttttctgcaaagggatagatggtaaatattttagtctttgtgggccatacattctctgccataactactcaactctgccattgtagcagtaaagtagccataaacaatatgtaaatgaatgagctggctgtgttctaataaaactttgtttacaaaaaacaggcagcgggccaaatttggcccatggatcatagtttgccaactcctcatttagacagcttacattagtgataaaaaaatgatttagatttgcaacatcatctcttattttttctttacaatttagcaatattttttcattttcctaaatgaaatgtcatctaaacttttttgttctcttccccgccctccttattttaagagctttgtgatattccttgaggcaactagaagcatagtaaaatgttgcaaaaccagagttataaaatcagtgatctaagttaaacaaacaccttccagagagttatactgtccctgatattagcccactgagtaattcaggtgatttaatttgggggtaactcttaatatttgactcatttttattaattctttaaatgacctgagatatcagaatggcatgaataacttgatgatcccttcagccaactaaatccaaattccctaatttctatcctcatatctccctcccttaagatacctacactccaatttcctggctttctatagaattccagggcctatccttaaattaggccactagaaaggaaaaaagaattgtggtgctggtggcgtaaatagaaaagattggattccacacagtcttgggaactgatatctgtgtcttgaaactcattctggcccaatatggaatcacagaatgttacagtagcaaggagcaaagcatctggtctagatttttccttttaattctaaatacacaggagattaaataattttagcttagtttggtagcagaatcaggactagaatcccattctcccagtaaacaggccatgctccttccaccatttgaagcagcccaaatacctcattttgcaattttgcagagggcaaagctgacacccagagaagttaaaataataaaaatagtgttatattacatttatataatttacatagcaatataaataataattaaagagatgttatccaattctttttcagatgactctttagacttgttcatggtataaccttgtcactccatacttcattttacaatcttttaaaaaaatttgcactctctataatttgctcttagtctttgtgatataacaagggcctcaaagataaaatgctaatttttaatggtgtcatttcaaagttagaattcgggatcagaaatatgtgttttacttaacccccttccattcacatgaaatgtctttatatggtctctttagagaggttgaaaatcaaagctggacatatgcagtgatgcacatagatgctgttctctccataactaaaatgtctctacctcttttatgcctgtgaaaacctctagctggttatactctgcatcactggtacaaccttgatatgaagacacactaagataccacccagatgtcactagaggatgttatagacttaaaagttttctcatataatcattctaattcagttaatttgcttttaaaatacatatagcatgtgaatttttgtgtatacacatatatacacatacacctatatatacacatacacttatgtatgtgtgggtgatgttgaagaaacatatcaatattatttcctttagaattgaatgaggttatggtagacgataaatctcccaaaggtaaaaatttatcttagatgactctaaaactcagtttagaccttctgatctttctccaaacacatatcaccaaccatgtgattaggcattttgttaggccagagacaggacaataactgtactgtgtatcaagctctacttatggttttatcaggtctctcaaatgttacatttatttgaaatattagaagaaattgaactatttctgctctttgacattaacagggggaaagagaagttgtgttttgtaaaacaggtgaaatagagagagaatgctatccaattatttcccagataaccctgcagcaatattaccagagtatttaaagaaatttgcttaagaaaataatattcacagataatttagcagtttaattatttttccaaataaagctcatttattcattcatttattcaacaactatttattgaacaccaactgagtgtcttaacattgtggtgagtaccaggaaacaaaatgaaataagcctctacccttaagcagtaaggaatgctaagaaggaaacaattatagtacaatgtgtgaaatacttcaataaaaatttacacacatattgtggcaatgaagaagaaagagggaaagcttctaggagactgtgaatcctaagggataagatagaacaaaatccttttgagctctgtgcttttttgcataacttggtctaaaaaaaaagcaaaggttttaacatcttccttatctatgtgtttttgtcattttcataggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaaggtagagtggcatctgggcaaagagaaagcaatctgaagactgtgctataatgagaataacagtattttgcatttgacaaatatgcagtgacatgtaccacctctttaagtcttctaaatcttagttcttaaggtgcctggtctcagacaaactcctggttgtctgttttggtttgttttatttctcactacaccaggttgccctcataggaggataaatatcattgtcataaaaaaaaagagtgattttatttctggtgtgtgtaaaccttggggaacttgctgatgatggaagggggaaagttatacactttagttgaggatataaggtacatgccaacaagaataaataaattaaaatgcatggtcacattttaaatgttagcaatagtcaaacatttattggtggccacttcctggcacttactatgcacttacgttgacatacatttttaaatatttacaatgacttctgtgaggtaaaatgttattatccttattttgccaatgaggaaatgaagaatcagagaataagtaacttgttcagtcatacagctaatacagacgggctgaaggcagaaatggttttgcagctgctccacagcaccatgtgagacttgtttatttttcactaatttaagtcagatcactggtgagatgaaatctatctggcatgtgatttcataactgatagaggatcatctctgtgagagtgttctatgtgttctttgatatgctcattttgagctaataggataaaaaattttctgggttgggcatgatggctcatgtctgcaatgccagcactttggaaggctgaggcaagaggattacttgagaggagtttaaggctgcagtgagccatgactgtgccactggactcaagcctgggcaacagaataagaccctgtctaaaaaaaaacaaaaacaaaaaaccttagccatttatgttgtcattaaagattttctcttatttggctttcagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatac

SEQ ID NO: 36642 - DNA, 72313 bp, Homo sapiens; identical to SEQ ID NO: 36641

SEQ ID NO: 36643 - DNA, 44977 bp, Homo sapiens
cggtggctgctgcggagccggcagcgcaggcgggcggagcggagctgcccccgtggtggcgggcgatgcccccgtgagcctccctcgccgcccctccccgccccgcgtgcctatccactcggagtccgcgccagcctggggccgggccgcgcctactgccgggttcgcggggcggggtcccggggcagcacctgccccgccttgcggagccgcctcggcctgtggaggccccctccctgtctggaccccggccccacctccgggtaagtcagcaggccttgctcgcctgggagtggacgtggggagggggctgcagaggtctggaggaccacggggggaggggggctctggccatgaagcgcaacgtaggtatgtgagtgtgcaggggcgggggtggggggatgaacacagggtgtgagagggctctggggaggggactaagggatgagagagggacgtggggtgtttggggaagcctggaaaatggggaagggggcccagagtcttgagttctttgctgatgctcagagctcctggggccctggtcttcaacagcattgcctggcatggcatttttggaaagtgcttaaaatccctcctggaaagggagctggaaggcagcctgcttttctcccttctgcctgtgccctggttgagaagcagccactttttcctcaacgtgacaccgttgtggtgtccagaggaccccctccaccccataaaagaaaaggagtgctgcttactccagccctggggtgggaagagggggctttgggaagctgggaatgcagttggtcagcagcatggtgcagagcccagggttcagggaggcttggcaggacccttgatgggcaacttgggcatgctctcattcatagggaggagctcttccctgactggccgcctgggtacctggactccatgtccccatcacctctggacaactcagccctgaggagtgggtttcttcagtgtcctggtcctgaaggctcaggaaggatcctggaatggggtgggcaatggcatatcaaggctggagaacagggggcattggctggcactgccacttggggcctgtttcaatgtggtccttcagggcttggacacctgggtgaatatgtgtccaaccctagccccaggggtgttatcaggatgtagggaagaaggctgctgctcctttggtcctgtcctctatccatgatgacttcttaagtctgggttccttgggtttggggcctgaagtcatgggaggaggattgggcctggtcaacaaggggttaatgagccatctcccccaccccaccatagttgctgccagccaccaattagtctgtaatcaggcagctgccaactgtccctgggggcatgtgggtagcctaatggggcattcttggttgggaggcggggtgggtgggttggcagggatgtgctggggaggtgacccatgtgccctgtgcttaaaccaagcaccatgccctttgttgtttgtttagggcccacagaccccttccctgccttctgttcctgactgccttgcttagggacttccagccctggggttctacacttatccgaccctttgcagggtatgaagcccagagttggttaaacttggcttcaaacccaagctctgccactttctggctgtgtgatattgaggaaatcacttcccctctctgagactctttcagtaaaacaaacccagctgctatgtgggtagcaggaaggagtgagtgaaatggtggatttgagctgcgcagcacagtgcctggcactcaggagggctcagcagctaactgctgaactcatgagcaacccctgtgccaagtacttgctgggcgggcgtgcaggagccaggtgctgaggacccagcagggaccacggtcccttctcccagggcatgtggtctgtgtcactgtcttaactattctctctccctccctccttgctcaacgacgcttctggtctctggactttaattggattttactgcgcagaacccaggcctaaagctgctactctctgggcttcccaacttcctgcccaggtgctgagctctgtggggtctgtcaggggtctgggtgatgtctgcagctgcagtagcagctggccctttaaggagggaagaaaacaattatctggcctgggcattgcatcagctggagcctggagggtccctggggaggggggagcaggctggtggttgatttcattagtgccatgtgagaactctcacctgccccactccccagccacaaccttctcccccaggcaacagctgcctcagtgcctcctcccactccaggggcaccaccttggagaggtctctgtgtgtaccccccagtcaatgtcatgggccccagaagaggagggaagtgtctctcacattggccttttgctgactgtggcactgtctctcctgttagcaatctgctgacttggggtgcagggtgcgtctcctgtactggcattttgctgacgatgggggtgtttctcccacactggcattttgttgacccaggggaggagtgacttctacactgtcctcactgacagtggggctgtctcctacactggtatatcactgacctcacagaagagctttaccagctggggtgtgtgtgaactgaaggcggaggttagaaacaagtgctctctggttggaggtgagcttgctgggaatggtgagtcacaggggttgtgtggtttggggcagagaagagaccaggcacttgggcatcagacagacaggattcaaatctaatgccttccgcttccaacctgttaccacttcaggcaggtggcctcaactaccaagtctcagtctcctctggaaaataggaataatttatacccatacttctccaccccatctggaatgtggttagggaattaactgtagtaaccagatgtatagtacctagtctagagctggcagggggagggtgcatactgtatgatggttctcttccctttgcaagtttgggcttttcatagcttgagctcaagaagcctggacaagaaaaggagggtccgggaggagtgaagaaaaaaggagaaagaatgcctggccctcttgcctctgtggcagaaggatgcattcagtccaccaggtacctctgatgtatcagactctatgagccaggcggcccctgccctcacggaggtgacattctagtggggacatgacccagagcaggtaattacacatggcatgtgtgtagaaaggagggacttgggctctggaacctatcactgaagttgctctcctgcagtctgtaatctgggaaaggttcctggaggtggcgacatcttagctgagtcatgaagggtgccaaggaattgtagaggcgaagaagggatgaggaaggggaactgtgtgtctgaggccctgttgatggtgagaacaggcttggcgtggtagagggagggcagtgtgggcaggcccaggacagcctggcccgatttcctagtctagcaggatactaaagacttgggaatttatcctcaggccaatggcaacccctaaagggttttaagcagaaaaggcaagatcagatttccccagaatgttagggtctatggccctcaggcagagccttcttgggagtgactttttgccctctcctacccttttccctgtgcagcagcctcggtcccagggaaccggttgtttatgtggctggccccaggagggaggacagccagtcccagtccctccagctccttctctctggtctaagctgtatcgtggccttgttgacaaagctcagcccttggggccaggttctcccaacctccctggggagccagagggcaagaggcagggttttgcaccaggctgctctgtgcccacatcccagctctgcagttcctgagctgggtaatctctgggaaggcatacccgtctctgaacttctgtgtcctcaactataaaatggagttgatgatatctctaggaaaacgataaagtgaaattccacatggaaaccataaaccctatctggatgtcagttggcatttttactctgttgtgtgggggctgacatcaactctgggccgggcccagggctggctgggggtgggagcagggctggtttcaagagtcagtggtcacgcagggccctgcgcctagaaggaccccacacttaatgttctgctgacaccgtcttaaaatttttagtaactttgaacaaggggtcctgcattttcatttagcactgggctctgcatattatatagccccacaaatcgggtaggggtaggaagaggcagggagagacatggatctgcaaatggttcccaaggatgaggtggagggcattactaactgtcccaaggtgggtgggatgttaataagaataacacttatttagtgcttactgtgtgctagttctctgcccatcgctttacatgctcatctttaaacagtcctatgaggtaggtactattatcatctctgtggtatagatgaggaaactgaggtgacctagccaaagtcgcacagctatcaagtggcagagctgggattcaaaaccaggttgtccaactgcagagcaatgcttacaccagggaagtctccacctaggaggagcgaccacctgccctgggtttggaggataacttggagtttgcccaagaggaagaagtgcagtggagaagggaggactctctcacctgggaagtgtccaggctaagggcatgatgcttggccaggagatggggagccaaatcctggtgccttctggggttgagagaaggtaacctttgcatttcatggtcctgatttgccaagctcagagccccttgtcactctgcccctaggtcctgctgctaccatggctcctcaagttgccccaacccctcttcccacctttttgccccctccctccctacctcccgggtaatctcgtttacttctcttgattttaatgatctcttctgggttgaagatctgcaggtctggctgggtgcggtggctcacacctcctcaaagtgctggtaatcccagcattttgagaggctggggcaggcggatcacttgagcccaggagttcaagaccagcctgggcaacatggcgaaaccccatctctacaaaaaaaatacaaaaattagctgggcatggtggcgcttgcctgtattcccagctgcttggggggctgaggtgggaggatcgcttgagcctgagaagttgaagctatagtgagccatgttcatgccactgcactccagcttgggtgacaaagcgagaccctgtctcaaaaaaaaaaaaaaaaagaagccccaacaatctgcaggtgtgactgcttcctggcccacacttagatgtctcacaatcagcttcagttcaggtccagacccagctcctgactctcccacctgcacctgctctgcctttaaggtccccggttcatctctggcatcgccgtcctcccacctggtcaagctagaaagctgaaagttctcctggatacgcccctcttcccgtcccacacccctataaccagtcctcagcaagccctgttagtcctcctgaatctctgccttgagtccgtggaccctctcgctgcccaccaccccctccaggccaccattggctctcacctgggccactgtgacagcttcctacctggtctcctgacatttgttcttgccccgctttctttcatggtcttcttaggataaacgttggattgtgtcatttccctgcttaggacccttccaagccttcttggaatgaaagccagatgcactgacgcagtctccgaggccctgtgggatctggtccttgcctacctttttgtgtcttcttctgccactctccctcagctgcaggacttccacacgtgttgtccccaatcctggaatgcacgccccctcttggggccctgctaactcctacttatccttcagatagataccagctcgaacgtcatttccgcagggaagcctaaaaaccagacagtaaacagcaccctgctccagaggaccttgtacttcttcataacattcagcacactcaaatcgcttttccctcatgtctatttcatgctaggctgtgaactctgtgggctcaggaatccgttttgcctcaccccggcacatagtaggtacacagtgagctgttagatgaatgaagggactagatgaggagtgctgcagcctcctaactggtccttgcctccaggcctgccttttccagccctttctccaagcagccccagaacaatctttctaaaacacagaactgaccccgtcaccccctgctacttaaaatacttcaatagctccctgtcactgacaggaaaaggcctcggcttcttatcatggtattcaaagccctttatgatgtgcgcctgactgcctgtcttccctgcttccccgccacactttgaactccagtccctctaagacaccaggctgttttgggtctctgtgcatctgcacttgctgttccctttgcttgtaatgcctccccacccctactttgtctccatggagaatgtccttaattcttcaaaatcggctcagctgctaccttcgctgtgaagcctgtggagcccttccgctcctccccaggcagagttagcccaccctccctctgccacatctgtgcaaagtctacatctcttactcgctgtctcccactgcactgggcttctccgacgtaggcacagtgattattttttcaggattgttcatctgcgtacctccggctcccagcttctctcttgtcttaattaggtctttgcttatatacagaaacccactcaaaccagcttcagtaataaagaagggcttattacaaggacagaagggattccctggaactaaggggaaggaaaaccattagcttcaggaaggcgggacctggagggccaagggaacttgaagcagccattctctgcaccctgcctttctgtatccacagactggatatctctgccttttcaggcaccaagccacctatagttcctgtattgtgtcccttggtttcagccacatggagagagagaacttggggcttggcagatccaatcccaaactcccaggagaggatctgattggctcagagtgaggcaggtgcccaccctggtccagtcatctgtagcctactgggaaggatcaaagagacatgcaaacagggttctcagtgccccgctcagagaagggggatcttcgttagcttccaaacacatctcctggaattcttagagtgccgatgtgggtgcaggcagttgggcctgagccccaaacttccatctggacagcagctggagaaaaaaggcctggaattgtgacttaaaggagagtcttttcctgggcagcagtgctcaggacaggctctgaagaacctgtcaaatgtcattcagaggcctgaggagagagagggagaagaaagcctgaattttctcaccttgctttggagtgaggagagagggaagaggaagccaggaacaggcagaagagtttttccccacgaaaatcttcatcctccaagatgtaactcttttcatcagtgaaaaaccaaaccatgtctacctcaccttccccctgtcactcattcttgacctgtattgattctgttctttgtgcttccctggtaataaacattttttttaagcacttactctgtgccagacattgtgttcacacatttcatttaatcttcacttctataagatgggtactattattattcccattttattttatttttttaaaacatataaattttattttattttagagacaaggtctcactttgttgcccaggctggagtgcagtgacttgaacacagctcactgcagtctcaacttcctaggctcaaatgatcctcccaagaagttgggactacaggtgcacaccaccatgcctggctaattttttttttttttttttttttttgagacattgtcacattctgtcacccaggctggagtgcaatggctgggtcacggctcactgcagctttgaactcctgggctcaggtaatcctcccacctcagcctccctggtagctaggaccacaggctcatgccaccatgcccagctcagttttgtatttttttgtagagacagggtttcaccctgttgcccagattggtctccaactcctgggctcaagcaatcctcccatcttggcctctgaaagtgctgggattacaggtgtgattcacgacacccagtctgtcatctcattttacagacaaggaaactgcagtttaggcatttacaggctagattttaaagctcttcacctctcttaatctcggtgatttgctgatttgtctgcttgctgtttgggattgtgaaggtctcacgggcagatagcaggttaccatcctgcctctttccccactgcccagcaagggctgccaactgtggaacagatggatgcaggtagagtagaaaaggtgtctgggtggacgtcaagtctctgacgtgtggatctcccctgtgtagctagctctgtgactatggacacgtctcatcctttctgagcctcacatttctcattcagaaacggggaagataattcctgctctgaggctcatattagatggtggccgttatgacaatttgtgaataggaaaggaccaaggaatttctaaaagattgttattaccagaataggctgtagcaacagggcactagcggggcactgtgcccgaactcctgcaagaggtggacaagcctagagcttcccaatatgtggagtgggaccagggatgactttcagtgccatttcttaacattagctcacgtagtgagaaagttggttccctctcaacgatatcaagtccaagattgtccaagggagaacatgtcagtgtagtttctagtgtgtctttttttttttttttttttgagacggagtttcgctcttgttgcccaggctggagtgcaatggcgcaatctcagctcaccacaacctctgcctcctgggttcaagagattctcctgccacagcttcccgagtagctgggattacaggcatgcaccaccacgcccggctaattttgtatatttagtggagacggagtttctccatgttggtcaggctgttcatgaactcccgacctcagttgatccacctgccttggcctcccaaagtgctaggattacaggcgtgagccaccgcgcccggcctctaatgtgtctttaacaactttccaacactggttgccctccctttttaacagagagctctcaggctaggctcagaacattgcctggcaactccatatagctaaaacataatatcataactgtttttactgtgtttgttttattgtcattttctatttattaaaagtgatactggctttccatttatagtaataacatggtttctattgaaaatagttgcattaaagttaaaagtgtcaatttatttttatctgtttgtttatttatcgagactagatctcactctgtcgctcaggctggagtgtagaggcctgttcttggctcacctcagccttgacctcctggactcaagtgatcctcccacctcagcctcccaaatagctgggactatgggtgtgagccactgcccctagccagagtgtcaatttaaagaaaataagtaataaacagtacaagagtctgtagatttgttttgtttgtttgtttgttttttgagacggagtctctgtcgcccaggctggagtgcagtggcacgatcttagttcactgcagcttctgcctcctgggttcaagcgattctcctatctcagcctcccaagtagctgggattacaggtgcgtgccaccatgcccggctaatttttgtatttttagtttgaccatccagacggggtttgaccatatcggccaggctggccttgaactcctgacctcaagtgatctgcctgcctgagactcccaaagtattgggattacaggcgtgagccaccgtgcccagcctaggagtctgtagatttggcagaaatcattgaggtgacacacagtgttatgcacttaatgcaaaattgggaagtggtatggggatgtcggaaatgtgcactgttgacctagataattttgaaggtcccttccacctgcccaacaaatctaggggtctccccctgctgcgctggcctgctctcttctgctcaccttgaaccctggcttgggcttcttttggaggatcctgccatgatttccctgcagacaggagaatttgtgccattgttttcacaacctgcttgggaggggggctcatggagataaggtgtctggatgtggtaggatgccccctcatctctgaggccaggacttgagacctcctggggggagtaggggctgcataccctacagttcttctgcttcctatgtataacacaggcctcagggaggcctagggagcagtgaagctttgggagccacaggtaagggcaaggctgcccctggggcttcatgtcccagagcttggggctcagggacagtgaagcagaaggcttcggagtctcataggtccctcttcccctactccccgctttgtccaccgctttgtgctgactgcttgtccctgggacctcgcagcagaccccagggggcctcggaggacacagtggatttatcctcagggcccatgagcagggccaaagtagagaaggcagatggcaaggagggagggaagtcctgtctgccccctccctagtcccatgttcacagtgggaagggtggcctgggcaccaggaggatggagggcctgggtagagtgtggggtgtgtgcttgtgtgtccatggtgaatgtttgaggatctctgtgaaggcataatgtgtgtgtgtatgtatgagagagtttaagtgtgtgtgtatgtccctggcaaatgtagctaggtaactcacagatatgtctgagggtctctgagggcatattgtgtgtgcactgtgtgtgtgtgtgtctgtggtgaatgtatcttcatgcgatatgtctgcagttctctgcgagggagtttttctgcagcgtgcgagtttgtgtgtgtgtggcagggtgtgttgtgggtctgtgtgatgtgtgtgagtctgtggtagctgcatctccatgccatgtgagtctgtggtgcacaaggtgtgtttttgtgtgcatgtgtgtgctctgtgagtgcctgtctaggtggattgcctgctgggtgtggtgtgtgcctgttgttttgtgtacgtcatcttctttgtacagcgtgcatctcgctctgtggcgcgtcggagtggccaaccggaggtgtatggcttgcgtgcgggtctttgtgccctgaaagggtccgggggtggagaggttgcagggaatgcgtgcacctctttgggcggtgtctgtctggcctggggccgagcctgtgctgggtttctgaggagggtccccagggtgggcagcaggcgcgggcggcgccttccggcttggtgcggggctggtaactggagccccttccccccatgaaatattgatccggcctcgtcagcggcgcgggggaggggcggggagggggaggggcgggaaggggaggggaggagatgggagggcaggcgggggagggactgggagcgagtcgccagccgctgtccgtggtactgccgtgtctcccccagcgagggtgtgggagggggagagattgtcccatccaccaacaccctttgttggggcccctgcctctcaggatgagcctgcctttcccttctgctatcccgcatctaggaagggggagcagaggaaccaaatgtgtatcttattgggatccagtatccaccagctagggtgactatacgactgggtttgcctggcacagtcctcattttcatctgcggtccagtgtgattgtgagtattgtccctgctcattctcacaagggtcccaggtggatgataaattatgtgctcaccggtaataaggctttgatccaaagaccttttcccagtcgcctctgctctgccctgggagttccccagccatgtggacatgtaagtgtgtgtgtagttgcatgtgtggaaattgtccttcctgtactaggattgagctggaataagtgcttcagagccccgggctcccgccacagcccaaaccctccccaatgcatccagcccccttttctttcagtccaaattctgctttccattccagctgtgctcctttcaggcctgggcttctcctgtgccttagaaagggagtcagggtgccgccctagcctccctcctgcatcctgagctgggcaggcctcttctcggtctcaatatcagggtgttgtaggccttccagcttggccatctgtatattcatggcatcttctgtgagttcctctcctactcttcaccatggactctccctccttcagttggctccatcttcctcctacctctaactgtgggtactacctctcaatctttcctcactctctgctctcttctgggcattctccttcctttccacaccccattttttctttggagaacacacccaaatcctgcctactcaccttgctctcctgagcgctcgtgaatcagcttacctggccaacacctgaatgtgggagttgcagcattatctcagacccatcgggactaaactgggaattcatcttctccttaagccaggctttttccgctaggacctcaagctctgctgatggcacctctcacccccatccttcctgtaaatcaccttggatttcattttttcccttttccctactttgtcccctcactcactctaggcaatcccctaaccacacccacgactcctggccccgtttcctcttcgcacctcactttctaaagcagtgcagcccttcttcctgcatggatgtagcagcctcctggctgctcttcctgctgtcaggcttctttctgattctgcactcagtctcagattgatctctgtaaagcattacatctaaatcatgtcagatttcactcctacaggatgaaagccaagcttcttagccccacattcagagccctgcactggctgctcccagcctatctttccagccctctgttccgcagttgtacctacctcctctccaactgcgctgctgtgttcgccagcctctgaacacaacgttttctccctgggccttcccagtagttgccgcctccttcctttagagccacctctgcctctcctctccaaaacctcacctatcttttgaggtgcaactactggggtaatgccttttctggtctcccccaccctgaagtgttcactgtttctgcagaacaaccagagcaatgtctcttcacctctcagtgccttgggtggtccatggaccagcatcttgggcatcacttggaagtttcttagaaatgcagagtctcaggctccacctgtgacccatggatcagagcaagctccccaggtgattcacctgcacattgcagtttgataagcactggatggtgtggtcattgaggacggaatcttgcttccgtttggggagtcacctttggccaggagtagtggtattctccagtgccaagtttagcagcccctgtaaggagacaggtgccacatctagccacatcctacaagccaagggagaggcgaatggtggagatggctgagaagaatgtgtaccctggctggccctttcccacccataatctataccctgcaaggccccagagctcaagctctgtaaatctgactccagaaagcactttagtgacacgaggaggaatcaattaatcaataaaaaagcagttatcaagcagatagaagaacttttccctcttcacaaaacacacattggtggaaatgcctgttactttaatgtatgttttgaaaagaaaaatatgtggttttggtttttttctttattataacattaatacagtttcttaagtagtaactttagaaaacacagtatgtcacatggagaaaataaaaatgactcacagtgctataaatactgctaatttaatgttttaagttgccattcattcattctacaaatatttactgagtcctgctatatgccagacctgtgccaggtactaggggttcagggtgaagacgacgacaaggttcctatttttaaccagctcacagccagggggcggggtgtgggagacaagtacggaacaagttaggaacagcagtgtgttcattgcctagggaagctgcaataaagcgccacaaacagggtggcttaaaacaacagaaatgtagactctcacagttctgaaggctacaagtctaaaatcaggtgttggcaggattgcttccttctgtgtgctgtgagggaaaatctgttccgtgcccctcccctggcttctggtgacaggtggcaatccttggcgttccttggcgcattgacgcgtcactcccatttctgcctccgtcggcacatggcgctctccccgtgtctgtcttcacgtggccaccttcctataaggacactggttatattggatgagggacccacccttctccagcatgatctcatcttaacttgtcacatctgcaacgaccgtgtttccaaaccaagtcacattctgagggactggaggttagaacctcaacagtttttggggggacacaactcaacttataacacacagggacagtacaaagggagttatggggattaaccttatctgggaagactgtcctaggaaatgaccttcaaacttggattgagccaagaatagggtttagccaggcaaaggtggcaggacagacaagtttggggccaccagatcatgggggtgggggcagagaaggtatgccaggcagacaggagacaaagtggctaagtggctcttttttttttttttttttttttttttttgacagagtctggctctgtcatccaggctggagtgcagtgttgcaatctcggctcactacaacttctgcctcctaggctcaagccatcctcccacctcagcctcccgagtagctgggactacaggtgtgtgccatcacatcaggctaatttttgtattttttttttttagagatgaggttttaccgtgttgctcaggctggtctcaaaatcctgggctcacgcgattcacctgccttggcctccctaagtgctgggattacaagcatgagccccacgcccggcccaaggtggtacttttgaggactgaaaagaagcaagtgtggctggaatacagagtaggggcaagaggcatgggacgggctgggagataggagaggaagacagtccccagttcacatgggcttgtgggccttggcaagggccttctcctttgtcctgcaggaaatgggaagctaagggaggttgtcaagcaggagagattcattctgctttgtaggctggctcctcccaaaactgactcaggcggtattgttccttcaagtccctgcttctgaggaagaacacacagccctgtcctcaggagcccccagcccagtgaaggcccatggtgaccctgtcctgggaagggggcatggctgctgggtgaccccagcggcccctagtggagccttcaggaaccttgttctgaatgggagacacggctcacccagccctgggtctgccttacccttgtgtgttctgagtccttagagttgtggtttgagtccgaccaccccatcccctgcactgccatgaggactgtgactgagaatgtatctagggcccatgtggtgccctgaggccctgggggaacatcaggggctcagtcttgtaggtcttgcagggaccatgccttcagcaccccactcccctcaaggtatgtctggagtctgtattgccttcctacacagtatccagcctctctggggttctcaacccatcccttaccataccctcagagggctacccgtttcctgtgtctgatgggagagggcccaccctgcccaaagctgcctgtccctgccttgcccaggctgagtgggccaggctgggtggaggagaagtgggtcagcctggtagccatggtgacagcagctgctccctgccagccttctcctctcctcaccacaaacctcaccgatgagctcctttgtccggtctggcgaggatgggggccaggcgagtgagattgggggctgtggtgtgtatgattgtgcatgtgttcaagcttgcacacaccttgtgcacgtgttcaagctcgcacacacctgctcagaggtggggtgtgtgccttagccaagggagcccacggctcagggtaagatgcttcctgcttccctgcccacggagccatggggctcttcctgcctctctggactgggcaggggcccaatggggagggtgtgtgtgggtgtttgcaggtgtgtacacatgtgagtctgtgaacgactatggctgtcgtggctgcttctgtgtgtctctgtgtgtatgagtatcttagtggggggtggtgtgcacatatgattgcgtctttaagtgtgtatcattgacataagtctgtgtgatcacacatttggaattctgtgccccatgtctcttcctgcatgtgtgtgtgcacgtgtgtgtgtgtgtgtgtgtctgtgcatgcacgtgccagcctggcttcggggagacaaaggtctgcacaactaggagaggagccgccgctgtgtgctgcccacgctggctgggtgtgcttccttggcacagactgccttccccaccacaaccacctaccaactcatcacccgcccacctctccctgagtggggacaggagagactagagccgaaggagcccctttcccccttctgtgaatgcaggcactggcctctgacaggggcacagattggcacaggtgatgcgatgggccatcctggtgctggattaggtttgggccaggggtcttagatgccagacccagcatccagcaaggggtcaggagctgagatgctggcacagcttcatgcgccacctctcacctcaactgaaaagtgcagggaccctgatcccagacttctggagcactcagggctgtggtaggaggcgatgctcctagtctctgggccttcccctgcaatggttgcacctggtgtggactccagaccaataagaactaacaactggacaatcctttacgatttataaaggaatcttattagtaataataatgtaattgcccaactgatgatcatttaccacatcccaatccttgttttataatgttttatgtaagaatcctaaagcaggcattatcgtccccactttagagatgaggagcattaggctcaggggatttgttaaggaagccctgtatcatacagcttgtaagtggcagatctaggttttgcacttaagtctgtctgcctgcagagcatgtgtttcattcactctgcctttctgctcctctttgtctcatctgaccccagtccagccgggagagtcagggagggcccaggtggtgattagactcgttttgtagaggagggaatggagggaatggttcagagaagctgaaggacctgctcaggatcacatggctgggggtagagccaggagtgtgtcccccaactgcttggcatgtcacagagtgtctggggagggacacagaccccattaatcagagggaggttggaggaaggaaggatagggtctagagctccttagcagttggtcctggccaagtctctgtacatgtatttaaaaatctcaaagttgtgggtcttcagcagcttgacatccaagtacctaaaggaacattaagggggcccatgagttgtaaaaattttacaagaggaaatggagaattgaagagtttaaatgatttgctcaaggtcacacagcttcttcaaagtctatctttttatgccacaatctactggaagcccttgagggtagatgctttacctagcccttcctctaagctcctctcttcccttccagacccttttatcacatcgcctcctctgggagcctgccctgattgccttcacctcatttcttgaaaattggtgttttggcagaagtcaattgaagccttgtgcaaatgccctaggggtgtgctgttgggaggcagccccctgtgatgcggaacaccaggctcagattcatcagttcggtgagttgggttttcttccaggtgaagggtggggagggagcacccaataggtgatgtgagacctgagagttaggggacttagggttgaagcagtgattttgccaccaattttttatgtcaccctggtgcgtctttcccccattctgggccttgatttcttgttctgcaaaataaaaggctcaggctagaatagagacagcaagtcagttttagctcatgagctgtttctcatcagctggtgctggtgccctgtgttgagagggactctgaggctaagtctgaccttgatgggaaagagagaggttaatgatgtccactgtgagtagaggatggggaggggtggtgggagcctcagttatttgcagtcccttccagcctaacactccatcaccctgtgatgcattccttggtctttactgttggaaaggtgggtggctaggttcatcttgagcttttgtgcggccttgaactaccaaaaattctcatctgggccgggcgcggtagctcacacttgtaatcccagcactttgggaggccgaggtgggcagatcacgaggtcaggagttcgagaccagcctggccaatatggcaaaaccccatctctactaaaaatacaaaaattagctgggcgtggtagtgggcgcctgtagtcccagctacttgggaggctgaggcaggagaattgcttgaacccaggaggcggaggttgcagtgagtcgagatcgcaccactgcactctagcctgggtgacagagcaagactccatctcaaaaaaaaaaaaaaaagttatctggttagacccacggttaaagggactgaggggcccagggtagcctggtagggccctgagacctgctgttgtcaggattcaggagagagtttggagggcccttttagggtactgagaccccagggtagaggccaaacatccaagggctaaaaagaaaacacaaagcttattcctggggagctgggcaggtctcttttggcatggagttttggcaggagtgggggcagtagctgtctccctggaggatagatcaaagtttctgtgctgctgtggcaatagctgggagtcagcaggaagaacttcagagtgaggtctctgtgactcactgggatcataggacggtttccttccctgcggtgccatgacctgggctgagaaagggacagtctgctcagaagcagggaattggtgaagggacttgcgtgggaagggtatagtttatttagcaatcgtttggaatcaccaacatgtgacacggtgtgctctgtgtcctgcctgctcctaaccactctgccacagtctccaccaccttcccttttccatccctgtggtctgatggctcaggggttgctatgcagtggatggccctccttttaggttccctatctgtaactttggcatgtctttcctgagctagacctgctgccggagaagaaactagatctctaattctgagacctctgctacaatgtgcattcagagactcaactctcccagtcaaaaggacttttagagattacttaacctgaccccttcattttacacccagatgagacagccgaggcccagaggagttcacataaggaatctgttcacgttcgaatcccacatcctgattcctaatcctcctaagctgccctacccaggacttctgacccacaaggtcagtcctaggaccttgggtccagtgctttgggtctggctcctcctgccccttggggagtggcctgcaggctgggccctcccaagcatttttcagttctccagcccccctggttgatccctagatggttaaagatgagaaaatagctctggatggtgcagagaccttgatgccaaaccaactgcttgtcaattccatttattattcatgaggaaacatgagcccctgggttggcagggtcaggaattttgtcccttacccccttcccttttcaccccctgggggtggtactctcttgcttcccagaggctgtgctagggaagcactttgcttctccagctatggtccggttgggatttctactgccctaacttagatgctcatgacagctgtgggaacctgggccagaggggcttttctcatatagacactttccttttagttttctcaaagggcccagagacccagggcagagtctgagcttaagggccgggcctccatttttggttgaagggacaggggatgctaagcattctgtctctttgtggaaacaggagacctgggttcaagtccaggccttgcctcttcttagctggctagtatgaacaagtcctttacttctctgagactcagttttcttatctacaatacagagataaccacatgccttccagaaatactgtaaggagtaaattagacctacaccgtggcagagtcacaggatcagataagccttctcccaccttccaccaaaacaccgtgcagatacctcaaaaacacacacactggcactagaattggaaactcgaagagatcatcataggccccagtccagggggactttccattagctgcagggttgatgggggatagagaaatacaatccaggactctgcacacgtcacagggcgaatgagatcggtccaggcagccacagagaaggcaaaatgaggcgttaattcatccactctgtcagctatactttgccaggctggcaggagccatgctgaccaggtgaccattctcagctgtctggggactgtcttcctttatttgccacaatggtgcttttcctctttcacccattctccctcccctttctgtgtccttttgaataggcagactctctcagtgttccaggcccgggggcccagggtcaagtgaagtgccctgaaccctggcatggtcagctgccccaggaaaaccactgtgggctaggacagagccagtagggtgctgggtgcagagcatgctggagaggctggccttgttgggttcttcctgagcagaggatactgacttcagcttgggactttgcagccaaactgtggaggccaacagctggagatcccagctctgttaaaaacagagccatggactcctgcagccccctcccccagagtggttctcagggccctctgtcctcttccctagcacttagtgtaaccatcattaaatctttaactgtagaattagttacttactgtctgtctccgtcttggactggaggctttgggagggcaggaccaagttggcctgactcactgctgtatccttggcattcaacatgggcctgggaattttaggggcttaaatatttgttgaatgcagctaacagggagagtaaatgtctatattttaaaaaggaatttgacaatagattctaagaatccaaaagacatttatgaccctggcatcaggtaggatgcttttggaggtaacagagaactctgattcaaactggcttaagcaatggaaaatgtattgtctcacatcattggaaggccagcgcagggcgggccctaggtatggcctgaggtactttctgtctgagcgctgtctgttcacagtagcactggctttgtcctagggcttagccctctctagggtgtaggaaagagaaggacagagagagaaagagagagagccccccacctttcttgtaagcatgggatccaaatcttcccccccttggacaagtaagagttgctaaggtgaatgccattcacagattgccttaaattaatcaagatctgcctctaaaacaaggggtgggtggtacctggacaaaaccagccctctgtgaggaagcagaaagggggagcggatgctagggaagctcctagcagtatttgtaccccctgatccagtcgttccatttcgaggaatcagtcctaaagaaataagcagacaaaatccatgtagaaagatgcttaggctgggcgtggtggctcacacctgtaatcccagaactttgggaggccgaggtgggtggatcacttgagatcaggagtttgagaccagcctggtcaacagggtgaaaccccgtcactactaaaaatacaaaaaaattagctgagcatggtggcgcacgcctgtaatccaagctgcttgggaggctaaggtaccagattcgcttgaacctgagtggcagaggttccagtgagtcgagatcgtgccactgcactccagcctgagtgacagagcaagactccatctcaaaaaaaaaaaaaaaagagagaaagatgtttattgccatgcttatttaaaagagaggaaagaagccaggcccggtggctcatgtctataatcccagcactttgaaaggctgtggcaggcagattacctggggtcaggagttcgagaccagccttgccaacatggtgaaaccccatctctactaaaaatacaaaacattagccaggcttggtggcgggcgcctgtaatcccagctactcgggaggctgaggcaggagaattgcttggatccgggaggcaaaggttgcagtgagccgagattgtgccactgcctgggtgacagagtgaggctccatctcaaaaaaataaataaataaataaatacaaataaaagagaggaaagagagaaagaggagataaacttgggcctgatctaagcggtaactctactgaaatacttaaatcaattatgctacttctatacaatggaatatcacggtagcatacatagtgttaatgacattgggaaatgcttatgatataatatttttttttttttttgagacagagtctcggtctgtcacccaggctggagtgcaatggtgcgatctcggctcactgctacctccgcctccccagtttaaccgattctcctgcctcagcctcctgagtagttgggattacaggtgcccaccaccacgcccagctaatttttgtatttttagtagagatggggtttcaccatgttggtcaggctggtctcgaactcctgacctcaggtgatccgcccgcctcggcctcccaaagtgctaggattacaggcatgagccactgtgcccgaccatgatataatgttaaatgaaaaaatagtaggatataaaatgatatttgcagtatgagttcagttattttaaaaactgcatggaagggtggctggaagggaataggctaaaatgcctctcaagagtacgataaagggtgattttcttgctgctttggacttttctgcagtatccccttcacatagaaggaccccaccagagtctgcacaggctggagccagttctgttctccctgttattatttgctatgaaaataataaccaccaatacttactgaatatttcccctaagcctgacaggcacttcctgtgcattatttaatgtaatccttagaacaatcctatgagctaagtgcttttatttcacatcttgctgagatgttcactgaaacctcaggatgtttgtttggtcacaagtccacgcagctagtgtgtagaggcctttggaattcaagcccgggccatgtgactccacagcctcggtcctctccatcaaaccggtcacctgcaaggtttttcatagccatgtgctaataggaatagtctcttttattgagccagaacctgtgcatgctcttgacatttgtttgtgcatttaaccttatagcctcagagaggtcaagtgactagcccaaggtcacgcagctaggaagtggtgggactgcagtagattcatccaggtctgatgtgggatccttttgtttcctgcccatcttcagagctgcctgaggccctgccaccccggggaccatgtttaacggggagccaggtcctgcctcatctggggcctccaggaatgtggtgcggagctccagcattagcggtgaaatctgcggatcccagcaagccgggggcggggctgggaccaccaccgccaagaagcggcggagcagcctgggtgccaagatggtggccatcgtgggcctgactcagtggagcaagagcacactccagcttccgcagcctggtgagggggcatgggacatcacggggtagaggtgggggacacttcgcaaagacagactacccagggactgccctgatgggtctgcacttccatgcccacagacacttatactgtggcccttcccatacaccaggtgctgttctaggtccagtaggtgtatggactgattaaatctccatggagctctatgaggcaggtaccaaagaacagaaaagggaggtcagatgcttcaaactgcacaactagtaggtggtggagcctggattcaaactctagcagttgggcttcctagctgatgctcttaacctttacactccactgtctccacacacagacattaaccagtaattacttattaaacagccttatgatcctggcactgtgtaagtgacaccacagttttacagacatacacatccataagatttagtctcaagtgctgggtgcagggttcacacctataatcccagcactttgggagggagaagcgggagggtcacttgagcccaggagtttgagaccagcctaggcaacatagtgagaccccctggtttaaaaaacaaaaaagattcagtctcgcctgtaatctcctagtctcctaaatacaaatagccacacaaatgcagttctgtagtcccatgtatatgttacaaagcacaagggagacacacacaaagatgtgtgacttgtgcagttacataaatagaacgctcagtgtctctggtaagctgcccgtatttccagggaagcataatagagtaattcacactgcgcatggtcacagataaaaccagtcatgcaaaccacacagacacagccctctgattacacatgcacagacccagatcacagaaacatgtcacatgtgtgcaggtgtacatcacaaagccacattcacacacaccttaacagctccatcctcatcaatacagtatcctttttcagacacctagctgcagaatctcagttatgttcagcctggtgggtgaccaccttgtgacatacatagaccccacatcacagaggagccagccctccccaccaagacctcctcactttgtggtatcagcccagacaccagctggttttgttttaaaatctcttccggcttattttgttcagagtaacaacttccccagaaaccttcaaataggcagctggatgggatggtgagggggcgggggctccggaggatccagggagaatgctcatcaaggctcccagttggggctgggggtgggggacttttccaggccttaaaatagatttatacaaagccgtcgacagtagcacgtgggctggtcttttccagcaatcaagctgtgatgtggtttctcgctggggaaagctattataggtggggaaggggcttgaggttatcagagccctagagtgggcatggcctctgtgaatatgcagtttaggcctggtactagagagtcagggagatggggacttagggatctagaaattgggctgggacaaggaaggggctgagataggactaaggagtgagattaagattagaaggtcgtggaggtgttggaccccgggagtctggctccaggggaccaagcccagaaatccagctgattcagcttcagacccaaaggcttcttcatgcccaaagtgatttggggggacagtcttccaaggccaggatggggacctgagtcactgggagaaccttctagtggtctgccttgactttacaggctgcaggcagggattggagcagataccaggaagacctttcatcttgagaagagatgaatgatgatggggcttctgaatcccttgtctccttggtatgcaagggcatggctaaaggactggagctaggggaactgcccagatgcccttctaactgaaggtctctgtgaatcagctaattgctgaatgtgagtgaggagagtcccttgagatcatctagtacgctgtacttattttattgatgaggcatccagagcctggggagaaagcatgttcctggagaacgacctcaagttcagatccatcccctgtcatttactagccgggtgactaaggcaagttacttcacctctctgagcctgctgccttgtttgtagaatgagggcaatgatacatgccttgcagagttatccagggaattaagtgagatagggtatgcaaaggcacccagcttcatgcctggcacatagtataggcactcagtgaagtgttgatgctgttattattacctgccattgtaccataaagccaaaagagaagtgagttctcagcctccacacctctgctccttccctgtagcacgttcctctccatctagaattccttctccattttttgcccccatgccttgaggatgccagtatcccagctcggacccacctcatgggtgggagcatctggtgccagaggaatatatgaggcagactcatgggcattggctctggaaactgttctgggaaagacctagaagggtgcccccactcctgacagatgagatggctccattccctgcagggctgggctgtgtgaagtggggaggaattcctctcctggactctgtcttctgggctcaggtctgcccttcccagggcctccttcctcctggtgtgtccgtactgtgcaatggctagacctctgcccatccttctttgtttcaaagcccctgccctagtacaggacccataatatctagcctggacgattgcaccaccctcctctctagctctcctgcctcctgcctgccttcttccagtttattcctcttgttgccctagagtggacttacaaaaactcactttagagggctagtcctggctctgtaactcaccatgggacctcgggaaatttacttttccgctgggcctcagtttcctcttctgtaaaatggagctaaaatgctctctcccagtttccttctggatctgacattcactaagtcgtgggagcagtgaggagggtggggtcagagctttgggtccaggacacaggtgggttctggtctggcaattggctgggtctacacaggaccatcctgggctgtcccagcccctgcccaaacggagctagtattttcagtaccagggacagtggctttccccttctggactctgggatctgggtcagggtagagagagggctcaggaccattccagaagatgccatagggagtggtggtacaggctgtgagtgcccctcctttgtttgtgatgggacagatgggatggttcctggagtcttttggtctctggagcccatagaattattgcaagcaactgagagagagattatataaagttattccttaaatcagcaggggttgagactattcatgtatgaagccagtggagggatcgtatggacatgtatgaagccagtggagggatcgtctctgagattgcaagagctttctcctccctctgaggtcatggaacttaatctctgctgaatcacctctcagctagatgggggattgggaggggagtgaaaagagcatgacagcagactgggagtctgtgggcctgatctagtcccagctctctcggcacctgaacctcaggcttcccatctgtgaaatttgggggaggggtagccaaagtatctctaagatttcaggattctgtgactccccgactcagggtctcacattgggttggacaagtcttatcaaaaaggcaaatttgctcccaaatgggtcaaagtttccctaaactctgaaagaggagggttggggtcatgaggaggtgaccccaactcaggctgtgtgttgtggggtagagatatgaaggcgagggagcccccacagacccatctgttttctaattgtgttagagaggatgtagagttaggagccacggacagggagaggccccacacaccagcatttttacccaggcctctgtgtgtgaggtgagtcagacaccatttgtgggttttcatcaacatatgtgattgaatgggagggttcaactccaagtgttacatgtgaagatcatgtgtctgtgacttgactgaaggtggcagagtccatcatgtgtacatgtgaccaagacctggtaggaccatttgtgactgtgtgactgtgatataaacctgcatgtagccttgtgtatgagattactgtattcatatatgtgattgctgctgctcgtgcatgtctgcctatgcctctctttgtgaaaaaaatatgtatgagctaatgtgactctgtgtgtgtgtgtatgagagagacagactgacatgttgatggtgtcatggattcctgaatatgctattccagtatcccagaagctgggatgatttcagagaaggcattcctcctcaccctgcaccctgttctcagcctgtcccgccacccacccttccatccactagtgatcctagacctctctgcctgccctcctccagtggggactttctgaaagataagcagacgaagcaggaggaataaagtcttccttttcccaggctggggtcttgaacatcccctccccagcccaccattgggtgtggtgggagagaattgccaaggtaaccagctccctgctccccactgttttcaggggctgtgctgcctgtcctgccctggcctctccccctccctgtaggcaactccactgttaattcgcttggcctctaaccagtgacagcaaatggttcctttggtgcagttcccatctgagggccagttccctccccatcaagttcctccagctgccaagcttcagcgggggaagtccctgcaaaccctcaggccatctcccccatccgccccccgccaggaggagagggtgtctagagggaccacactgcaatgccgaggaggttgccatggaaacccaggcaggatggtgtgctgctgggagagggaaagtgtcccatgttccctgcaaggctgagggggaggccaggatatgggggtcgagggcctctgaacaggaggcacggagacacgggtaagttctcacaggccagcttcggggttcttctgcagaccttttctcaaagccaaagacaatttgggtcaacccagcagtccctctctgtcttgttttcctaatggcctctccagctctccacacacgtcctctccatgttcagccccacctagagaaggtgggtttgtttgagagtggccaggcttcccatgggggctttcctatagagcctccagaggtatcagaggtgagttgtgaggtctgggtgtgatagggtctgagggtgcctgaaagagggaaagtcagtctgagaatcccagagaagatgaactttccagaagagagtgggaagaggcacacttaacctttggggcaagggctgaaatcgagtgggaaggtgggcgtcaggggagcctgatgagggtgaggcgagggccccagctgcggatctgcggctctgcgtggtggcgccatcatgactctgcctgcagccatctttctagtctgctctgtcagtgtcactgcccggagcagggccaggtgtcaggctgcagaccagctctgaggtcagctcagccatgcccctgcctccagtcagagccctgctcatcctccccatcaaccccccatgccaagagagtgactttggcaggactcttagagaagccccattcataatctgaccttgttccctctctgtgcttggggttgggggggtcacagaaggggccaccaagaagctgcgcagcaacatccgccggagcacggagacaggcatcgcggtggagatgcggagccgggtcacacgccagggcagccgggagtccaccgatgggagcaccaacagcaacagctccgacggcacgtgcgtgcagccccgtgctgtggtcccctccctcctcctcggtcctccagtcacagagccactgggcagggtgggaaagcctccctgttttgtttccagctaaaatgtctgggtcctctgtgtctctgccttccttcatacccctcccctcaacactctgtgcctggacctcaggtcttccattgctcccattggaatatccagatacccaggagctatcagttccttctgtatgtttcaggaagggacccttacctcccacctcccacctcccaccacgcacacactgccctgctccagaggaaagggtggaaaggaaaatgtggccctaaaatccttttaaatctaaaaccattgttgtggcccagatgagtggaattttctcaaggaggcttgcttagagctgagggaaggagattggactagatcagtgtttttcaaaccatggatggtgactcatagacaggaaataaaataggtttagtgggtcaaaaccagcattagaaaaagaaatagacatatcttatgaagtaagaataaattgcctcgtgaacttttgtttccattttttatgtatagatgcacacaggtctgtcctgggtcatgatgttaaatctcctttcttacatgtaggttgcattaaaaaatctgaaagtcactggtttagatattcccacagatctcttctaagtctatgaaattatagttgtatgactaagattttctgcttctgcttcaaggcctagtgacttccaggcttaggattctgtggctccctcgtttgagattcagtgattgtgtgtctcactgctgcacctacttccatgaatgcgagtgctctcaagcatttattacatcttcccaggtgcagagcatgcctgggcatctcagataggtgattcttacactggaatctgctggctgtgatcagaccaggaacagtgatcgttgttttttttgttttttttttttttgtgatggagttttgctcttgttgcccacgctggagtgcagtggtgcaatctcagctcaccacaacctccacctcccaggttcaagcgattctcctgcctcagcctcctgactagttgtgattacaggcgtgcaccaccacgcctggctaattttggatttttagtagagatggggtttctccatgttggtcaggctggtctcgaactcccaacctcaggtgattcgcccacctcagcttcccaaagtgctgggattacagccactgcacccggcctaacagggatcatttaacacttacagcaaccctgagggttgtgggtattaccattatctccattttacaagtggagaaacagggagaggaagagggtgggccaccttacccaaggtcacagctattaagtggtgatggagtcagaattggaattaaggccatttgattccatgacctttgttcacaatctccacactatatccagctcctaaaattctgtgaccttgagagtctaagtttctttatttaaccttctcagatatcattgtcctaagaatgtgatattaggctgttgttgaccatggccaataaaagtggggccttgaagcccctccctgtggggtggaggctgggcctagtcagggagagacacaggctctctctgacaagcatacacagcctactttttcctccctgctggccgctagccaagggggactcaaggccaaactatctagtaggagattcttccttggacagccttttatctctgcagccaggagcctgggcctttctaggagatcttagaactttattctatcatagcccctgagggttggcagggccaaccctccctcatctgtcctttctcagctggccacacccagaatatctagactggagcacaaaagagaagtagcacttttcccttgatgataacaacagcagcaaccggaactatcatttagtgctttctgtttgtctggaacttttcatttgccctaatcctcaacatataaaaccctatgaattttgttttgcaggcaaggcaattttaccttttggagcctctgttttctcatctgtaagactggataatagctcctaccacacagagtggttgtaaggattaaaagatataacccatgtggaatttttaatgtaccattggcacctggccagttgtcaatcactgtcagcttttcttgttactgtttctagacccccacacagtcatggaacaaccaccaaccaccatcacttgccattcacctcaaccctgtaattgtgttattttggtcttagctgctgttctgggcaccacctcatgtttgacttggatttcaaacttgcagtcaactcaaacctcagttcttgtaacttgttccaggcattgaaatttctgacctatgtctctggttcttagcactgatatgccctggtgaggacacaggtgtccagcaagccctgccttgtaagggtcacttcagaagtccctggacattaaggattaaatagcatcattatgtattgttattagtttattttctcaagtgacatcaaagtatttttcttcagtatgcagaaataaacagttctgtttgtcctttcccagagtagtgcaatcatactgtttagaggagaaactgaggcacagagggacgtgcccagggccccagggccagagcatggcagcctgccagctatactttcatcctcaggttgccctgaccccctcacgcgtccctctgcctcctcctgcaggttcatcttccccactacccggctaggggctgaaagccagttcagcgatttcctggatgggctgggaccagctcagattgtggggcgacagacactggcaacaccacccatgggtgagtcttattaagggcaggttgagtggggtaatggtgaccatgcgacaggaagggtgagctcagtgggggccctgcattggccatcgtagagtttattctatcaccaattctgtgatcttaagcaagtcacttcccttctttgaacctcagtctcctcatatttaaaatgggaataataatacccacttgagttctatgctctaacaatactttactgagctcctattagatgctttgcatgaggtatttcaatttaatgtgtaggaactgtggcttatttgacttgttacacccaacagcgcctggcacctagaggccctttagtaattttcttatcgcttttccttgcagctaggaagtatagttggccctctgtatccatgggttctgtgtttgtggattcaaccaaccttggatagaaaatattcagggaaaaaaaattccacagagttgcaaaaagcaaaatttgatttgctgtgtgccgagtactaccctgaatccatgcaaaggaagtgatatgtaggcattgtgttaggtattataagtacagtcattttcagtgtgtgaacatcatagagtgtacttacacaaacctagatggcatatatatatatatatatatatatatatatatatatatatatataaatttatatgtattttttcatatggaaaaccgtatatcctagcaccattactgaatatcaatcatgtcccctatttgatctgcaatgccaatatcaagtaccatatatcaggtttctatatattctccattataatcttacgggcccactgtcatgtatatgatgcattgttgactgaaatgtcattatgcggcacaccagtataatctagagatgattgaaagtatatggaagaagctggttgcagtggcctgtgcctgtagtcccagctgctcaggaggctgaggctggaggattgcttgagcccaggagtttgaggccagcctaggcaatatagtgagaccctgtctcaaaaactgaataaaataaagcatatgggaggatgtgcatagattatatgcaaacactatgctatttttattattttattttattttatcttcgagatggagtctcactctgttgcccaggctggagtgcactggcgcaatcttggctcaccataacctacctttacctcccaggttcaagtgattctcctgcctcagcctcctgagtagctgagattacaggcatgtgccaccatgtctggctaattttttgtatttgtagtagagacggggtttcactgtattggccaggctagtctggaactcctgacctcatccacctcagcctcccaaagtaccgggattacaggcataagccactgtacctggctgccatttatttatttatttagagacagagcctcgctctgtcaccaggctggagtgcaatggcacaatctcagctcactgcaacctccacctcccaggtccaagcaattctcatgcctcagcctcccgagtagctgggactacaggcgcacaccgccacacatggctaattttttttctttgtattttagtagagacggggtttcaccatgttgcccaggctggtcttgaactcctgaactcaggcaatccgcctgccttggcctcctggctgccattttatattagagactggagcatccaaggattttggtatccctgggtgggggcgaggtagggttctggaaccaatcccccatggatactgagggatgacggtactacctgaagcctacgcttggtcctgttagcttcagtctggcccatttcatgagctctcagacagaacctccctgccccctccctctcttaggtgttggctgtgttggcttccagcagctcctccccaggatagctcctccagaggtgcctcctcgcctccactcctttcccatcagtctgacctgagcagcacctgacccacacgtccccactcagcccccatcaggacagtgctcaacctttgaccctcccagcaaatgaggaagccaagtgcagtgtcctgctgtgagtcatgcagtggagctggggttccactccaggccaggactccttccactgcaatgccctcaaaagctcctgcccaggagctcctgcctgctggaacaggagatgatggggaccctcagagggcaaggatcagctgaaagcaaaggctgggaattagccaaatccaattctagggctggacccttgttttcagtctcttaagggtctggggagcctgcttttcccagccctagacccagccacaggctgggcagcagtgagaggagccagccacttccacaaggctaatgcgccatggcagccgggaccattcgtgtgtggtaccccctggtgtcagaccagggaaggacaggtttgccttgctcacctcggtagtgatgttactggagattaattcctaagaccttcccttctcccttccccacaaggaggtcaggaatagctggatggaggtggatgaattccaggaggtctcttgaaattagcaaatccccatcttccgtagtacacaaatacaaacaatttcatgatggctcagataatctaaaaatgggtgactgaattcaaagtctggcccatttgattcttgtggaccaggcttatgattctgcacccctgtaaaagacttcactttgttctgagtgactgactactacataattccaaattctgccaaccaatgttgaacaaaactaagagttcctagaaatcaggtaactgacataactccacacacagaccttgccccggctggataatccattctgtgggagtacagtgaagatttctcagccgtccacacccagaaagtctgctggccttccctccctccactggtaatgcagtagtaggcccttgttgtctggtagtgcctcgtgtcctgggcaggtttttagctcagagccttttcaaacagatgttctttcttttcttctttctttcttttttttttttttttttgagacggagtcttcctcgtcacccaggccggagtgctgtggtgcaatcttggcccactacaacctccacttcctgggttcaagtgattctcctcagcctcccaagtagctgggactacaggtgcacaccaccatgcctggctaattttttgtatttttagtagagatggggtttcaccatgttagccagaatggtcttgatctcctgacctcatgatctgcccgcctctgcctcccaaagtgttgggattacaggtgtgagccactgcgcccggcctcaaacggatgttcttttgacacagatgtatggggaggtgaagaacagccactgagcccacagcctcccctgtcttcctgacacaggaagctctgtcctcaagtttgctattctgctcagtaaaacagaagcctctcagttagccagacacaaatgggggtttggcagccatctgttgttacccagtcatgcccctgaagatcatgcccctaccccaacccaccccaagggacctatcaaagggtccctcagctgctttaaagtggtcttccgagagcagttttggcccatgtggttggtgccatcttgttccctttctagtgatgatgtagcctcctccacaggctggcattcagtacagcagctggctggcctgccccttggtctggccctgcctggactcaccctcttcttcctttcaggagatgtgcacattgccatcatggaccggagtggccagctggaggtggaagtgattgaagctcggggcctgacccccaaaccaggctccaaatccctcccaggtgagggattttggaaatggggtcctgacagggaggggcatagagccgagctctgggtctagcaggtcctcagctcccactggcctaaatcgggattctttacagtggagtcacagcttgcctggaaggccagtgactaggtgggggagtaagggaggatggaggaatcagtacttgagtcacctcttctgcctgctgtccactggctggctcattccacacatcctgctcacctccaagatcacctggcagttaggggatgggcaggccaaagctgtctgtcctggacccctccctgtcatacattctctcctcccttagccacctatatcaaggtttacctgctggagaatggggcctgcttggccaagaagaagacaaagatgaccaagaagacctgtgatcccctgtaccagcaggctctgctctttgacgagggaccccagggcaaggtgctgcaggtgggtgtcacagggcaagtagggcagggtggactcacagactggaagttgtaatttaaagtttttcatttatgattcatcctgtgccaggtgctgtggtaggtgcattaatttgcgttactcatttactttcacaaccctgtgaggtattactgtccccagttgattcataaggaaaccaaggttttgggggtaatcaaattgctccccaggttgcacagctggtaggtagaaccaggacacatgtgaccactgcctcctccttcccctagtgctaatgttcattgcacatcagttcagtgccaagccttgtgttaggtgctttccaaacacgacctcatttcatcctgcagatgatcctgtggagtaggtgtgattctcttcactttacggaaaccgagtctcttacagatgaagtcacttgcttggggtgagcccaggccaggtgactgtcatcccaattacttgagagcaacaaaggccttctgcacacttggtattgttagcccttctcaacagtcctgggagggagggatcttcatgctcgtttcatagatgaagaacctgaggtcacgtggggataaagcacagtggtggatcagtctctgggctcagtcctaggttcagattccagctcagcactcattagccgcgggtagatgtgactattaaacagaggattgcatgtagggagccttacatagggcctgccacataaacagctactcactaagtattaacaatcatggtggtggctgctgatcttgcctgaggccatggaggtgagagagaagaggctagagccaggggctgtctgggccatccaacttctcatctagggctgctcctctgggctgagatggttctgtggcaaggggccttggagttgcaaatttaaactgcagagccagacatggtggctcacaaccataatcccagagactcgggagactgaggcaggaggatcacttgagtccaagagtttgagaccagcctggcaacatagcaagatcccatctctaaaacatgaaaaaaaaaaaattatctggtcatggtggcacgtgccagtaatcccagctactcgaggtgctgaggcaggaggattgtttgagcccaggaggtcaaggctgcagtgagctatgattatgccactgcactccagcctgggtgacagaataagatcctgtctcttaaaaattaaaaataaaaaaagaactgcggaaccctaggctttggggagtgggaagaataatctttggtgtttgcttagaaaaggaataacggccgggcacagtggcttacgcctgtaatcccagcactttgggaggccgaggcgggtagatcacgaggtcaggagatcaagaccatcctggctaacatggtgaaaccccgtctctactaaaaatacaaaaaattagccgggtgtggtggcgggcacctgtagtcccagctactcgggaggctgaggcaggagaatggcatgaacccaggaggtagagcttgcagtgagctgagattgcgccactgcactccagcctgggcaacagagtgagactccatctcaaaaaatctcccagtggtgtggctggaaacactgaggtccagtgagggcatggagcttacacaagtcccacggcaagccagcagcacagctagagctatggccaagtcctgaactctcagtttgccccttcctggggaaggctgttatctgaaatgctgggaggctctggagtcacacacccaggtcctaatccaagctctgccacaagttactgtgcaactttaggttagctaattaacctttctgagctacagtttccttcatggaaataatgatacagagcacccctacctacatggcttgttataacaattgaaagaaagaatctaggtaaaatccataggatcgtatctaacacacctcaagtgctcagtaaattattgtgtgaaatcagtcttgagttctggctccctctgctccatctgtgccctgctgaaacgtgtaggttcctaggcctgctgcacagtcctggagtcagggaggtggctcactccctccctctcttcctcctggcaggtgatcgtctggggagactatggccgcatggaccacaagtgcttcatgggcatggcccagatcatgctggacgagctggacctcagcgccgcggtcaccggctggtacaaactcttccccacctcctcagtggcagactccacactcggatccctcaccaggcgcctgtcccagtcttccctggagagtgccaccagcccctcatgctcttaaggatgtcaggaagaggccaggatggtggtgtggggaggggtgcctgctggccccatgtcctcccctgtacatagtcttcgtgtctttctggaccccttgtcctgctgcatgcctgttggctactgggctcatcccagctggcagtggagactgtagtgtgtgcgtgtgtgcgtgcgtgtgtgtgtgtgtgtacgtgaccacgttctatctgttcatttgtctgggtatagtcactcctggtgatgatatgggctgaaatgtctccacgtctctttgtgtcttgttgaaaagaaacccaaaggagtgttgtgtggacatgactcaccctgaggagtctccagggatggaggtggggcatgcggccactggtcggtgctgcctggtcctggcctggggcagagcctgtgtgttcttcacctgtgcctgctcctggtggtctctgctttgttttctgtcttgtcttttgttccactcttgactctcccggctctgccactgttttctgagaaatgtagcatccgctgcagctggccacactgagggccctctgggaaccccaccccactggagccgctccggcagctcttcctgccactgaatgcgttctgcagcatgtagcatgcccacctagctccctggccagggccctggggaggcagagggtacccaggggactgagggcttagaaatgactttctctatgaggctggaacctcctccttcttccagtgaagcacgaggtcttggttccagggttcctggccaggtgcccccttagcatttgttcttcatctcctgtctcttcaagcctccccactccaccgtgccgaaggagctctgccagtgggcctgggcaggcagccacagagggcatgttatctgctaaagcaaacagtcctcctgaggccctgagggtggccctgaccccctcagggctcattcctggtgggcatgactcggtaaggaggttctgtgggtagggctgtttgctggaataaggagggctgaggctgagttgttccccgccactgttgaggatcccatctgacatttggggattcactgcatgaagttgttcatttggggctccagtttttgtgcatttccagaccagggtccctgtctgggagctcagacttagctgggctccagcagcctggctccggactctcgtctgccaccatcaccagctctgtctaagcaatacttacccctccgggcttccctgctttcctgtgccccactgctgccctctgcagagccatctgctccaggcacccacctgcctctgcttgctttctcacccatgtctggttggagcttctcacagccactcaaaccctgacttgatttgacaactgggccctgttggtggagaccagtgcctgaactggaccctgtgaaatctgtcccgtgggaatcctgaagtctgactcaggaatgcccagacctgtccctgtccctcctcagctctagggtgaaaggcgagaggttgcacaggacatggacagagcagcccttgggtttgtatctggtaggggagaaagcagcaggacagtggaggtgtgtggaaggcactctttccacctctctccaggcattatccccaggtgctgaaatggctgtggccccagcacctgaggcaggggtacgctacctggggtagcagtagaaaggtcttggggtctgaatgacttggggcctccattcataaccaaagttgtaggggcatggaggcagtggcgccttatggataggtcatctcagcccaaagggcctccttggctggcatggttctgtgttacgttgaagccagagtcttataacacctcccaagaaagataggggaagaagccagaaccccacctggcctgcccacaggacaagaagtgggtaagggcaggaaggaaatgaacggagttagctcccaggctcctatctctgcctgagcctctattcttatattatcagagaaagggaccattgggtgcatagagatggggaggaggccactgggctgaattttctctttaggcggaaatgctctccccaggcccattgcgttcgtcaagttcttggaaatggacaaagggctctgtcctcctcgaccctagtgggggatcaagaaggaaactccgttgcaaaagggtattttaatctcctgtttatgatatattcacctctagagcagtcactgtcagggtgttgcgaaaatactctacacctttgggatgatagggttgttagtgacccacaggacagtatagatgtttgtggatgtagcactgagtggtgatacccagaccagcagtcaccccaggaagtgggggctacccataccctcattcctctggtggggagctgcctgcagagaggcctgccactgggggttccaggccgtggtgacccttgcctctggggaagggttagcacaggggaggttctagctggaggaggggtctgatgtgctggtaacttgggctgacctacctacagtccctggctgccaaaactgctcagcagttgggccactccactattccacctctctaaaagaaggtaatttcctccccaaattgaccttggggaattattcttttaaccctttgcaccaaataagttactcatccccacctggattttaccccatgagggtaaagttgtgtgaggctgacacgtctgtgtgatgcagtgtggctgcacttaagggtctgtttctcagcatcatggatgcaggggcttgtctgaaaagccactctggacctagcctgtcccagaagaggagaatgcacaagtgtaactcctggttgtttgctggggtgggggagcatctgctgtttgaggacggggggtggggaaggaaggaacatgatccctccagaagtctcccaccctggggccaactcactgccatgttcagtgtcccggctccaaatgcccccttgcccagatgaaaccctgcagtggttacaggaatggagctctttgtcattccacctcctctggtcaggcgaggttcactgtgcatatggcagagacaggagtggccctgcagtgatgttgggttgtgggcagggacagtgatggatgactcagagcgtctgtctttgtatttctgctctgttcattctgtcccactttcttcatagactccttttccctgcaatgggtttttggtatgaaaaaggctccagtaaatggagccaagtcttggtttgacaaggggaacttgatccttcagggaagaatcatctccaaaatgactccccatctggtttcttctaccacccaattctactaggaaaggagcacttaggaggctcttgggatgcagcaagtcccaggcaatgccagcatttcatgggggctgaggcagaacccaggagctccaagaaaggccacccatagagctcatcctctgtggaatcactgccggttagaacactgaggtcaagccagtcctcccatggtcatgccacccaccagggaagcatgcctgatctcttctttactgccagccttgaggagagcagaagcctccatttttaaagacaataaagacctccaagggtacttctttggaaatgaaatgtagcacaatcttagcctacgttaccaggagccctgacatgcaaccagggtccctcttccatgccctgctgcccaggagttgctgagctcctcttcccctggggttccagccctcctaatacctcatattccccatcttcctcagcccagaaagcaatggggctttagtgatgctcctcttttgtgtctctctggttgcctctagcactgtgcaaactctgcaagaaattgctgcctttgcttgatgttgtagatgagttgccctccacctggctggagagatggcacatcattcagggccagaaggttgtccagcagtgtttctgcagtggctgcagggagatggaaaagaagagccctgcttccctgcctcctcctacctttctcttccactcctcagagttttcttctccagtatcctgacatgtaaagagattctttaaaatgctgcttcttctactggactgtctttcactgagtagtcagggaggagatgaaaatgtggacacatccccccgccttctccctcaaccttttcactcacgtcagaagaggttggggcaaaacaaaacaagcatgattgaagagcaggggaagcccacacaatcaggtgagccctgatgggggctggactggcctggtctggctgggaaaggattcttttaaaagcgtgcctgagcatctcagagcaatgtcagtgatgccaaagagagcaacttggcctccttgggcaccaactctgatggctgagttgcacaaacgtggctcagatgttggcatgcccgatggtgggaccttgttctctgataaagggcttaatctttccatgtagcaaagcaactttccctccctcccctccccccgaaccctgagcttgggcttgtgtgggcccagcatggctgtgcctgtgagggaagccacatcagtgagagaaagttgcattctctcaggggcctagattggcttggggcaggtgcttgttgaaaagcatgagtgtttctgctttgggaaacccttccagggctctggttggaaacttggccagtaaggacagggccttgggcctcccaaggagttcacaatgatgccaggaagggtccctgagcctgggttccagtcagcttggctaacagaatggggcttgggaattccaggggcaactgagcatccaccccattagccagtgatctggacagggacagctggctacagggaatcaaaggctgttctgtacagttttaccagaaactgtgaccttgggtaaggctcctcacttttctgggcctcaacttcctcatctgcaaaatcagagcattagctgctctccccatgattccctcccagttttaattaaaagtctctgatctggagcacatgagggttgcgagcctggtgcacctggttcctgtctccgtgggctggtttccttcagcccctgatgcccaggctgggtgcaggctctcatctggtccatgcccagatgctgcctcagacaagaactctgggaatcctaacagactctgctttcctctcttcgtggtttgtcctccctcttttattcttgtgtaatgatgagacataattaagggtcatctacaatggacaattttcaaggtgctgatgtgatgtcacaacctccgctacatcctgagtaagtcagtgtccccaacagcagatgaggctgggtctttcctcatttctgcttctgggatgacatcagtgggagagttgaagatctgagaattctaaaggaaatgttctctgatgggaggagagagggaacttatttcccttcaaagtagtttgcttcttaagaccactcctccctccagaatgtctttaaccagacatcatttcagaaggtggggcagctgcttccttaggaagagtgggcctgatagctcaaccaactcctttagcatgtaaactcacagaaggcaagaacccctttttttagactttccaaatgcatcctgcaaagagagagatagctgatagggactgacaagcacactgtttagataagaagcaattagccttttatatctgtgctctatacattttctatgtgcagcatctttcctaacttgttgtggttcccgggtggcaggtgcacagctgggagggactgccggctgtttcgtacaacattcttgccaattcccttgaggagaaaattcttcacatggcttctgcatgtacagtatttgggcagcaaaacatgattaaagtcagtttgaaaatgg

SEQ ID NO: 36644 - DNA, 203669 bp, Homo sapiens
ggagggcagtcggcggctctcgcgccccggccactttccctgcgcgattcccggagctccctgcaggaggtgagagtccccagcgggtccggatggcgtagttttgccgcggcgcagcagctgccggagctcgccgccgccgagcgctgggcggggaaacttgccgccgctttcctccaacttgctgcgggtggatctccgctggacacaccgcctccgaggtacgtgccggcccagccccgcggcgctgcagcccgcccgggctgtgggctctgcaggctgcgcgggtgcccgtcggcgcggcgcgggctgccagtgcctacttaccggccagggtcgctccagccgccaggacctccggccttgggagggaggcgctggtggggcggtgtttaccctccggggagcaggcaccggtggccagcggtgcgtgggcagcggccgcacggggcaggcagtgcccccggcgatgcgcagtgctggggaggaattctccacgcccgccctcactcttcctctccgcgggtccttctgacccctgcggggcgcggcggccacttccctccgggcgcgtgacagcttcggtgggaatggtttgttgtgggttcgcagtcaattgccgtggcccaggctgtggctcccggactcgtgcacggacgcggtttgcgttccccgctggccgcgccctcagggtgccttgcgggctgagccgcaagctgcagctcggcccccccccgccccggtttattttgaaggctctcttcttgtattcatttggttaggacaaacttggaaatcttggactgtcgctagaagaatctgcttgcagacttgatcttattagggcatttgccccgctttgcagaatcgcatagtgtcaggagccgacgtgtcaagcatgaattaccttggcaaagtagaacttagtggatttggtgtcctcacgaaaagctggaagaagaaaaccgttccatttccctagctgtgaagtgaggatagtagtacttgccccgtaaagttgctgtgagcatctaatgatttaatgtgtgtgaggtgctacaacagtgcttggcaccgagtaagcaccgcacggaggttagcgctgcttgccgctagccctgcggtggcaggataggagcggcgagggcagaggatagtaggagtgacaggctgtgctggggaaccaggcgtattctgagttttatgtccttccgaagaagtgagcggtttgggagaagtctccacaggtagtaaaaacacacgtcaagaccgtttcttcttcctgaatgcagagtgcaaacagttacttcagtgtgaactcagttgtttcttttggataataataacagctaacgttttctaagcccatactgtgtgcacttaatcctcacagcatctctatgggaaaagcactattaataaccctattttacagataagacactagaggttaagttacttgtccaagatcatacataactttctgttagttctgactccaaagctaccttccttcctcagcggagagcggcaagtgcaggccgatttgtgtgtacatagatttgtgtgcatagtccatgcatcttctcccatctttcagctttctatttgagctgaacgcatatctcttgaaacacacataaggtatctgtgatgaatttaggcgattttacatacttatgagggtgcccaattaaagttcctctgaaactggccccaaataattataaatagaactctgacttgtattaattaacatggaaatttttttttttttttggtgacagagtctcgctctgtccccaggctgcagtgcagtggtgcgatctcggctcactgcaacctccacctcccgggttcaagagtttctcctgactcagcctccagagtagctgggactacaggcgcgcgctaccacgcccagctaacttttgtatttttagtagagacggcgtttcaccatgttggccaggatggtctcgatttcttgacctcgtgatccacctgcctcggcctcccaaagtgctgggattacaggtgtgagccaccacgcctggccaacatggatctttattcttaatttcttttattaattctccagacattgttgatcaccattacttggcttccttaggaaacagcttggggttggcacaggaggcagggaaataattcttacccccttaagggctattaacatgaaattgatttcatgccattgtgtcagttaaaggatgttgctctatttcttgctgttctttgcttttggctttatttctgcattgtttagtgtttcaaggcttgagcgttttttttttttggcccttcagtttgacatttgtcaactttaatttttcctgttttgatggaatctgaccgttacacggcagctttgcctaacaactgttgattcagctcatgtttttaaatataaaaatcaccaacatagttttgaatcccagcacttcaaaggcaacccgtggggagttcattgttattttgaatattagtcaatagggggagcataacacactgttgatatctataaggcgcataaacccgtttttagagtattaaacatatagtttgaaaggggagggcaaaatatctagcaaaataactaagttgcttttggagtttataatggaggactagatttaatttgaactgattaagaatgaccttgaggacagggcctgtatgttgaatatatgtcaagaactccatggtggctggacagatagataaacacacatatagttttttttcaatttgtttccttaagtggtgtgtaggccaggcacagtggctcacacctgtaattccaacactttgggaggctgaggtaggaggatcacttggccaaggagttcgagaccagcctgggtaacatagtgagacccccatctctttaaaaagtgaagtttgtatgtaaactaattttgtgtggtttgaataatatttcaacttacctgggagaaatggaaatccagaggaatttgttgtgaatccttttgtaatgatcctcatttgtgttttgtagaaaactgaatataatgaatttgttctcagggaggttggtgtgttcacaatcctgtcatcatctttcattaacatcttctaagtgcaagacaataggggatcagtaatcctaaataacagcagttctattactgtgaattcctcagaggcttacgttaatattcaagtatagtagtagttcagatgtatcatatttgatactagtataagtgtgatgtgtctatgaatactcatacttgtaaacataaacaataagaatatgcttgaaaaaatcacacttgacatttatctatttatttatttattttttgagatggagtctctcgctctgtcgcccgggcgggagtgcagtggtgcaatctcagctcactgcaagctccacctcccaggttcacgccattctcctgcctcagcctccccagcagctgtaactacaggcactcgccaccatgcccggctaatttttttgtatttttagtagagacggggtttcaccgtgttagccaggaaggtctcgatctcctgaccttgtgatccgcctacctcagcctcccaaagtgctgggattacaggcgtgagccacggtgcctggccaaacttgacttttaaaaaaagtttttggctgggtgtggtggctcacgcctgtaatcccagcatgttgggaggccgaggcaggtggatcacttgaggtcaggagttcgagaccagcctggccaacatggcgaaacctgatctctacagaaaatacaacaatttgctgagcgtggtggtgcacacctgtaatcacagctactccagaggctgaggtgggaggatcccttgagcccaggaggtggaggtttcagtgagctgagatcgtgccactgcacgccagcctggcagacagcgaggttctgtctcaaaaaaaaaaaaaaaaaaggttttcaatttttgtctgtagttttgtaggccagtttcctttcttgtttcttgcgtattatgtagtatttttttattatttatttatttatttatttttgagacaaagtttcgctctgtcgtccaggctggagtgcagtggagtgatcttggctcactgcaacctccgcctcccaggttcaagagattctcctgcctcagcctcccgagtagcggggaccacaggtgcatgccaccacgcccgactaattttttatatttttcgtagagacggggcttcactgtgttagccccgatggtcttgatctcctgacctcatgatccacccgcctcggcctcccaaagtgctgggattataggcgtgagcgactgtgcccggccccatattatgtagtattgatttacctttatttcatttactacgttagggtcccatggatcctattttaaaataactttcaaaattagttgagtcccttctttttaaatcttagcattgcgcttatactacagagtggcatttatttaggatctcatttagtcttctatgctttgctctagtttactcgagtaattcaacaaacacttataacctcctactccctactaggctatggtttctggtcttggagcttggcaaattaattgtccttattcagtgctctgatgactgggggccaaaatgccttcaggttgcttagggctttcttacagaaagcctttcgttggcttgaaggaaagtgttgttccattgtttttaagactcaaaagaattaatttttctctcttgcatgcaaacttggttgtgacttgtaaaagtcaggtgagtgcttgtttttctgagggcagaatctgagcctaagagcccagggaactcaactgtcctttgagttttaagaaggtgatcactgctgacttctttagtatataagtgaagaccaatttcctggcttcaaaaatctgtgaaaggtcctgactttacattttaagcttaacagacagaacagttagagtttagactgtgactgtgtaagtaataactttgctgtaatattttgcctggatgattctgctctgtggtcattttgaattacctcccttcttgatagttcattttgaaacatctttttgtggtgctttcattgctgttggataaaaattgtaattgtcagatttattttttatttttatttatatacttattcatataaaatatgtaaatatatgtaaaatctcacatatatataatctataactatatattgtataatatataatatgtatatattttgagacagagtcttactatgttgcctcggctggtctcgaactcctgggctcaagtgatcctcctgcctcatcttctcaaattgttgggattacaggcatgagccactgctcctggctgtcagatttattagctactaaaggacagtcttctttttcagtcttaacagttacttaaaagtgattttattgccatttccatcagtctactggagcatttttcttatatttttatttttatttttattttttttgggacggagtctcgctctgtcacccagggtggagtgcagtggcgcgatctcggctcactgcaagctccgcctccctggttcacgccattctcttgcctcagtctcccgagtagctgagactacaggcgcccgccaccacgcccagctaatttttgtatttttagtagagacagggtttcaccgtgttagctaggatggtctcaatctcctgacctcgtgatccgccgtcttggcctcccaacgtgctgggattacaggtgtgagccatcgcgcccggccatatttttaaacttatttaaaacaattgtaaatttaaaaaatgttaacttttttgaaatttgcataacttgagttagataaatgtttttaggggcctttaatgtaaaagcagtcttgtattgccactaggaatataagcaatttggaatttaagagtgaatctaggttatatgaaaagctaaccttaaacacataatagtgagccttcagcagattgagtgagggcatttctgtaggaagaaaattaagtgtaccaagagccatagcagtaacttctctggttctgcatcttcagagtaacacttggaatgatagcattgtttctttgcagcatgtcataaaacacaagctgttgctaatttgttcagtgtctagtcaagctgaaataaatcaacacagcttggaagggccttacaagaaggatctgggttcatttcctgggctctgtccaggaaatatagaaatataataaataaatctaggaatataaaatttctagatttcttattttatatcttttgaaatagcacatttgtttgttaactgacattgagctttattttctctgcttgcaaagtccttgcttaagaatcagcacaaatttccaagcattcttcctccccacttgaataatgattttgatgtcttgctctctcaaccaaaatgtgtttttgaaacaacattgatataaattctgcatgaggctactgtcatttggaacttattcttcattttttattcttcagtttttcaggccaaagatgaagacttaataggctgacaactgcttatgagggatagagaccatatttaaaatggaaggtctagaacaagagccccagaaccatgccttcaggccatcctaatgtgccctgctgaagataattttttggtgtcggggggcagggcagggagcctaatgtctggtttttgtggtggtggttcttttatgttgaaatcttcttccatcctgggaagaggattcagttatatgtagagcctagcaaagttgatttttagaattagattttaatggttatttttttttttgagacagagtcttgctctgttgcttaggctggagtgcagtggtgtgatcttggctcactgcaacctctgcctcctgggttcaagcgattattgtgcctcagcctcccaagtaactgggattacaggcgggggccaccacatctggctaatttttgtatttttagtagagacagggttttgccatgttgtccaggctggtctcgaacttctggcctcaagtgatctttccccctcagcctcccaaagtgcagggattacaggcgtgagccaccatgcccgcaagcccactttaatgttaaactgttgccaagataatttagaattaagtctgaaatgttagctctatctttacttaaaaaatggttataaagaagcgtatactttctggacattggactcctagtgaagggggcctttggagttgggtgttgtttgcaggaggacgaaacacctgcttttctgtccttccaggcacataattcatttctctggtatatgccgaaggtcaggttttttgtgtaaaattgctgatggatcatttgtaaaaacacatttaagttgattagtccttgaaaaatgatctttagaaaatgatctttacagatactagtccttgagctttcctgtggatcagattgccttgggcgaaggtctgcagtttcacaagcatgactcactaccttttataggtgagaacatcaaatgggccaggtggagggtctagtagaactctggatttctttttaaatttgtatcatactattttgctaatggaaacttgatgaatacttaattccatctggcaagtgaaaagggtcccttttgggagtattcgttttgttagcatttttagtgatttattgttttgacagtgtgatattggtccttggatgcaaaaatactctggagactatttggaaatttcattttataattaactaactgtgtgataattgctggagcagaatgtgtgttttttttttttttcttttcattctggaaggttatttgaggtgaaaaacttagattctaatcacaaaggcttgtgttcatgtggtaccctgagtacttttgtaagatactcactgtgttgctgtgagttatctcttttatggttttttctttaaaacaaaactcttctgagtctccataaagaataagtatctcattttgttatattagattttgtgcagttggctggcaaattaaatttaactttgagggaaagcaccattgactcattacatacattttgcatcattgcagcgtaaggtcttccctatgtgtgtgggagaagtttctgatctaaatgggcatgtttcctattgctggtctatcttttagccaaagcatttctgaatagacattcctattcattttcttattttcgagactttagagagattgctacttgttatgtattcgtgataaatcatctgaatcctgaaaaaaatacttatgccaacagcccattttgtaaagacacttgtctttgagcttttaagctgtcatactcattattcgttacaatagctgtacagccattggatgtatcatgtttttgacacaggagctaggggaaggatgacctacttgttgcatttcacatttttccatatttatatcttttttcaatttgtggcatctttatttcattgttagagtggttgttctctaagacgttccaggttttaatttcattcactgtgtgggctaaataaggagctttcctgtagaaccaattctactaaattcctgaaaatgtcagttaaaaattagccaggcatggtggtgtgtgcctgtagtcccagcttctcaggaggctgaggcaggaggatggcttgagccaggaggtcgaggctgcagtgagtcatgatcataccactgcactccagcctgggtgacagagtgagaccttgtccctacccccaccacacacacaaaaaaagaaaatatgaagaaaaaagaaaatgcttccaaaaagtatcccatctagataccatgctggttagggcttttggtcatgtttgaatgggacatagctgaacacagagcaggatttcaatgggtaggctaggaaaaggagaggagtgtctaatttgttgggagaaaatccacttttgcataataataggggatttacgtgttttctttggagttaatatgtatttcaagtaggtagataggtaagaggtttgcaaaaaaattttgctaaggttgaggttctgtagttggcaactcttataaccctgaagatcctgttctctaaagccaggaaaaagcagtctgtttccaattatgtatcacaaaaaatagtgaaattaagccaagaaaaatgatcatttgggagttgggttgcttttttttttgcagagggtaaaggagaaaggactgtagacacacattttaaagaatctgctagtttttctgttggctttcagatttttctcaaatgctctgtattggaaattaagaataattttaggattaaaggccttttcctccttcggcttctttttgtttctcagagagcaaatagaagagcatttaggcagtttttgctgacatgaaagggtttgggtccagtgttccgggacccagcttgtgtttttggtaaagccttttcctgcctgaatggtcccaggttatgggctcacagcatcatacctggtagtggtgctatggtttttgttatatgaatttttttaccatgctttgaactgaaatgtagtccctgctgcctagcattattctgctggaggagaaaactagggatgttagtgtgggaaaggtatggaggtgcgaagcctagcatttggatgatgtgtgggtgaatatattgtcctcagcacttgtcagaagcaactagcctttcgggatgcctactgctagtttcaggattagtggtcctgtgagacctaggtgttaactaagaaatctcctttccactgccagaagatcagccccggcaggtcttagttcctgtttctcacaccttacacctccacagagtgttgaataagactttcctgatgctgcataatctttgataactcttagtcttgtcactgaggctaatgtgttttagctcttggtgcttttcttctcacctcccatttactcttctgcctgctgctggctcccacgcccaccacacccccaccacacccccatgaggtgctagaagaggtgtgaagtacggagtgcaaagttgcatttgctgctttactatcctttttcccccattttttttcttggtttccctgaaacgagttctcctggttttcctcttatgttccggatgtctcttcagtcttccattttgtttctttttctttctttttttttttttttttttgagacggagtctcactctgttgcccaggctggagtgcattggcacgacgttggctcactgcagtctccgcctcctgggttcaagcaattctcctccctcagctgcacactcccaccccccccccccgcccgagtagctgggattacaggtgtgcgccaccatgcccagctaatttttctatttttagtagagacaaggttttgccatgttggccaggctggtcttgaactcctgacctcaggtgatctgcctgcctcagcctcccaaaatgctgggaatatagacgtgagccacagtgcccagcccagtcttccttttcaatgcttgatccctatgggttgacattttccaaggttgcattttcctttcctcctctcctctcccctcttcttttctttttcttgtcttttcagtctacattgagttgctcatatttctgtgcttcaatatcagcagctccctgttttttcacacccatatttccaacagcctatcggacagtgccatctggttgttctgtagatttttctgttacagtccaaaagccaccatattacttctctgtggtccacagcctccacagtgtcaccttctgtatttcccatgtccctccttctctatgggggttcctgcttactcttccaggctctcactgctgccagctcctccagtggggcttcatgtggctcctcctggcaggtgcttctcttgctgcctcgtgagaatgttgtttttccttcggcagattccccagagcaggattgagtcttaccatcttggtattctaggtgtgtagcatgggcctggtttatagatatattgtcaaatggaattcttcatttcagcccacttcagttatggctttggggaaagatcaggcttacagttgatataaattatagctatagaaaagacacagaaaatcaactcagaatcatagagtttagggttacagtggggcttagaataatcttccttaagtttctctaaagatgagaacaaccagagagcagtgtttctcttcttgcccctctgcagcctagttcccacccaatagccagaatgattgtgataaaacctaagtcagattccttcattcccttgcttaaaacactctaggctgggcgcagtggctcacgcctgtaatcccagcactttgggaggctgaggcaggcggatcacaaagtcaggagtttgagaccagcctggccagcatggtgaaaccccgtctctactaaaaaaaaaattagcctggcatggtggtgggcgcctgtaatcccagctactcgggaggctaaggcaggagaatcgcttgaacccaggagacggaggttgcagtgagctgagattgcaccactgcactccagtctggtgacagagtgaccaaaaaaccaaaaaaccactctactgtttattcttgtctttctcagaataaaagccagaattcttacagtgatctgcaaagccctgcccaaccagcccaccactcttatgctggtgacccagttgacttccctcttgtgctctctaggctgctcaatctgctccagctgccgcacctgactgttggtccctgagcacgccagatacgctctgtctcagggcctttgcatgtgctgtttcctttgcttggaatgtttttccccaaatagctacagaattcgcttctgttaggtccttactcaaaacagacaaaccaaaccaaaaccccacacacatactttgtctctcccttttctgctttgttttcttagcattggtctctatataatatataattatgtatcttgtttatagtctgtctcctttagctagaatgaaagctccatcagggcagggatttttatgttttgttctctgttgaatacccacacctggaacagtcctggcatgaagcaggcacttgataaacattattaaatgaataagaagcattttatggatttcttttttttttttttgtggcagggtctcactctgtcacccaggctagagtgcagtggcacaatcttggctcactgcaacctctgcctcccgggttcaagccattctcctgcctcatcctcccaagtagctgggattacaggcacatgccatcaggcccagccaattttttttgtatttttggtagagacggagtttcaccatgttggccagcctggtcttgaatttctgatctcaagtgatccacccgccttggcctcccaaagtgctgggattacaggcgttagccacagcgctcagcccattttatggatttcttatagccccagttataggtgcactcagggcattaaaaagggaaaattgggccaggcgtgttggctcaggcctataatcccaacacttttggaggccgaggacaggagtctcgaggactcctgtcacttgaggacaggagtttgagagcagcctggccaacatggtaaagccccatctttactaaaaaaaaatacaaaaattagctgggcgtggtggcaggcacctgtaatcccagctacttgggaggcagaggcaggagaattgcttaaacctgggagggagaggttgcagtgatctgagatagtgccactgcactacagcctgggaaacagtgagactccatctcaaaaaaaaaaaaaaaaaaaagaagggaaaattggccaggtgtgatggcttacccctataatcccagtgctttaggaggctgaggcaggaggattatatgaggcaaagaattcaagattagcctggataacatagtgagaccccatctccataaaaaaatcttaaaaagtcagctgggtgtggtggggcacacctgtagtccctgcttaaagggactgtagttgaggtgggagaatagcttgagccaaggagttcgaggctgcagtgagctatgatcatgccactgcacaccagcctgagtgacagagtgaaaccctatccccccctcccaccaccccgtcaaaaaaagggaaaaccatcaatctcggggaaggagaatctgatttttaaaaagcctcatttaagactcgttggactagaacactgacctcgttttcatgtctgactcaaagcagcacctgtgggtccccccatccttacaagtggtttgggaagactcccattttacctctaacaggcatgggcttgctgcggtttctctctgcctgtggtttgccctttaacccagcaggctacaaagatgaaaagcaaacacaacgttaaagaaaagagctagggaagagggcagggggaaacagggcagaatttccttgcagccctgacatcttgccttgtttctgtgcccatccccttgtctggttacacagtcccttccagagctgccttgcttgggggctgtgctcagtcttgagacttttaggccagatgactcttgagttttgctttgatgttgtaatttctttgaagagaaatcttaattttaggcaaaaaggacattggagaacggattctttaaaattaaattaccatctttcgaagtgaagttttaacccttctcaagataaggggttgtccctgaaatttctgcttgcttctgctgatgatgctagtgggaagtcaggattggcaggaccccatcttgtgaaaccaataccgtaaatcctcagggcaataaattcagctctgaagaagtgtcagactcttatgggtagggattatgtggaatgaagtacataatttgtattagtgtaatagtaaagttagaggaatttgcctcctgctcttattgagataacatcggcatggttcctacagggataggaagcccagccaagaaaggcaaaggcttaggaggaagctattggccatgtacaaagcctgcagtgtcattcaccctgggattcaaaggtatcacattgaaaataaattgtctagaatggagctgagttatcagtgagtagttaaaaataatcaaagctaccatttcctgaattctaacaacatactaggaagtaagtgctttatttattaatttagttagtcatcataacaatcccatgaaggaggtagaatcattatctctactttatagatcaggcatggagctttaagtaagttgcccaaaattatattgcttagaaaaggcaggtgggggatttgaactcaggtaggctatgggggccccgcactttccactatgctgtactgtagtctgcttctaggacaaaccaagcatgctcttacctcaggacctttgcactcactattcccactgcctgggaggtttttcctttagatattgtcatagctttatctcttacctctgtgcttaaatgttaccttgtctgggaggccctctctgaccaccctgtctaaaatagcatccctcctgtcatcactctctctccttaacctgctttattttcctttcctaggtcttctcatgccttgacatattatttatttgttgtcttgtctgtccccacctttagaaggtaacctatgtgaaaacaggagtgtgtttaatttgctgctatgtgcccacctccctgaacagtgcccaggacagggtaggcgctaataaatgtttgttgagtgaatgaatgaagtaaactaaaactgctgatcaaggcctgccaccctggtttcagaacaaaataatttgtcccttgtgccagatctcatcagactacccaccaccagaaagtgagtgtccatgcagggcctggttgatgtctacagtggcttagtaataggcacagtccctatcttttttttgaaagtcagctgtttctggaggatctcttgtttgtagtagttaagagcatgggcgtggaattagacagacctaggtttaagtcctggtgccaggatttataagctggtgacttggggttgcttagcatcttttttttttttttggtgacagagcagagtcccactctgttgcccaggctggagtgcagtggtgccattgtagctcacttgcagccttgaacttctgggctcaagtgatccccctgcctcagccttccaagtagctaggactattggcatgcgccaccatgcctggctaatatttgtgtttgtatttatttatttatttattttcagaaactcctgatattcaaattatttttattttttctatgtttcccaggctggtcatgaactcctggcttcaagggagcctttggcctctgcctcccaaagtgctgggattataggtgtgaaccactgtacccagccttacttagcatcttgaagcctcacctttctcactacaaaatggagtaaagggcatctgtctccttgtattgttgagaagattaaatgggaaattgtgatatacatgataggtgttcagtagatgataacagacattttgtgggttcagaagaaagcagagatgtcagcttctgacaggaaggggaataaggtatagacacttgatcaaccacagaataattacaaagcagcatgtggacaagtcttggctttgtaactaagtagctgtgtaaagctgggccagtcgttgagcctttctaatttttggtttgctaatctgtaaaattaaagggtcggagtagatactacctgttctagcattccaaattggctctgactagaagataacatggaacaaattatacacaaaatgataagtgacagaatgttcacagtaggatgggattaatcagaagtctcttttggaatgaggtgaggactattggtagagttcttggactttgaggaatagcataaagatggcagattgtgataaaatggttagatctgacaaaattcaggttttttgtgtgcttacattgttgggaagatactgcatttaaataatttttgtttacgtaagttatatattaaaatagctaatgtagtattaatattctgtttattcttatgttgccaagttgaatatttttcttggataacacttttctgttttgtgaagttattcctgctagcctttacataattatgcatttcagatttccacaagtgtgtttgaagtctcattttctagaagggattcaggattattagtccatgtaatgacaattatagtatgatatagaataaaagattttcttgtttaatttcttcatattagaaatgagggaagtaggatgcagaaggtctgagctggtaaaacatgctgatggtcgcactcctgcctccttttcctttgaggatgcctgaggttcttatacataactcttgttattgagaaatgttctaatttatcatcctgctgtactattttttcttttttcttttgtttgagacggagtctcgctctgttgcctaggctggaatgcagtggcgtgatctcagctcactgtaacctctgcctgccgagttcaagcggttctcctgcctcagcctcccgagtagctgagattacaggcatgtgccactacacctggctaattctgtatttcttgtagagatgtgatttcaccatgttggccaggttggtctggaactcctgacctcaagtgatctgcccaccttggcctaccaaagtgctgtgattacaggtgtgagctaccactcccggcctgtactatttttattgtagtgtgcacagtagtatttatacctgtagtccactgtggtaccctcattagatgcccgctgtcagccaagtgtaggtagactgtgatccgccttgctggaattaagacagtgggaaagccatacttggaaggaaataattacataataattacaacctgaagggttgtactgcgttctaggtgtccaagtttaacttggtccaagggaatcagaggaggcttccttcaagaagtaaggcttttgctgagacctgaagatgttagaaagtgaccatcctagggaccatggagggatgttgagttccgatatagtgaacatcacttttggaaggtgaggacttggcccttttgtgggactgaattgacactagtgtggctggagtgtgcagaagatgagcttggactaactagacgatggttggtggccatgtgaagttttgctgtttatctggacggcagtgggcaaccattgaagagttttaattcttagtgtttcacatgcctgggctctaaaccaccacacctggtgcacttttaaattttttgtagagacagcgtttcactatgttgtccaggctatcaaaagcttttttcaatggccaggtgcttgctagggcctgagggaggatgactgttgtcctgagaatattctgatatgctgaattttgctcgaataattacagctttatgatttaaacctttttgatgacagctgattcctcattctaggtagcttggttggtttggtggcagtgccagaccaagttccacagcccccagctgaacccctgcagctaattgggaatcatcaaatagaatcgagaagggccctgcagccagatccctgtaacttataccagaaatgttgaggcaatggcttcaccaccatttggacagttttgctacattatgagtatctttagaacccataccttgtatggaatttggaatcatttttttgtgatggagggaatttttgaaattctagatgataaagtctaatctcaaaaataatacaaaatttgctataaacaactatttctgttgccttgctactagtagtttgcttattttctttttggaagtctaggtatattttaaccataaaaataccaatgactattatttatttaaaatagacagtgtggggccgagcacagtggttcacacctgtaatcccagcacattgtgaggctgaggtgggttgatcacctgaggtcaggagctcgagaccagctgggccaacatggcgaaaccctgtctctactaaaaatacaaaaattagccaggcgtggtggcacatgcctgtaatcctggctatttgggaggctgagacaagagaattgcttgaacccaaaggcagaggttgcagtgagctgacatcgtgccactgcactccagcctgggtggcagagtgagactccatctcaaaaaagaaagaataaaataaaatagactgtgtgggccaggtattgttttaggtaccatgcctatattctgtcttatattataatcaaaatattgctaccattttacagatgagggcgtggtaggggctaaatgacttttccaatgtaacacagctgggtaagccaggttttgaacccccaaatacagttctttattaattctagcttaaaagcagacacccttataaatgaaaaggtacagaaacctttggatgcaaaaatcttaaatgtgaaaaggtggttcttagagtattgcaagggtgggtgaaaaagccatcctagtttgtgagtttgaataaaacatggtcttttccaactttgtgaaatgtgtcaacacccaccctccctttttcctgtattttccttgggagtgaggtgtgttgtgcttgggatagatggaagggctcttaaggacggactgaagttcggccccaaggaaaccaaggctgctggggccagatttgttgatcatgctcccagccaggaatgagggtgggcctgctctggagggacagcccaccttgcctctgaaggcagccggcacagaacaggcagagtggagtcaggcttctctgctctcctcgtaccatctgtgcgtactgcttcccccgtgcctaccagtacaggtggttccagagtaatcttcctcctttcttttcctgccactggcagccacagaatgttgggactaattaatctgatacctcaggataataaatctctttggtagaaacagcttgctaatgataaatgatagttttaatactatacatgcacaatctcatttgattcttgcaacaactctgtgatgtagctaagttttgtctgttacactctttacaaaggaggaaactgaggctccattctgatctaaacctccatcctttcttgtctgacatgctgtgagaatctcaactgattgtccaggcagtctggcctcccttcagtctgttctctgtacagcgtgagggaaatctttagtaatcccatctgatcacgctattccctgtttaaacccctccttgaacttattcctcttctctttccctttcagctctgcagctctcctccctcctgtaatgcttcctctgcctgcagtgtcattcatcacctgacttttaaaatcttcgcttatcctcaggttgcgtatacttttcctttagagctctgattatatcgtgtagttacatgtttgtgattattgtctgtttatctcaccagcttttaagcccacaagggcaaaaaacatgtctccttggccactgcttagcagagtaagcaataaagatttgttgaaaggagaaactcaggaaattaaatgtcttgtgagaagtagtaaatgatatttttactcggatataagctccctgagggcaggatttttggcgtctttttttcattgctatatccctggcatcttgaacagtgcctggcatatagcagtaatatttattgaatatcagttgtgcttggatgtgattccgaagatttcttatccaaatctaggactttttctctcattgtgccaaatctatctgaagatggggattagtttagttctgattctgaatcaactcatggatgtagccaggccatgttagccatctaaggggaagctactaattttttcttactggtttttagcctattgccagacatccattttgccacagtttttctcttagatagagcaagatttctctcctcaccttagggaatattgtacccaaccagatccttttgaatattggtttagaacgtgatggttttgaggattcatttggatgggattttttcagctaatcttggtctttacctgtgcactctgttgggtcatgagggcatgtggggcagtatgctcagtttaatggactcagaaataaacccaggggatctctgaaattagcagaattagcagcacatttgtttgctttttttttaaacccattaagttctaagaattttctttttttttttttttttgggagacgtagtctcgctctgtcacccaggctggagtgcagtggcgcgatctcagctcactgcaagctccgcctcctgggttcacgccattcttctgtctcagcctcccgagtagctgggactacaggtgcctgccaccgcgcccggctaattttttgtattttaagtagaaacggggtttcaccatgttagccaagatggtctcgatctcctgacctcgtgatccacccgcctcggcctcccaaagtgctgggattacaggcgtgagccaccgcgcccggccaagttctcagaattttcttatgttcattgatgaatactaagtgttcttcagttcatcaaagttcacctaccttttaaatggaacatgttgctttgaaatgtggggaaaatgactattattccaaattgctctttcatgatctcagagtaccctatttatatttctactttttttttaaataaatactttaagttctagggtacatgtgcacaatgtgcaggtttgttacataggtatacattaggtatacatgtgccatgttggtttgctgaaaccattaactcatcatttacattaggtatttctactttttttttttttttaagtgaaagcaagtttattaagaaagtaaaggaataaaggaatggctactccatagacagaacctatatttctttctttctttttttctttttttttttttttttgagatggagtctcactctgttgtccaggctggagtgcagtggcataatctcggctcattgcaatttccctctcctgggttcaagtgattctcctgcctcagcctcccgagtagctgggattacaggcacgtaccaccacgcctggctaacttttgtatttttggttgagctggagtttcgccaggttggccaggctggtcttgaactcctgacctcaggtgttctgcccagctcggcctcccaaagtgctgggattacaggcatgagccactgtgcccagccagaacccatatttctaaagaaagcatttagttcataaagtccagagattctttgaggtcaaaaagtcaggattgggagtccctgatgtttgcagtcagtgtggtagaacctcacagaagaaagaggagtttgtatttcgttagttttatcaaagctacaacttttcggaagccttcagtccatccagcattccagggaactgattcctaagtcgggtgttaaggcactgaggtgtacaagttgtggccaaaactggagttcagctgaatgagaatgacacacttcccttttgcttctcctctgccttgggaatctttcaccacactggggagattagacaaaaaccttctgcagtttattttctttttgaacagttacattatggagagacttttaagctaaaagaagaaaagctccctttttgttacaaacagcagtgtgtagtttcaacttgtccaggacttcctcagagatgttttaagatccggtgtaaacttgctgtggtttgcctttgggcatcaaactgtttagcttggctctattatatctgtaattgctgcattttaataattgcccaatattcttgtcagcaatttgcagcctatatttttaatggaaccatttgcctttcttttccacaggtttgttcagacctggcttaagcccctggattaacgcagcacagaccctcagacccactgcagctgtgggcagggtgacgcaagctcattaaatattcccacaagcctcgtgccgcttacagtttatgtgcttcataaaatcctctgggaagtcatcttcttctgagatctccttacagggatttgctttataaaagttgtctttaacatttgctgaaatagcatattgtttcagagaggtttttccttatcaaaattattatataggcaggaggcactatagttcttgtgaaccaattcactaatttagggaatctaatatttcgaagggaaaaaaatagagacagatcctctttgtggtggttgaatttttaagttaacggagaagatttccatatgatcagagttgatgtggaattatggtgacagaaatgttcgacttagagggataataagtcagtttaatggctcccaaattatctctataatttagtcagcttttgagacaagaccgttgtgtcattgatgacttatgcctcaacttgactggtaattttgttcttttagtgagtccactctttagcttatctccttttgactgttgtaatgtttatttttcagtaaacaaaagattgaactggatttacagtagctaagaattacataaatagctatatcttaatttctccactttattggtataaatagctcaaagagaatggacaagtagtgatacagtacagtaattgtagctaacatttatttggttggttgttacgtgctagggactgttctaagcattgtgtatgtatattaactaactgaatcctcacaacagcctaccatacatttcctaccacaggatatgttcattcaagaagagtaagctgcctaacattaccatttggtaaggggcagagtggattcacacccaggcagatttttaatctttatcataatccgtatgctattcatactaggattttaatcactatcgtatatcaagattgaaccatagtggcctcctgcctatataataatttagtttcaagacatatctaagaaattctttttgaaattggaactttactgttattatttctggataggtaatacttgcacatggtattaatacaaaacccagaagggaattcagtgaaaagcttctgctccctcccacccctgtcctgcagtcaccctatttcccccgttctcataggtaaagttacaattgcaaagagccattttaaatatctctctttgtcacttgatgcaataaattaagaccatttaattaaaaactcatttaaaataattttttttgtactgttatctacaagcgcccacattggctttgtctctgaaggtagctatgggcaactcctgttgcgtgatatttcctgagtgaggatgacaaggccacaacccccaggtgtgtgagatggctcccggaaatgccaccattctgccttttccagggcttagatcagggagggtctttgcacttttacccataacttttattcttgatgagaaggaaccatgcctggagcatagtaaatgctcagtacatgtttgttaattgaacttctgtgagttgtgccaggctcagggatagagggctggagaaatatactttggagtgtctaaatcagtgaccattagggccgtgtgaggaatattcaagttaggcaaaccaccacaaaactctcattgaagactctggataggaaaagcttagaaagaaccttctagatccttgagtccagtaaccagatagtctcagatgggctgagagacagggaagacttttttcctgttaaaatgttggcaaacagttgaaataagaaccttgcctttttatgtttctttatttttttcagattgattcctagcacaacttaatttgatccttgtgataaccctgttattataacattagattgagtctctaatcagtgctggttttgttttcttgctggcactagggttgcatgtatcaagtgtcattgattactttggtaccacaacttaactggtggtgttatatttcaggtgcaccttgattttcttctgtagttctgaaaattctctataaaaccaaagatttaaaatgtcaaaaacagggccgggcgtggtggctcacgcctgtaatcccagcactttgggaggctgaggtgggcagatcacgaggtcaggagttcaagaccagcctggccaacatggtgaaaccccatctctactaaaaatacaaaaattagccaggcgtagtggcgcatgtctgtaatcccagctacttgggaggctgaggcaggagaatcgcttgaacccaggaggcggaggttgcagtgagccaagactgcgccactgtgctccagcttggcgacagagagagactctatctcaaaaaaaaaaaaaaaaagccaataacaaatatgtcatttgcaaaagtatttgctataaaaatctttattagatagtcactgccctcagtctagtttgcttgagtgctattttgcatcttttaagataaatttcttacattacgcttttcagaaattctctgtttaattttagtgtctgtttgtttatgaagtttcttcattaagttttcttattgaaatttgttttacaggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggtaagttgcataatataaattgcatatttgttatatatttttggatatattttgtcccagtctctttagttgagatgaagtttcactctgttacccaggctggagtgcagaggcataatcatggcttactgtaggctctacctcctgggcttaagcgatcctcccacctcagcctcctaactagttgggactacaggcgtgtgccaccatgcccagctaatgttttattttttgtagagatagggtttcctatgttgctcaggctggtttcaaactcctgacctcaagtgatcctctcttcttggcctcctagcatgctggtattacaggtatgtgccactgtgcctgacctgtatttacatttttgtccctgaataaggatttcaagaaagcatttttgtcctttattagcaaataaatagatcttctagattgaggtgacactcttgacataggctgcttgggaggtatttagttttgcctatttcacatatttcaatatgtaaccttttttttttttttttttttttttttttgtggagacagagtcttgctctgtcacccaggctggagtgcaatggcctgatctcggctcactgcaacctcctcctcttgggttcaagcaattctcgtgcctcagcctcccaagtagctgggactgcagatgcctgccactacacgtggataatatttgtatttttaatagagacagggtttcaccattttggccatgctggtcttgaactcctgacctcaggtgatccgcctaccttggtctcccaaagtgctgggattactaactttttaaaaagtagagaaatacactgagcttcctggaggccaaatgagattggagatgaaaagatgcaaatgacttggaacattgttgcttaactaagagtatcggatctcccacaccaccatcttagtgtgtttactgtgaggggttacttagtaaatttggaagcttaatttgctctattttattataatttccattgtgtctattctgtaatgagctacataaaactaatttgttggaccagttctggaaactggcaggtctcagcaagaaaagcattgactcgaaaagtgattagctgcttggttttggctgttgaattgcacatacagatgagagtgatagtaatgatcatctattgagtgggcactatatccaggcactgggctaaacaattaaagaatataaaaatgaataaggatattcttatttaatgagctcacttaatcacaacttggaggtagaattaatttggcattttataaatgatgaaatgagatatggagagattaggtaacttgcgtagtgtcatgtagctggaaagtggaagagccagattttacattcagattttacatctatgctcttcacctctgtgttatactgaagaaaccagatctcccttaagactccaatagactcagatctggggttgtgtgcagacgtagactaagcgagagtcagctggcagaaactggtttatggattggaaagtagaatgttcctctcattgcaagtatctttttttttttttttttttgagatggagtctccctctgttgcccaggctggagtgcactggtgtgatctcggctcactgcaacctctgtctcctgggttcaagcgattctcctgcctcagccttccgagtagctgggactacaggcgtgtgccaccatgcctggctaattttttgtatttttagtagagacaaggtttcaccatgttagccaggctggtctcgatctcctggcctcagcctcccaaagtgctgggattacaggcgtgagccacttcccctggctataaatatcttgaaagaaagttgctaggccttttttgttgttgttgttttttgaatgccagtttatgaatttcaactgcccattctctatttttgtctatcagcagtttcattttgtctcattattgaagtgctatttgccttttagcctgtgtattaaaatggaattgacttaaaatctcatcgaaaagtagtagaaatgcacccccccacccccacctcccaaaaaaaaagagagagagaaagagggagagaagcggcttgatggaaaacatgctgttttgatgacaagatgtctagtctcaccttgtgggtttgaggctgggctttctgccttcattgatgcctgggtcagactgaaaaacacaactgaagaaggcactttatgggaaaggagtgagttcaatggccctgtccagccttgatgaatttgatagtgaatcagttttgcttcagatcttcctttcctatttgaagcctttgggaaaatatacacacaagtatatatatatttgagttgaatacacactcaaggctttgctgaggtggaagggacagtagagttacagattttttttttttttttgatacagagtctcgctctgtgtgtcacccaggctggagtgcagtggtgccatctcggctcactgcaacctctgcctcctggttcaagcgattctcctgcctcagcctcctgagtagctgggattacaggcatgcaccaccatatccagctaatttttgtatttttggtagagatggggttttgtcatgttggccaggctggtctcgaactcctgacctcaagtgatccacccccttcagcctctgaaaacgctgggattacaggtgtgagccaccaccgctggatgaattacagattttataatagcatgaggcaactgataaatagcacagaggtatggatgcctttttggtgtagaagtttgttggttgtttcccttttgcacaacataatagatcaaatgaatgaagaagagggaaattttgtttttttttttttttttttttttgagacagagtctcactcgccccggctacagtgcagtggcacaatcttggctcattgtaacctccatctcctgggttcaagcaattctcctgcctcaacctcccgagtagatgggagtacaggcacacgctgccacgcccagctaattttttgtattttagtagagatggggtttcatcgtgttgcccaggctggtcgtgaactcctgagctcaggcaatccgcctgcctcggcctcccaaagtgctgggattacaggtgtgagccactgtgcctggctgcaaaaaaaattttttatatgctaatatctgatatttttctctgtaggcccagcatactttacaaaatggttttttgggcattctggatgagctgaatttagctcatctgggtagttataacaatgatgaatatttcaaataattactgtgtgtcaggccccaaatttctttacatgtattatctcatttcatcctcataaatactctaagaaatatagatactttaataatccatagtttataagtgaggaaatggaagcacagagaggtcaaataactttcttaaggtcacacagctaataaatggcaggtggaactataaacctacttagtccaggtctggagattgagcctttaggcctctctactatattgatttgaaggaaatcatttgtttggaaagaatggtaataggttttgagccatttatgtcctcctgaaacattaaatcatttattcactgatccctgctgagtacaaagcacagtagtagtcacttagggatatacatgcaaagaaatgtaagattcgttcccaccctattttttttatttttggagagatgggatcttgctgtgttgtccaggttgaccttgaactcttgacctcaagtgatcctcccacctcagcctctcaaagcactgggattaaaggcgtgagccactgtgcccagccatattcatcccttcttttgagttgcttgtactttatttaggcttataaaatataaccatataaccaaataatgaatgtgtagtgaaagccaagtaaaacccaaagacctcagaggggtcacgaggggaagccctgtgggtcagagtagccagggacagctatgtggaagctctagatcttgaactctgtcttgaagactgggcagaatctaggaagaaggaggcactgagttcaccaggtgggaaaacctggcctagcacggaatgtggcatttaggtgcttaatttttttttttttttaaataaatggatgacctggagagctggtgtggaaatgtagcaggaggtctatttggaaagaaggatggagtagattatgaaagttcttaaatatcataatgaggcttgtggattttattctgtggtttggatgctctcttcttccatcccttggagccaaaggcatgcactgtttaatcttggaattcaaacggtggcctcaaacagtgaggctgagtatgtggcctcattagcttcagacccagcagtgcttggctcacaggctgtcatttatcaagggcttgatctctgccagctaatttatttaagacaactctatgagatgggtattattattatcatcacctccattttacaaacaaggaaattgagactcagtttggttaataatttgtacaaagtcctggaactaataagtggcagagttgagacttgaacctggcagtttggctctagaatccagcccatcaaccactagatccttctctagggaggagaccctgtgtgtgggatgaataaacctcttcttgattgattaaataccaggtgagtagctaccagtgtgacatcctggaaccagattaagcccctttggcctcagaagagacagacacaggtcatcagagcagaaggaccctcaagtagtgggccttctttattcatattctgacttaaccaaagtggccttaaagctgtaaatcggtgggaaggtgtggaggtctggcagcagaggggtgaaggttgtcaaaggcctccttttggttatgtggccagaggaggggcagagcacaagggagcacgtaaattgagcccaagttagaataataggagcctgcttgttccagctccataggtttgtctgggccttcagtgaaaacctttctttccttctctgcttgtgatagagagtgaatgaaggcagtcggggccgggtgggtcgggggatatccatgtcccagtgttagtgttgttctgacaaaactcatgctttcggctgggcgtggtggctcacgcctgtaatcccagcactttgggaggccgaggcgggcagattacgaggtcaggagattgagaccatcctggctaacacggtgaaaccccgtctctactaaaagtacaaaaacaaaattagccacgcgcggtggcggacgcctgtagtcccagctactggggaggctgaggcagaagaatggtgtgaacccgggaggcggagcttgcagtgagctgagatcgcgccactgcactccagcctgggcgacagagccaaactccgtctcaaaaaacaaaaaactcatgctttccctcccctccctcgttccttcgttatcatatagcactgttgaggatggagggtggactgtgctcttggtgaacacgagctgtgtaaggaccataatgcctcttgattagaaattagcttaggtgatttacttgggttaaaaaaaaaagagagagaataaatacaagagatttattggggttaaaaacaaaaaagaaaaaaaaagaaattatctaaggttatttattggcctcttagatcctgtaagctacctaatgtaagaaaagtgggaagtttaaaaaataagtgcttgatactatgggcttaagtctaagttttgctttaaaaactcgtctatacttgtgttataacattactattattgaaaatatctgctttccaggctgaagtgattcatttattattctagttctgctttcctcctttgtaatttgtgataattgtgcttttctttttaatacaaaaaatggataaaaataaaaacttgaaaaggcaaaaacaaaaacaaaaacaaaacaacctcccaactgttctacacatctttaaaagatattagctgctgcctctgaggcttgccaacattaggcagggctatgtttccaggagttttagtaataagaaaaagaggcatgcatggagaattcagggaaatcagttttattggaagggctggagttatcactggccccttgtgccaggtgagaggggtgccgctgaggtgagctctggagcagggctgctggcattgatgccagtgggctcttggtggaatggctaacttcttcattccactgtctcaattcagtacccagatgtatccttttggaaactcgcctgcaaactgtgcacagatttctattgagaaacacatttcttttcctctctactggatgtacctggaattccaggtagagtccacaggaaaatcgagatgcttttagtctgagctattttcctgctcagaaagctctgaactctttgtgtctgtgggagagcaagctgagataccagctggttaatacttggtctggaatggtacaagctggcagccttgagtagaggctaataataccatattgtatttgtaatcttaaaaatgtttttataacaggtatttcatttgatcctcacagcagcctctgggggtaggcaggcactattttcttcatttctagaatgagaataatagggcttagagaaagtaagtgatttagaaagataattcaagtcttggttggaccagaacttagacatgcttttgcagacaaactgcaccaacaaatcctgtgacctttttggtatagtgcacccttagcacctcttgacaaataaaaattgtatatatttatggtgtacatcatgatgtttttatacatgtctacattgtggtgagtaaatcaagctttttaacatatgcataacctcacacacttatcattttttgtggtgagaacacttaaaatatactctcttaacaattttcatgtgtaaaatatattattttttttcacatttttatagggggctgtaggaagggggcctcctcactgtcgagtgaggtggtcacagtttctttggcagctccaagctgggcactgggggtcctggaggtggctctgtatgtcagcatgttcctaccaccttggaagggcactagatagtttcagggcgtcacctggttggtcatgatgttgtacttggtaggggctgagtattggcccccatggtgaaggacatgactggcaccagctccatggcccaggcatttttgaggaaggcatgagtcctagaggggtaggtgagtgggggtcacctctacaggggtcatggccatcttaggctcagtggtggcagtggctactataataccttgttattaactatagtcaccatggtgtacagtcaatctcttgaacttattcctcctgtctaattgaaattttgtatatttgaccaacatctcctcagtccttccacccccactccccagcctctggtaaccaccattttactgtttctatgagtttgactttttttctgggagggggtgggatggagtctcactgtgtcacccaggctggagtgcagtagcatgatctcagctcactgcaacctccgcctcccgggttcgagtgattctcctgccttggcctcctgactgggactacaggcatgcgccgccacacctggccaatttttgttatttttagtagagatggggtttcaccatattggccacgctggtctcgaactcctgaccttgtgatctgcccgccttggcctccaaaagttctgggattacaggcctgagccaccgctcccggccatgagtttggctttttaagattccgcatataagtttgatcatatatgatatttgtcgctctgtgcctggcttatttctctgagcataatgtcctccatgttcatctgtgttgttgcaaatgacaggatttccttcttttttaaggctgtatagtattccactgtgtatatataccacattttcattattcaatttattcatttatcctgtacttgaaagagaaatcttggatgtgagttaacggcctgtgaacctcagaggtggttctgccatagttatctcctgtctgccaaacgagtgatcaaaggctgtaatactcataagggcaggaaggctggagggtgctggcaggggactaccaccagggaatgtaaggatagaagatggataggctcaaaggttcaaagcaaactgaaaaaaagccccctcccctttttttcttcttcttctttttttttttttttttttttttgccaaccctcaggtcttagaacacagctagttgatttggtctgtgattattattgtttttagctgattattttatcttatttttattttatttgtttttttgagacagggtctcactctgttgcctgggctggagtgcagtggcgcgatcatggctcactgcagcctcgacctcccaggttcaagccattttccccccacagacccccaagtagctgggactacgggtgcacgccgctatgcctggctaatttttgtgttttttttctgtagagatggggttccgccatgttgcccaggctggtttggaactcttgagctcaagtggtccacccatatcggcctcccaaagtgctaggattataggtgtgagccatcatgcctggcctttagctggttattttaaccagttttgtgtttaattctgctttttgatacacaaggaaaggatattgtcaaatgtgataccagttatcaccagagtgccaaactttattttaaagagcaaataactgctattaaaagacctagagtggcatggtggtggctgcctgtaatcccagctactcgagaggctgaggcaggagaaccacttgaacctgggaggcggaggttgcggtgagccgagatggcgccactgcactccagcctgggcaacaagagcgaaactaggtctcaaaaataaaagaaagacccagagtggatagggtagcctgcattttagagtgtattccctttgaggatattgtgcacagccaagtgtgatgaagcacctccccacctaccttctccattagatttttctacagaaacagcatgtgcgtgcatgcgtgtgcaaacacaacacacacatgcatgcgcacacacacacatacacacacacgggagttgaggcagtagttgagagaaaggtgagttcatttctcaaagattcccttgccctgtatggacctgtgtgtgtgtggaggtggggtggatagcctaatgcaaggccttttactttttttttttccctgagacagggtctcactctgttgcccaggctggagtgcagtggcacggtagctcactgcagccttggcctcctgggctcaaacgatcctcccacctcagcctcttgagtagctggaactacaggcacatgccaccacacctggctaagttttgtattttttgtagagacaaggtttcgccatgttttccaagctggtctcaaactcttgagctaagcaatccacctgccttggcctcccaaagtgctaggattacaggcgtgagccactgtacctggccctttttatcattttcaaggagagtttactaatagctagttgggcaactgaatgtgcatatagtggaggggaggatgtttaccaagaatgagtaagattattgctagatgtgatgttagccaagtcaagagaatcgaggtttctctttgctttgcatccttatcgtaggctgtataattgccacccagctttctggatttctgattgatttgggttattttaggacagcagtgatggtgtgttttacagtgatcaacacttccatcaagacacagctttatctgtatgtgcctacacagctctttaattgctaaaagcttacccttgcacacggttgtgtatataggaaattagactttctcagcttgtttgctttggtaattaatccaactctggaggtatctttatcaccccatagagcttcgagctctgagcacgctgattttggaagtgatgtaggagcagggagtgttctgggaagtgttccgggaagcgtgccagcaagaggccttcctttaggactgaccctgctcagcaccgaggcgcatgattggcccatcccgcaccacatccatggcagccactgactttcattttctttaaaacgatctctgccagaatggcctaaaaaacatttatcctgaacttcaatctagtcatatttttgttttctgagagggcactgtcaatcaggtggaattctagagggctgaaaaatgccatagctcttggaacgttccttccaaggagtaggcagcaggtgctctggggactgaagcccagctattcccctgccctcccttgccagctcttaaacatctttaaaaaaatctacagtgtaatgtggaaaattttactaccttcaaagggaaatgttgatttaaaaaattattttaaagttactctgtttgttggcaatgaggggaaccatatatggcaaaaggaaaaggtcttgataaaattgctctgtgttctttgttttgcttccttttgtcctcatatgcctgagtaactgcgtcctagtccagaagattgaccagggccatctgagtaacacctcccttccttcctactctcctactccacccatgaggatacacaggtagcataggcctcaaaggagggcagaggttcagcctctggagtcagcccctgctctgcattttttttttttttttttttttttttgagacagggtcttgctctgtcacccaggctggagtgcagtagtgcagtcttggctcactgcagcctcaacctcccaggctcaagagatcttcctgcctcagcctcctatgtaggtgggactacaggcacgtggcaccacacctggctaattttgtgatcttttatagagatgacatctcactgtgttgcctaggctggtctcaaacttctggcctcaagtgatctgcccaccttagcctcccaaagtgccaggattacaggcgtgagccaccacgcctggcctccctgctgtgttgttttcatcattgaccccgctggactgctacagcattttcctgtgatgaacttttccagtgggatgcacctgtgcatgacaattatgttgttaaattgctgaaagttaaagttataatactacatggtgaagcaaaatgctctatagctcctgcccgcccttatcttttccttttgagttaattagaggacagaaccacttattttgccttttctttatacttttaaataactactatgttttagatgaagacttgtagtctggtcaacgttaagtacctcctaagattcaggtactttgctagcttctgaggcacagaaaggggagagactttggggttagtgcaaataatgagttttttcatttttttctttttctttcttttttttttttttttttttttttgagatggagtcttgctctgttgcccaggctggagtgcagtgacgcgatctcagctcactgcaagctctgcctcccaggttcatgcattctcctgcctcagcctcccgagtagctgggactacaggcacccgccaccatgcccggctaattttttgtatttttagcagagacggggtttcaccgtgttagccaggatggtctcaatctcctgacctcgtgatcggcccgcctcggcctcccaaagtgctgggattacaggcgtgagccacctcgctggccttttcatttttttctaatacagttaactttcctaaagtgttgattgattgatttaacaaggatttactgagtacctattgtatttcagacactattccaagtgttggagagatagtagtaaacaaaacagataaaaatccttgtccttatgaagcatgtctctagtggagagagaccagaaacaaacaaaatgcatatatcagcaggttcgtcgaataaaaagcaaagaggttggggattgttagcggggattgcaatttgaagtaaggtgattaggaagggcttcactaggaacattgagcaaaggtttggaggaggtgagctaagtggatatctggggaaagagcattccaggcagcaggaaaagcaagtgcagaggccctgtggtggaagtttgcttgcagtgctcaggcaatagcaggtgggccaggtgcctgctggaatgggaagtcagagagttaactgaggggtgggagacggtgcgggtgtgtatagcccaaggcattgcaggccatcataaggttctcactctgaatgacactgagccattggagagtttgagcagaagaatgatatgatctgaaggatgtcttaacaggaccactctggctgctgggctgagaataggctgttgggcaaaggtggatttggagatactggcaagagaaaatgatgaccaggactccttattagaaggaaggacccttgggagtcatatgcttaggaaattcagaatgatgcttttgtaatttttccccaacctattccttttgaggaggaaagtggataaagatgtatttctcacatcagtggaatactgtgccatagcctaatattaaagataattacatctatagaactgaaaaagctgagtcttaaaacacaaaacaacctccccaaaccatctaaagaaaatctctttgtgttgtgaatgaatgtccttgaaaaatcatcgtcttaatagcctaaaccctcttttccttgcttacttaccctcctgatttccaagtcttgttcttttcatttctcagggggcctggttttcaggatcatgagttttgagggtcttaccaccttttgcagaagtgcttcttacagtgttgtaaattacagtttcgaagaaatacagttgcatccagttttacatagtaaatgtttctgagttgtaggtcaacctatttttataagttaaactacatattaaatgtgagcaaggagcatgatacaacagatttttttctataaagaaaataatcacttttaaatatattttataataaggatattcatagtggttttgccagaggtgagtggttttgccagaggtggaatataccatcttgtttatggaataggaagttttgcttttggagtttgaggttataaacaaatattaggccagtgctttcttatatgcatgagaatcacccagggatcttgttaaaatgcagattctgttttagtaggccttgatgggtcaaagactgtagatttttaacaggctcataagatgctgataccgttagtctgaggaccacatttgacagcataggtcatctgttttctcaatgcacaaattgtaacacagaaactgcaaacacctagacaatttcttagtgccataaaagggagcttgattttagcatgcctttacaacagctaccttgaacacctttggtaaacttgtttgggtcagagggatccatgtgctggagaggaagttggtttgaggcagtgagttccacagatgcctttagctctctgactgtaagtgtggtgcacctgcagaaaccaggtgcatctttattagctggggctacaccttgacataatcctaacagttgttaaagaaggaattcttcccgcccccaccatttcttccttttatgtgcctcttttgccttgtctcatttcttgccttgtgacttagtagaccaaggtaggagattcgtgttgggtcactgagggcggggtcattggtcccggaacctgtggccaagggactcttcggtaatgagaggtgatatgggctgagtggataaaagggggactttaggtgggttagcgagggtggctctggagttagggactaaaagttaaaagttgggtatacctcatttctgctagcagggctctaattttctagctcaggtttccccattgacttcctactttattctttttttttttttttttttgagatggagttttgctcttgttgcccaggctggagtgcaatggcgtgatctcggctcactgcaacctccgcctactgggttcaagcgattctcctgcctcagcctcccgagtagctgggattacaggcatgcactaccacgcctggctaattttgtatttttagtaggaatggggtttctccatgttgctcaggctggtctcgaactcccaacctcaggtgatctgcctgcctcatcctcccaaagtgctgggattacaggcatgagccaccgcgcccggccctactttattcttataatcacactccagtctagagcttttaaaaaattaacattttttagaagggaaaaatttctgtaagttgtaattgatgtttattaagcaccctgacaccacatttattataagtggggataagactgagaatatttaagctctgtgcctgaaaagttgtgttttaaactaacttttatttgtttacactgccattgagtagtttataaggttttctgatttgctttctctggcctcatcactgtttttggagaggcagcgtacaacctatgtacagctctggagctcgccgcaagactcaggtggtggtcattctgcttttgaaattgaaccagaaaagtcctgaggaatgtaacaatattttttctttttgcccccctgctagcttttttctagccctcccaaaaatgtgtttatgttgctgtccatgcatgtggagcagtctggaattctgtgtgacattagatagtgaaaaaaatagatttcccacgtgactgaggttataggagtgagaaatcttggattatgcaaggactctttgattggaagaaggacattttgagatgagatttattttaagatatagtaaaaaaaaacctagtatacaactttttgtttttttctaaactaacccttttcgggggtgacaggatggggtgtggactagaagcaataccaaacttttaagtatcaaatcttcactcagaagaaaaaaaatgtcttcagggtgaaagaatagctcaaatgcgaaaagcctgatagttatataatttgagagtagggtctggcatattatagaggactccgagagcctgatccaagcagcctgccattttcatcaccccaggattatctgtaaggacaactttactgtctgtcacctgccaggtctcagcctggcccttgtgagtgccaggaagtttgtgtcctctgttttgccaagcttaattagctctagaaataccctatcaaaggctgtctggcagtgttccattaatggtatggggtgaattcaaaagcactaattaattgttagattatttgcaaagcccatgctgaaaaacctaatgcctgcaggagaaagttggcagagagacggtacagagattagcttggaccttacccggctcaattgcgttttggaattgggccaagaggggagttgcttttctttttggagaagtgcttgtggctatattgttttctaaactgccagtgtactgctctaggctctccgtgagggagctcatatggacacttgcagacctagagagcccagagaccatcttcaagaggttttgtttatttttgttttgtgagagaaacacaattgtttaactttcattaactaaataaattcttcgcaagggcctcttcttaaatagaggaaaaggaactctagtttgtagtgtaacaattcaggttttaagtgttaaatgttcaaaggagccaggatcagggctttaaatagttttttcttcttaaaataaaacaagtcaggttcctcatgtcctctgtttaggtggcccaggtcagcaaaaagtgaattttccaactgctactgcagttggaagatgctgtttaaaaaaatcttcatttgaaatcaagtgcatgccaatttaaggtcagggtatactacatgcaggaaaggaagaaacaggtaaacaggtttgcattattttgctacatttgacatatagaatgataacacctataattaactcagcttgacaaattgtagacaaataatagaagtccctgtcccttatagatgagagagatttgaggcttttggagccaagtgccagtttctgttgactctgaaggcaacggagacagctgaagatcaaagtatagaaggatatttcagacttatctaaaagccaattgagtgttatataagggagctgtgtgtagctctgtttgaaaacatccatccagtaatcttccagttcctgagcctggccctgcctcctgttgacaggcctcagcgtctttttcttgtccttttgggcttgagcaacatgtgagtaagtacttatgtacaaatcccagaccaaatcttactttattaacatgattcagaagaaaagaattctaatgaaaaatttcagaggactgtgccgaaacatttcgtgatgttgtcagatctccctgaactcaggaaaggcccccaaaaatctattatttctgtttattactcaacttggaaaaagcttacaagaatgcctcaggagagtatgcactggttgaggaatttattcctgggtgtacagcatcccctacgtttactctgtgtgaggcgggctatcctgaaaccctgggcaacctgcctgctcctcagccagcaggtctagagtagcagcttagtatttttaaccctttctgtcatatgactcccagccaactttttgagttgatagaaacacagatctgagagctatgaggaattatgaaagcctttgtactgacaaaagactatgatttttctttgctgctttattatggttaaaaggtctcattatgcttttattttggagaggtaattctgtataacaagacctacttgtatatcccagttaggttgtgagatatcatgaataacattacaactgatagttaaattgaagactttaaatgattttcctcaaaaagataaaactaaattcaaggttattctaaaataagtatggttatttgcatttaaaaatatttcaaagggagaaagagaagttaggattacaagtgatagaatgaaaagtgctcataatttgttgcctgtagtatctgttttgctattcatgaacatggtacacccattcatttgtttaggttttccttaatttctttcagcactgcttttgtagttttcactagtttcttttgaagactctagtgtgtccaaatgtgaacaagattcatcatgtctgtcttattagaattatgtttaagaacctctgttttagagctgtaatgctatcctcttcaatctactcttcattaataatgatgaaaactgatactccctctgactttcctggagagtgagctcaggggtgtgtaactaaggctattgctaaagtgagttatcggcctggctgcctttgctctaagttgtaggaactcaaagctcagtgtgtactgtgagatatgttctttaaggctgaaggctagtgttgctgagcaagagatgtagtaaaatgaatatccttgttcctttggactaaatgtcagagttagaggcagtcttggaacccaaagattggatgttgtgcctttccatcaggccgttgggctttcccagcagagtttcgctggaacagagtcactccagtgaactttcattttggacttgtaacaaaaggattttgtagagattttaccctctgaatgtgggtaatacctgagggctttatcaagatgaagagtaactttgttgggttgctgcacctttatttagggaaagtaattctccaccacagtgtcaagagtggtcttgacagagacatatgaaaggtcagagagtcaggatcgtgcactagttgtgaccttgggttttggattcaggcacacaggttcaggtccagatcataggctgtgtgaccacaggctcagtgtcctcatttgtaaaattgaagtatcagtagttcctgtctcagttgtgttcttgtgaggattataaatgagataatgcatataaaccagaggatcacgtttattatgaatgaaactactggaaatagtattctttgaaaatgttaccatagtacttacctagtttggactgctataacaaagtcacatataagtcacacatagattgtatgtcttataaacaacagaaatgtatttttctcacagtgctggaggctgtaagtctgtgatcaagatgccagcatggttaggttctggaaagggccttttccaaattgcagactgatgacttttcattgtatcctcacatggatacagtcctcaaaaagacaaactagagagttctctggagtctcttttaagacactcataccattcatgagagcgctgtcctcatgacctaattgctccacctgttagcgtgccccatctcccaataccatcacactggggttaggattttaacatacaaattttaggggggtacacattcagtccgtaacacatggtggacatatttaatcagtcttttaagttgcagttctattattcaggcatatttttggtacaaaaattagatctgatcctgaaatataatgttgctgttaaacagactttattgatgcccagtttctttattttccgtaagttttacttagagcagtacagtggaaataccacagtggtacaatgggagtgatggagttgggagagggtgtggataagaagtgctctccctgccccccaactttttgttttgttttgttttggagatttgagtcccagttttgtggtttgcagagcttttgttgccttatctatacaatactgctaattatacctattcctttgatttgatgaggataaaatacttgtaaagcagccagaagtttatggcacatagtagttaggtcttcaaaaagttaatctttatttagacaatatatatgtgtaggaaaagagggggagagagagctagaacaaccttattatgggcagaatgcatttgctgtttagctttgtgctcccaatggagaaaaagcaggttggggaatgtccttgggagatggctgaggagctgttggctgagccaggtggatttgaactgagcacctggatggaaaagaccttgttttcttttgaggcagtgacttggtctttaactggaagttacagggtaaagatgaatgctcaagaacggtggcggtgctgaggatcaggaccagtgggggacaggagaacccaagtgaagtggattgaggctgtgtattggtagttttcctcatctatatggtacctctaggctcagtcccagtctaaccaccctacttaaaattgtaatccctctctaaccacagaaactcctattccttcttatcttgctctgtttttcctcgtagcacttctcacctcaaaagctgcttgtaatttacttatgtttattatttatcttcccccactaaaatgtaagctccgtgagagtcaagttagttttgcttttgctctggtgcagctttttcttttttcttttctttctttctttctttttttttttggcagagtcttgctctgtcacccaggctggagtgcaggggcacatttcttggctgactgcaaccttcggctcccagtctcaagtgatcctcttaccttagcctctcaagtagctggggccacaggtgcacaccaccatgcttggctaattttttgtattttttggtagagacggggttttgctctgttgcccaggctggtctcgaactcctgaactcaagcaatccacctgcctcccaaagtgttgtgattacaggtgtgagccactccacctggcctaaaactacttttttttttttttttttttgagatggagtcttgctctgttgcccaggctggagtgcagtggcgtgatctcagctcacagcaaccttcgcctcccaggttcaagtgattctcctgcctcaacctcctgagtagctgggattacaggcccacaccaccactcctggctaattttttgtatttttagcagagatggggtttcaccatgttggtcaggctggtcttgaactcctgacctcgtgatctgcccgccttggcctcccaaagtgctgggattacaggtgtaagccactgcgcctggccaactatttttataataattccaagattgggttaacactgctctaattgtataagagcaatattggataaaactgctggtgactcagcaggaatgaaggcagtacttcactggcacacacttgcagtaaaacatctgccactttcctttaagagtgttgttaccctcagatacatgttttttccttattctatatggtaaaatgggaggtacgtatgttgcatttctgcattccaaagtacaatgattttcttgaggaaaagcactgtgcagttgtttgagttgtgagctgatctggtctgtttttcatggaacaccatttgatgtgaaagagtgactgacagacaactgatggttatccagacttcagtatttggcagacatttttgaaaatgaacaaagtgagccgggcgcgggggctcacacctgtaatcccagcactttgggaggccaaggtgggccgatcacctgaggtccggagttcaagaccagcctggccaacatggtgaaacccagtctctactaaaaatacaaaaattagctgggtgtggtggcatgcacctgtagtctcagctactcaggaggctgaggcaggagaattgcttgaaccctggaggtggaggttgcagtgaactgagatggtgccattgcactccagcctgggcaacaagagtgaaactccatttcaaaaaaaaaaaagaaaatgaacaaagtgaacctgttagttcaaggaaaacaacagtatttgttgccaataataaaatttcgtttttcacacaagttaaaattttggaaaacttacatccattaccatgattatgacagtttctcaatggttaaatacttttctgatgaaatcagttgagatattaacaaatgtgatttttaaaatattatataatgaaatatgtcttatttggcagtaaaccattatttttcagatgaccaatgcatgatattacaaaatcatgcatgatattacaaaatcatgcatgatattacaaaatcatgcatgatattacaaaatcatgcatgatattacaaaatcatgcatgatattacaaaatcatgcatgatattacaaaatcatgcatgatattacaaaatcatgcatgatattacaaaatcatgcattggtaaaatattccacatcttgagagtacaagatagaacaattgattttttttttttttttgacagagtcttgctctgttgcccaggctggaatgcagtggcatggtctcggctcactgcaaactctgcctcccaggctcaagtgattctcctgcctcaggctcccaggaagctgggacttcaggtgcacgccaccatacccagttaatttttgtatttttttttttttttaaagtagagatgggatttcatcatgttggccaggctggtctggaactcttgacctcaggtgatccacctgcctgagcctcccaaagtgctgggattacaggcgtgagccaccgtgcctggccagagcaagtgatttttaaaaactttttattttgagataatttttgactgacagaagggttgcataagtagtacagcgtttctttaggcttatcactcagctttaccttatgaggacatcttacataaccaaagtacaatgatcaaaactaagaaattaatcttgttacaatattattaactaaagtataatatttattaggatttcaccagtttttctactaatgttctttttctggtccagaatccaacccaggatctcacattgcatttagtcgccttgtctccttagcctcctccaggctgacagttccctggtctttcaatgaccttgacgctttgggaactactggagaatgtccctcaattaatttttttcctgacattctctcaggattacattgaggttatgtgtcatttggaagaataccatagaggtgatgtcctcttttcagggcatcaaatcgaggatatgttatgttgataggaattattactagtgacgttaatcttggtcacttggctagagtgatgtctgccagaattctctggtgtaaaggtactatttttcactttgaaattacgcagtattttggggaaagcaaaggattttaatgttacggagtatgaaaaatttattatgtaattcagatgctaccttgcaactaaacttaagaaatgattatttgttgagtttaggtgtaatagtaaagaagaaataaccacaagtatataaaaagacttaagatttggctgggtgtggtggctcacacttgtaaattccagtactttcacggggtgaggtgggaagattgtttgagcccaggagtttgagaccaggctggtcaacacagcgagaccgtgtctctacgaaaaactaaaacattagccaggaatggtggtgtgtgcctgtggtcccagctgctcaggaggctgaggtgagaggatctcttgagcccggaaggtcaggactgcagtgagccatgttcatgccactgcactctagcctgggtgacagagtgagaccctgtctcaaaaacaaacaaacaaacataaaaaaacttaagatttgaaacttccaactgcatatactgtatctgtgtgaggccagatttcttcatatccttcaaccagaacaatgtattgcaaaaaattgaatgcaaaagtagatgggaaaacccagtggtcttgtattaagccagacatttaaagagatttgctgtgcatgtgtctttgaaatttaacaagaaaagagatttgcggccgggcgcggtggctcacgcctgtaatcccagcactttgggaggcagaggcgggtggatcatgaggtcaggagatcaagaccatcctggctaacgcggtgaaaccctgtctctactaaaaaatacaaaaaaaaaaaaaaaattagtcgggtgtgatgacgggtgcctgtagtcccagctacttgggaggctgaggcaggagaatggtgtgaacccgggaggcagagcttgcagtgcgccgagtttgccccactgcactccagcctgggcgacagggcgagactccgtctcaaaaaaaaaaaaaaaaaagagatttccaaaaatgtaaaacagtgctgctcatctcaccttacattttgttttagaaagtagttgtttttcatgaaagatactgtttatgttacagtttattatagttggtttttagtgaattaataaatatttaaaaatttcctcagttttaatttctattgcagaaaatgttaatagacttatattaacaaaatctctttggagtcctcagtaattttaaagcaataaagggatcctaacaacaaaaagtttcagaattgctttttttctgaataatacagaagagatatcttagtaggggaatcttttcttctggaccaaataaagatttaatgaaggactccaccaaggactcttggtccttgcagggaagtcactcaattatcagtgtactcagctggcagatgagggggattgccttgtactatctccaagtttctttaaaccccaaactacatgatttcaaatcactatcattgtcagcatgggcattatgcagcaatctcccgagtatgctatttgctaggttaaagatgaaggttatatgtaaggatataatgcagtagtatttgtgaagcagggactccagggacttttctttttgggcctgtaaaattatttctttcactgctcctttaaaagaatagaagttttcatgattattagattttactgtaatgagcaagggaaagatttttaattattgctgaaaatttttgtcaatttatgtatatcacaaatttaaaaatgcatgatttctgagaatttttctgctctaatgtatatgtgtaaacttatgtgaatatttgtaagtatttacataaatcatttaaatttgttaatgggttctaaatataccactgatgtctctgttgaagtagactcgggttgcatatccattatatccttacttaccagccgggcatggtggctcacacatgtaatcccagcactttgagaggctgaagtggatcatgaggtcaggagtttgagaccagcctggccaacatggtgaaaccccgtctctactgaaaatacaaaaattagccaggcgtgatggtgcatgcctgtaatcccagctacttgggaggctgaggcaggagaattgcttaaacccacgaggtggaggctgcagtgagccgagatcatgccactgcactccagcctgggcgacagacagagcaagactctatcttggaaaattaaataaataaataaataaataaataaataatatccttacttatagtcttcatgaagttaatttgttattttggttctttggttttaaaaaaaattattaggtctgtatttacaaatacagacttaaaaatgtaccagctagaatctattaagaatccccaactttggaactaacatttttcttttttagtttaaatgaaaggcaatttgatggcttagttttttaaaatggggaaacaaaagggaggggaagccagtagtatcttgtcgtgttaagtatcagtttaaatcaaatgttaaacaggatcctgcattcttgtaaagtgaatttagtaatggaaactgccacagtggagggccagctctgtcataatcaccaacttgagcatctctgatatttagcagaaatataaatatctaatgcagcgtgtatgtgttatactgtcatggcaaaatgttgtaactgattttgagccagattcttccagtgttttgaagctactgcttggaaataagatttggaagctgaactaacttctacaatttggtaaactatagtaaagttaactcagcatatattataaatacaatagaaatatataattatatataaaaaagtttcatcaaatttcaaaggtttaagtactattttaggatattcatagaacccaatctaagaggaaaatgctcctcactgccagcaggagaacttaatggagcgcagcgttttagagcatagacgttaagagccagctgcctgggtgcatatcccacggctgccactgagtagctgtgtaacctcggtttgctacattttacagtgtactcctctgtaaaatggagataatatccatctccctgggttgttttgaagatctaacgagatactgtgtttcaagtgctctgttgttccattattgtttagttagcaattgttaagttttaggttatttcttcatgacatctgaattttttttaaaatttatttatttgtttattttccttgagatggagttttgctcttgttgcccaggctggagtgcaatggtgcaatctcggctcaccgcaacctctgcctcccaggttcaaacgattctccagcctcagcctcctgagtagctgggattacaggcatgcaccaccacgcctggctaattttgtatttttagtagagatagggtttctccaagttagtcaggctggtctcgaactcccgacctcaggtgatccgcccaccttggcctcccagagtgctgggattacgggcatgaaccacggccgacatctgaatttttatctcattaacaacatatatcctcaagtaatgttttagggtaagttacatctgggaagatttggtattcatagggcatggtagagttctagtggtatgttggctttttttttttttttttttttttttttgaggtggagtctcgctctgtcacccagactggagtacagtggcacaatctcggctcactgcaagctccgccttccgggttcacgtcattgtcctgcctcagcctccccagtagctgggactacaggcatccgccaccacgcccggctaattttttgtatttttagtagagacggggtttcaccgtgttagccaggatggtctcgatctcctgacctcatgatctgcccacctcagcctcccaaagtgctgggattagaggtgtgagcaccacgcctggcctgtgttggcattttaagaatccttggagattatctggtcaaactcagcctgatatgtaaactacctttctaatatcctgttgactaagcccccaacctttacttgaatttaaaacatccctgactcttgggaaattcttccttgtgttgtgctacagttcatctggctgtaacctcctctcccagcccttacttcttccttgtagagctacatagaatttttgtctaacaaataacccatctgaatggtgacagtgaagcaaatgaattctggacaatttaagtgttgtataaaagtggccggatggtgtgtgtcaaagttgagggagctcagaggactttgctccctgttggtaaaagaagcaaggctcagatttgtggttagagctatcctgatctagttgggaacacttttgcctcattgagcctatgatggggctgtgagccagacaggggataggcagtggctgggtctctgggccccccacttgcataaagcacccccatccattgctatacttgtcctttcctggaggaggagcttctttgtgccttaaaaattatctcaccgccaggcacagtgactcacacctgtaatcccagcactttgggaggctgaggcaggtggatcaccggaggtcaggagtttgagaccagcctggccaacatggcaaaaccctgactctactaaaaatgcaaaaaattagctgggtgtggtggcaggcgcctgtaatctcaactactagggaggctgaggcaggagaatggcttgaacccaggaggcggaggctgcagtgagccaagattgcgccattgcactgcagcctgggcaacagagcaagactctgtcttaaaaaccaaaccaaaccaaaacaaactccatctcacgtatttgttcattgtctatttctcctcctgcatagaatggaagctccatgaaagcagaggagaaactgcttatcttgttcgctgctgtttctcgagtagccacaagaacttggcactttaggtagtaggtgttcggtattcaaatgatggaattaaagatcaactctgaactctcaaaggcagatagattttcactttagtgcaggaaaataaacactcatatgtcatgcccattcttcaggcctgaaccaaaggggaacctgtcagaggataggaaatgagatctcagcagcgtctgttactatttgcaattttcaaatacataaagagaaaagtatcttttgtctttttgatatgtgaagattttctagaaaggagaggtttcaactcttattgaaggcgggagacaccatgctatcagaattggattttaaaatcagcccagctggatagtagcttcaaactgcagccagcatgatgtgttacatgagtttagctttgagtgttaaaagaacaagtttgccagaaacatgaattgttaaaaaaccatgaaaacattacaatgtaggaaaaaaatgtagtgaaaattccagtatataatgtccaaatagttcctttttctggaggctttaaacattttcttaggtaatttgcaaagaatattggacaatgtagaaaatatgtgtagagttaaaatgatattgagaattctgagcagatgattaaggaaatctggacctccttttttctttgtttctttctttctttaatatgttagtacttgagttttccatagaattaggacatatatttaggtcagatctcactgggatattccttgggatatcttgattcagggttttcttcctttttttttttttgagatgaagtctcactctgtcacccaggctggactgcagtagcaccatcttggctcactgaaacctccgcctcctgggctcaagcaattctcctgcctcaaggcctcccaagtagctggaattacaggtgtgtgccaccgcacccagccaattttttttttaatttttatttttagtagatgtggggtttcaccatattggccaggctggtcttgaacccctgatctcaaatgatccacctgtctcagcctcccaaagtgctgggattataggcgtaagccaccgtgcctggcctttttttttttttttttttttttttgagacagagctttgctctgtcgcccagggtggagtgcagtggtgtgatcttggctctctgcaacctccgcctcctgggttcaagtgattcttctgcctcagtctccctagtagctggtattacaggcgtgggttaccaggcctgtttttttttttttttttttttgagtcggagtctcctactgtcgcctgggctggagtgcaatggagtgatctcggctcactgcaacctccgcctcctgggttcaagcgattcttctgcctcagccttccaagtagctgggattacaggctcccgccaccaagactggttaattttttgtatttttagtagagacggggtttcgctatgttggccaggtcagtctcaaactcctgaccctgtgatccacctgccttggcctcccaaagtgctgggattataggccactgcacctggcttttttttttttttgagacagattcttgctctgtggcccagggtggagtgtagtggtgtgatctgggctcactgcaacctccacctcccgggttcaagtgattctcctgcatcagtctcctgagtagctggaattacaggcatgtaccatttttatatttttatataatttttgtatttttaatagagacagggtttcgccatgttggccaggctggtcttgaactcctggcctcatgtgatccgcctgcctcggcctcccaaagtgctgggattacaggtgtgagccaccatgcgtgaccccgattcagagttttctctgagaagaaactcccttcgattttggaacccaggaggctggactgccttctagtctaggttctaccttccccctgctgtctggtttggcttaatcacttgattcaataattttatgactttgagtgagttacttaatatcactctaccttagttctttcatctgtaaagtgcggccaataatagtgtatctcaaggttgttgtgaggaataaacatgttaatacatgtcaaatgcttagaagagacccttgcacaatagtaaacactccatagataataatgttattattagccaaatgtggttattttgagggtcatataatggggaaaaaatgcaaatttaaaattcctgtacaaattcaaaggaatatcgattgtctctgtatatcaaagatgaccttagtatttgcaaagctctctctcatttagggccactagctgtttttccatttacacttccctatacaggatatagagttaatttctaggaaattagccattaattattggttaatgatggactaggaatgctctcaggagagctgactagttagaacatgacataactttgaattatctaagctttacctttacgtggaattttaactttgttgaatttttaagtaaagggatataaaagccagtctgctctattattagattcactgtgttcataaggcaacatggaaaaaaatagataatacagaaagaaaaatgacaattttaaggagaaaagtttttgtttttaaataattttctatgttaattaaattccatggatgttttgttattactttgtctctacagagaatgcagcagattttgaacatgcttttttccctctgcttaaaatgtgttggctattatatttcacaggacttacgtcgttttcaaaaatagaggtaattaattgttacgtgttttgatgttcagcaggcaaaggaaacacattactttgtgtaaacagaggttaatatggagtctttgaagtctaaattattgaactatttgcctaaggacaaacttcttaactgtttaggtttcttctggcctgtaataaactacagtggtggaaataacacaaaaaatcctgtgtataaaacatttgggtcctggttgcgtgtttgacccaaatctgcaggtttacctttgagttacactgcgaattagggacctttcatttccattttcctttccttgtagtggtttagttggttcatggttgataaagacagaagcatatgtttctgggaatggtaaaccttaattttgcttaagttttaaatgatcacttatttctggaactggcactggggtcgaagaatgtttattattccatgttaacatgggaatgagtctaaagactaagtgacgtttatgctcacttctattttacagcttccttgggctctagccaaggtgacttggttttgcaagagcgaagaggacctgccttatagtgcagtttttttttttaaattgtttttgtctgaaatgatctaccttgaggacagaagctgtactttgcagagtaaaagacaaactattactggttttaacaaatgaacaacccaggcaggtgggcatggtgcaggttgtgccccagcttgtgaggtctagcagatcttgtggcctttggacaggcttgccttggggaggtggaaacacaatggtgatgatttctaacttgaagagacctttgggactccagtccagaagtttttacctgtgtgtactgggtgggaggcgtgttgtgcttcctgctatgggggtggtgagagccgtttcccacctaagtgggacagggagaaagcgtctgatcggcacacagggtgcagaagcagcactggcccaactccacactcacttttccaggatcattccttttgcaccaagctctgaccctgtgccctctcactgctctggggactgttgaagccacaaggaggaagttgctactccttatgcccttcattcttcctgtgccccagaccgagatctgtcaggggtggggtattggaccccacctgaaatcacttgtgtatctggcagctttcttgggagtttctcctcagggggcagactcccatataaagtactggctggtatgactgcagctcccgttgacccactcactgttcacagaagcctaggaacagactgtagaacccagagaaagctctgggtgacctctgttatttagcagctgcttgcagcaccagtcactgtggcaactgggctttgtttatgaaaatgaatgaggacctcaagcctggggcatccataccgtggacagagctccccctggaaatcgactgcctgccagattgccagggctaaaccaaaacaaagacataccaaacacaagtagccaggaagtattctgcccttggggacgagcaccaagtcccgattgcctgtatccctcttcaccaagcataaccctgccaggctgagctgatcttggttatgccagagaaagacagaggcaaagaacatggtactagtattggcagtttttggaacacagccttgtattgctcaggtctggcctctagttctggttttagatggaaagagtgttgagtaccaaagatctagctttttgaaaattttatttcaggccctgcctttatgtaaactgtaacgatcatttgggtctgtactcaagaggcaggagaatcacttgagcccgggagttctgggctgttgtagtgcactatgccaatcaggtgtctgcactaagttcagcgtcagtgtggtgacttccctggggactcccaggggactgccagattgcctaaggagagatgaactggccaggtcagaaatggagcaggtcgaaactcccatcctgatcagtagtgggattgtgcctatgaatagacactgtattccagcctgggcaatatagcaagatcctgtctctaaacaaaacaaaacaaaacaaaaaaaaaccccttgtctggaacaactgagtttggagtttgttgtccccttagagtccttgctttcatagtgattgttttcttgtgtccaaagcatccttggtagttttaactctccatgggaattggtgagccatggacatcatcttggagcacactttgaatctcagagcttcctttgaggggactgctatgttctgggtgcttctggtattcacaggttctatgattctatggctggacccttctagcatatgtgccctttggtgtcactttgtcagaaccacagccagtgcatgggtcttctgatgccatcctgtggctctcttccccacaccatgccttgtttttttttttttgtttgtttgtttttttgaagaccttcgagtctcgctctgttgctcaggctagagtgcagtggggcaatctcagctcactgcaacctctgcctcctgggttcaagtgattcttgtgcctcagccttatgagtagctgggattacaggtgcgtgccaccacacctggctaatatttgtatttttagaagagacggggtttcaccatgctctccaggctggtcttgaactcctgacctcaagtgatctgcccacctcaccctcccacagtgctgggattacaggtgtgagccatcgtgcccagccacactgtgccttgttactgcatgtctgcttgggtcatggcccaggtgtcatggtggagggggcggggttgggaggtagagagtgctggcattggtgatttgccagcaggacacatgcccaggaagatggtcagaaaaagagggactccttcacgtacgtataagtcagctttagccttaaagcttcaaacacccactcactgcattgaggagtccttgaggtccctcacctgctcttcctggtctgactagatgccagggaattgggagagagggacctgcagtgggagggtcctggaactgcagtgacagtaatacaggcttaaactagaattccttcctggaagaatttcggtcttcctctaccccagcagcctttcactccttaactttagtagtgtgccttggggcttgagcagctgctgcttctgtggaggtgaccatccagagggaccctttcacagctaagttcacttgcacctccgtttctgcttaaggcaactacagtttcgggggtggctgcccctgtttgctcatgataattccttatgaactctcctgttgataaactgaactggatcagctttagtttccctttaactaaggatttaagtcaaagcgtaaccacaagtgtcctgttcgttttcattcatttcagtgctgaacatttatacactgggctatggatttgatgtttccttcctgtcttggctgagatacctgtgtgaaatatgagtttgccatttggcaaactctttttcctttgactagttaatgaagccaaaatattgacgggggtgtggagttaggggaagaggaggtgtgcatggttacatttgaaagttcttcatggtgcaggagaatccagtgcttcaccctgagtaattgtaattagggtagtaagtaaaccctttcaggtttattctatagcgatcatgacgagttatcttggggaagggataaagaagactgtgagaggttgtacagttctgatcctgtcaggctttgagaagcagacctcagcgtgatctgaagagccggtaccctggagtagatgattaaccaagataatgttccggacagtctgcagctgaactgaactggtgtctctgcatccattcatagttacccagtgtggttaataacaagtccgttgggagttatgcctgtgctggccataactaccttgtattctggatgggggtcagagaaactgaatggatcgattcattcactgagtagtgagtgactgcagccttactgaagccagctcctttccagctctttgatgacatgcactattattgttgttaacaggttggctaaaaaagtaaacctgggagagttgaggctttgttcctctgtccagcactcagatatttcctgtagtcattcagtaaacatttaccaagtgcttactgtgtgccagggactgtgttatcataaccagtaactttttcttcgttaatgaattatctcatgcggcgtgcatacaaagaagccttaagaagtggaggataatgggggcctgtctctccctgctcatcctttggggctgtcacatcacggaaaggaagtaacagtcaacttaaatcagtttactttggtaatagcagtttttgaaaaggtttggagcaggaaattgaaactcttgagaaacaggaggtttggggattactgctggatttttcttattcctgctatcccaaggacttgatcccagttaccactgataatggaccccttttatgtttaactgtcttgtcagtaagtcagtgacacatgctgagaatagaaaccagtaccattccatgtcgtaaccgccagcctgtacacgccccgctggttctgttgttgtgatcgttgctacagcgcttaacatcaaatgccagcctcatgcctggcactttacatcacacctacggcgtccccaccccgggagcttaccttccctagaagtccaggacattttctatgttggcaccacaggaataggtagagggcaagggacagaaagttttcctcagtaaaatgtggtctttgcttgaatcaataaaggcaactatgttcatctgttttaataggaaaggcctgtaggtaattttttttctccgttaaaatctgcttttaaaaatgtttggggttgagtataacaacagattgataactctctgttcatcgcttttccgttcttgcaaaatatgtgacttgcagtggttgactaagtgctaggctctgacgggaggaaatgagacccgtggaactcctggccccctgctctgtaggtgcctccagaccagggaggggagacaggcatcaggtggcatggccaggccttttttttttttttaatagtggatgggagaaaatgggaatatgactaattttatttaatacttaggttgttttgtctgtttgctttactggcatagggtcatcttcagctgaagaaggatgtgctggtgcttaggaatggctgtcaggagccatcggtttgctccttcaaacaggaagggcaatgctggcttcagctaagagcgagagaggttctttccccagacacccagtatgtctctctttgcaatcattggctgaattgactcagcttttcctcccatccttgaatcagtccctggtagagtaatggagttacagtgattggcttaggacagtcagctggagaatcagtcacaccactcaccacagcggcctcctactaaatataaatgtgagcgggacttaaaatagaagaaatgcacatctaacaggaccataacttagggataaggtactggacaaggtaatgaagaggcgatcatggcccttgtttgtgtttcctccgttccctcggcagccttctaggggaccctctaatgtgctacctcactgtgtacctgtctctctatcctgactccacctgtcactctctctcgactctgggagtatagctgcttaaggccaaggcactctgtcttactatttgtggccactgtagctggcacatagcagggacttaatatgggtttcagcaaattgaacgaaaaaggatacttcgtattcctttgtgtttaacttttatcaaacattgcttgaatcaagtggatttttttttttttgagatggggtctcactctcacccaggctagagtgcaatggcactatctgggctcactgcaacctctgcctcctgggttcaagggattgttctgcctcagcctcccgaagagctgggactgcaggcacccaccaccacgcctggctaatttttgtatttctagtagagatggggtttcaccatgttggccaggctggtttcaaactcctgacctcaggtgatccacccgccttggcctcccaaagtgctaggattacaggcgtgagccactgaacctaaccacaagtggactattgatagtatattcattgcacattttataacaagtttattgagatataatacacataccatacaattcacctctttaaagtgtacaatcatttttaatatgttatcagagttgtgcagctgccaccacagtcaattttagaacattttaatcatcctccaaaaaacctctttatccattggcaatctctccctattcttccctttccccaggccctagtaactactaatctattttctgtttctatggatttgcctattctggacattctgtagaaatggagtcatgccatatgtggccttttgtgaccaatttctttcacttagcatgttttcaaggttcatccatgttgcagcatgtatttggtatttcattcctttttatggccaagtaatattttgttttatgtatataccacattaaaaaattcatcatcagttaatgaacgtttgcattgtttcctgtctggggatatgaggaataatgttgttatgggcattcatatacatgcaagtttttgtgtgggcttatgttttttcccttttttctgggaagtatggctttggccaaggccagagtcaagcacatccttatgtttttatttctcttgtatttatatgtgtctgagagtagaatcgctgggtcatatggttactctgtgtttaaccctttgaagaactgccaaactctttttcaaagtggttgcattattattgttattattttttgagacggagtcttgctctgtcacccaggcaggagtgcagtagtgcgatcttggctcactgcagcctccgcctcccatgttcaagcgattctcctacctcagcctcccaagtagctgggattacaggtgcctgccaccatgctcggctaatatttgtatttttagtagagatggggtttcatcatcttggccaggctggtctcgaactcgtgacctcgtgatccacctgcctcggcctctcaaagtgctgggattacaggtgtgagctactgcgcctggcctgttgtattattttatactcccagcaacaatatatgagggttctagtttctccacatgcttgcaaaccttattattatctgtcattttgaattagtcatcctagtgggtgtgtaatggtatctcaatggatgttcatcaatgaaaataaacatttgaatgggcacccatggcatgtcagatgctctttcttaggtgtgggggcaaagagatttgcagccttcggctgtctgtctctctggcctcatctgttttcacatctttcctcttgatttatgttccctaaataccaaactgtttgtagtcctcatactatcatgtcatttcttacttccagatctttgcctataatctaaatattaatgcagtgtgaatattaatgccattactagttaactcttaaacagccaataaattatagagctggcagtctggctccagagtctgtgttctgtactacatactctttttttcttttaaaatcaactttatatcgaagtataatttatatagattaaaatgtacactttatttatttatatatttatttttgagacagggtgttgctctgttacacaggctggagtgcagtggtacagtctcggctcactgcaccctcaacctcccaggctcaggtgatcctcctacctcagccttctgagtcactggtactacaggtgtgcaccactaaacttggctatttcttgtattttttgtagagacggggtcttgctatgttgcctaggctggtcccaaactcctgggtttaagcaaccctcccaccttggcctcccaaagttttgggattacaggcgtgagccactgcacccagcaaattgcacacatttaaaggtacattttgatgagtattaatgaatacatatgcctgtgcaatcaccactgcaatcaagatacagagaatttttctattatccatctccacccctttcattctcttcagcctccctgtagtccatatccccagtcccaggcaattactaatctgctttctgttgctatagattagttttgcctgttctagaagttcatgtgctcttttgtgtctgacttctatttgctcagcaaaatgtttttgagaatcaacagccaagttgttgcatgtattagtaatttgttcctttttgatgttgaatgttttccgcggtatggatataccccaatttgtttattcattcacctgctgatggatgtttaggttgtttccttttagtattatgcagttaagtagctatgaacctctataaacatgtctttttctggacatatgtcctcagttttcttgagtaaatacctaggactgtaattgctgagttgtatgtaactttataagaacttgccacgcagttcttcaaagtatgtgtacctatgttggttttaatacagattcatcatttcctatccatgttgcttgggtagattatattaattcttaagaatcacctcagatatcacctgccctaggaagcctttttttgacccttctcatcttccccttctttgaggtgaattagggaggctccccctccaggctcccttaacaccttgatgattgagtgttcactggcctatctttcccattagactgtgagctccttgaagaaggaaaatgcgttattatttctgtatccccaggaccttatatagtatttaccatctagataggtgctcaataaggcttgtgaatgggcgactaaataggacattattcatctttatttttattttatttttgagacagggtctatctagttctgtcacccaggctggagtgcagtggtgtgatcttggctcgctgcaacctctggctcctgggctcaagcagtcctcccacctcagcctcccaagtagctaggactacaagcacgtgccaccacgctggccaatttttgtatttttgtgtagagatggggttttgccatgttcccaggctggtctcgaactcctagactcaagtgattcccttgctttggtctctcaaagtgctaggattacaggcgtgtaccaccatacccggcccttattcagctttgtaagggggtttatggccctgtaagggagataaaataggcatgcaaataactaatgtgaagcagaaattaatagagttgaagaacaaagtctgtgagaagtgaaagagagtgatagcttttagtgaggaggatttgggaaggctaataaaggagatggggtttcaactgagcccccaaaatagattagatgtgctgagatattattacccgttgattctaaagggatttgacttgatcttctgttctaaaagattggtgaggctggaaaatgaagtttatgtttgggaaggtcacactaagattcatcttttttttttttttttttttttttttttttaatgctttgctcttctcagcctacagcgggcactaggagatactggaaatgttttctgtttggcagtagaagaatataaatgtggcggtttgtctatcatctctccagattctaaaggcttctaggtgggattgaaaagacttctcttatcctctttgcctcttaccccatatggtaataggtcacataagtcacactattgccaaagctctgcttagccatttgtctggtctctttggtctcagccacctggcttcactatttagcacatatttgtccattgtcttctatagcacatgttcatagactattagagctgggaactttcaaaataatcaaatgataggccctccctttacagaggagaattgatactgaaatctagagactaacctggttaataatagtaaagataaaagctgccatttattgaccatttaatatgtatcgtatatttgcatgcattatgtaatcctcacaaagtgtagatgtcttcattttacaaatgagaaaactaaggcaaagtttcagatggtatagacagaaccaggattcaaagccaggtcttttctctacagcatcctacccaggcaaggccccaggtccgtagagttgctgaccacagaggaggaggaagttgggccacagctctcaggtctatgagagggcgttgtcactgaagtggaggaaaccaggattctctgcttcctagagagacactgagattgttcctttaaaccacatatgatttttaaaataagatatgtagagcagaaaccaatcaactagcattggctttggtcagaattatttttatgataaagtagagcatatttttaaatttttaattatctaagtaatattcaaaaacacatttgcacagtaaaagcattaagaatgtattaggttggtgcaaaagtaattgtgttttttgccattacttttttttttttttttttttttttgagacagtcttatctctgtcacccagtctggagtgcagtggcatgatctcggctcactccaacttctgtctcccaggttcaagtgattctcatgcctcagcctcccaagtagctgggattataggcgtgtgccaccatacctggctaatgtttgtatttttagtagaggcagggtttcaccatgttggccaggttgctctcgaacccctgaccttgggtgatctgcctgcctcagtctcccaagtgctgggattacagtcatgagccactgtgcccggccattactattacttttaatggaaaaaactgcaattacttttgtgtcaacctcatagaaggatggagagcaaagtcagagttcctctcgtgtctccaacccgtctctagcatcacccctaccttaggtaagaaccatttatagttagagttatccatttaatcctttttctatgcatgtatgtgcatgcatatggacaaatacacatagttttagaaggttaataaattgtatcattctttacatacaaaaagaacatgtcataagatatttctgtctgtacaaataacagtgttttaaatgcagcatatgtatttcatgatatagatacaccctttttgatgaacatttaggttattattattttagacggagtctcgctgtgtcacccaggctggagtgcagtggtgcaatctctgctcactgcaagctccgcctcctgggttcacgccattctcctgcctcagcctcccgagtagctgggactacaggtgcccgccaccccgcccagctaatttttttgtatttttttagtacagacggggtttcaacgtgttagccaggatggtctcgatctcctgacctcatgatccgcccgcctcggcctcccaaagtgctgggattacaggtgtgagccaccgtgcccggctggttattttaaagtatttgtttattataaatactgtggcagttaacatctatgcctgtaatactttatagtaccataacagtgatgttgttatggtgtagtacagtaggtgtatttacattgatatcagttacagcctggtgtaattacagttatgatgtaatgcctttagagagaggttggacagttcagttgctgtcccaaacctggctgagaagattacaaaagatttaaaatatttctactggtctttattattgaatgactacaccctctgaaaagtatgaattgagcattatgattgctcataggtaaaaggttagcaggcatttaatatgtgctaggtattttcttgtgtattctctcatttgagtcttataataatctcataaagaatgtgctgctattcactgtttatctggaactaagactgagaaagactgtggcttgcataaagtgacacagcttctaagaagccagttcaagatttgaaccctcatctgatgatcagtttgttttttctttccccattttctgaagctggttcattctcttaagaactgtaaggagaaaaatgatagaaggcagaatatctttgaactaatgaaatcatcgcatgagcagagaagcagagtgggcatcctgtggatttaggggagggagggggtggtaaagcctctgaacctgtcactggacttggaggtgtgattcatgacttcaggatagtggctatgctgagagaccttggtgtctgacagcaacgtcctgctattgtaagctatggatttactgtcatgctaagaaataaatcatgaccaggaaaggctgtatgtttaggtgctgctgatgcctgtaggccctctccaaacaggagaatggctctcagtggatgaattgtctcagcttcctctgagttgtaatttctatgtgggtcaaagggttatttttagcctgtgggatccctagctctttgaggagtggcctcgcttacaaggtcagtggagtgggatgatggtcgggattttttttttttcccagacggagtcttgctctgtcacccaggctggaatacagtggcgcgatctcagctcactgcaacccctgcctctcgagttcaagtgattctcctgcctcagcctcctaggtagctgggattacaggcgcatgccaccatgcctgggtaatttttgtattcttagtagagacacggtttcaccatgttggccaggctggtcttgaactcttaacctcatgatccacctgcctcggcctcccaaagtgttgggattacaggcatgaaccaccacacctggcgatgatcaggatttaaggattgtttctgagctcttcctggaccctgtgttttaggtcccccaaagaaggtgtgaacagccttttggaatctgttttactctggcaaaataatctgtgtccatagattgcaggaggatgctgttggtgttataataatgctctcacatttaaaaataagttatcaagtgtatttgaggaagaaaactaagaaaatctggaaaaaaccccaccatcaacaaaagacatgcaaaactctaaaacttgtaataggataaatgatgttcttgtaatgaatgtgtcagcattttaacacatgtgtgctcagtgtgtggtgatgcaggatgtgtataacagaaagcacaaacgtggtctgtgtttacattaaatctcccacctccaagacacacacacaaaaggtcccacttgagtatgtgtaattacatctctgaatactcccttgatcctatttttttccttttccctaaacacatattttggttacttctccaaagatacatgatatatattagcctcactcagaaccacagggaacatactcaattgaatcacacctctatgagtagtgtataaagtgtaacattttaaaacaccagggaccagggctggcaaggtccacggggaatcctgaaggctggtttccagccacaactgtgctggaatgaaaatagaaaacaatgaggcatgtgcagagtcagcttttctttgtgtcacagctcagcagtttttctgctgtcctaaactttcctaaaaaaaaaaaaaaaaaaaaaaaaaaaaaaaaaaaaaaaaaaaggctggggctaaggggaaatggtgcagttgcagttgaaatttttttttaatagtaaagactgaaaatataaactaacagctggtgctgtaggaacatgtgaaatgaagagtgaattaatggtgagaaatctcactgctctttgcttggctgtgaggacacgcgtaggaaggacttgtggaaacttgtttggtaaaatagaaaaaaaaggaaaagaaaaagctaagtaaccatcaagcctttttcaggagtgggggaaaaataaaaatttatatactctaaacttaaagctttatttatgatcattattttaaatatctgtaaatgcatctgtaaaaaactccagccaagacagagggagatgtgaattatcaagtatattgactttttttttttttttctgttatcagtagcatccttcagaaagtactgattaaaaaggaaggccattcccagttcttggtttatttgcctcatagcgcaccaagtcaaggttgagctggggccttattccagaaagcacaggcttcctttctgattggaaataatatgtattttgtttgaccttcagaatactcatggctttactggaatacatgggccaacatttgtcctggcaaggccagggcagtttaagataggtatccacagggattgctttatagagcaattaaaagcagtgggagggaggtgactgcagaaattcagacgtttgcatcctttctggcctaaaaatcaagtgagtaatttcaaaaagcagaatttgaaaacaaacaaacaagcacttctagaagtttctgtctgaacacttgagaattttgccaaggtcatagtgttctttattttttctttttccttacatgttactttctgaaatatgatcatagtgttcttttgcaactgatcttggtgtgaagagggggttacatcttatatattacacagtgctaatatgtgtaatattaacatttttttgaaagattgtcaaatatggaccgtggaaaacagtttccatgccgtttgaacgttatgttctttatgatgctttgtttataaaaatattgttagatagccagggatgtttactactgccagctggagttaggcctcatggtagctttttaaagtcaggctggaggtgaattcaaagcctaacacagagtttcaagttattgttcttatttgaagtaaatgcataattggagactgtattctgatttcttgaattcttagctatgccagtaattcttgtttcttagggccacagtttggttctgtcaaatgtgtagttgtagagatgataaatgagtactcagagattagatgaattcatatatggtgacattaagatgttttctttaataagaatacctattatatgggagtaagtgaaaataatcatgtcttaatgttgttgaaatcctgtattcatttgggggaaaaaaagtaagtactttgtattctgcttatgtaaagggatatgaaagaatgtatataactaaatttcttaatgcttcattttgcttttgatgtgcaaaatataactttactgctaggtaaaattatacttgaatattaacagttattgcatgagtttaaagtttcagttgagcccaatatatgggaaccacgcagtttctagtgattttcaaaatatagtcccataaagatgaaagagactcaatagctgaaataggtggtacacttgatttaagtgaacatttgctaacccaggaagaatcaggagccattccaacactgtagctgtgtaccatagatacaaaataatatgttatccaacttagtatgtatttgcttactgcagttgagaacgcaggagtggtcagtgaagtgtagggattagggaaaataattgagaaaaatgaggagaaagaaagaaaaatagatgttttggtaatctttgtcaaatgttttctcaaagaccaggctcagatttaaaatattatgcagatgtagtctttggcctctggtagtttctgataggaattcagccttgagttgaactttgagatgggttgttttcttttcgtttttttcttttttaattactaagtgaccaatctgttgtagtttgttgatctattttttcctcttgccatccttctgttgctttctccatgagctgctgtttattctggaatgttgaacatccacatttagaattaggatttgtgtggctctatcttaaccaggaatggaaaaaatccaacccagtctttcaattcatgggtttaagtggattcagagaggttctcatccacagtgacaggttcagaattcccacttctaaagcccccgtttcattaggtaatgaatatacaagctgagcccttccaggttcacactgtggaggcttctccactcctctgtcttggttggctttcttccttggggtgtttgggaagagtctgattacagccaacttctttccttgtcagttgattttataacacaaaccattaaagttcaaactttttgttcagcagattgatttcatttgtctcttctatagggatctcacttagagtttatagaattctttgctatcctttactttaattcattttggcaaggtatgtagtattaactccaggtgaggcaaccaagagaggggccctaagtcaaggaacttgttaatggcagagatgagcctggaacccaggccttctaggtccaaatgtagtgttctttcctctgtgctcccaaggttcccattgtatcctgtgggcttcttttttgtaacgtaaagtgggtagtgaggagaaaggaggttcttttctgttgatctttcatatacttattgatgttatctttatatttttatagaacttcctgatttaattaaacacttctcaaatgccatgatctcatttgttttcatgatgaccctgaggattagctaggacaggactatccctattttattttattttattttattttattttattttatttttagatggagtcttgctctgtcacccaggctggagtgcagtggtgcgatcccagctcactgcaacctccgcctcccgggtccaagtgattctcctacctcagcctcccaagtagccgggattacaggcccccacaaccatgctcggctaatttttgtatttttagtagagttggggttccaccatgttggccaggctagtcttgaactcctggcctcaagtgatccacctgccttggcctcccaaagtgttgggattacaggcgtgagccactgtgcctggcctcaaaaatgcctgcttttataaattgctcacagtatagtagagatttttacagtttggagggtgttggaggttaattttgttgaaggaagtaatttctctaatgtggaggaggtggtaatttagaagactatgttgtagaactgcagccgggtatatgtttacttttgtgagcgcctgttttatttgcccgtttatttatacctatgcattttgatagaaaaataaatatagttctgttttggctccctgaaatagtttttatattttctggaatttcctcacttattgtctttaatattcctaagttttattatgactcattttggtcatacaatagtagaagaagtaggtgtcggcctgtttgaaggggtttattaagtaatttggggaagtatatttttgaagcctataaatattaatttgtccctggtgttgagatttgtcttgtggttgtcagttgtgcatgttcttatatgttttggataggggagagtaaaaaggggttgagcatagtttatttttttctttggctcaaatatgtagttttaccataaaccacggaaagtttcctgttcttgtttgattaaaaaaaagtacacttccattcattgtttccatgtaacttcctatactttttactaaaaaaggttgaaatctaggataaattatgagctatctctcgggcaaagaaacgatttcatttcaggaaggagcttaggaagcgaaccttcttgagtatgagaaacagtaatagcccttggcatgtatgtgtgtgtgtgtatatatacatacatatacatatacatatgcctttccttacataataatgatttgcaaagagtgaatttggaccccgacttctaatcaacatggaaaggcagggaagattccatgtcatggctggattttagaaagctgcaaatggtattgtaccatagagcaggggtccccacccccaggccacggacctgttaggaactggggcacacagcaggaggtgagcagcgggtgagtgagcattactgcctaagctccacctcgtgtgagatcagcagtggcattagatttttataggagtgtgaaccctgttgtgaactgcgcatatgaaggatctaggttgcctgctccttatgagaatctcacgaatgcctgatgacctgaggtggaacagttccatcccaaaaccatcctctcctcctcggtctgtggaaaaactgtcttccatgaaaccagtccctggtgccaaaaaggttggggactgctgccatagaggggcctttgggtggccccgttaggtgttttctttgtgaggtggtgctttccagcctgccctggactctgtggttcatggtagatcattcgtactgacctggaccagggagcactggtaggagtatctgatttctatgaacagtgcttgctggcactgactcaagaaagaagacaggaaggaatggtgaatacaacttccattgagaaactagagtggaaaaaatgtgcaaattatgctaaaattgtaattaatctgggctgtacaggttgaatatctcttcatcctgaaagaaaaggggaggtcaccatgagaaaatgggattgagggaccataagaactttgtcatacctagttatacatttgtttttttctcttagaacttctgaaaagcttgaagccccagaagcaatagaatagagcttttagcatggttttgttgtgaactaaattcccaacagttcacctttagtgcataagcttaactttctttgatggtttgccattcaaattagattactgtggacagtgtccctaatattgtcactaatattatgatacagtatcagttttacagcaggtttgtgcatcatgaaggaagtcagaacgttttagtgagttacaaggaaaatagccatcaaaagtccatataggttactctgtggatgggttggggagccatcttctggtcttcatccagacttgattgacttaaaattgagtatataagagtgtaaaagatggtaagtgataggcttgaggcagagacacaggcctgcagccagaactggaaaaaaacccacaagtatgaaaagtataggcaaaactataaagcagccaggcacggtagctcacacctgtaatcccagaactttgggaagcagagatggacaaatcacctgaggtcaggagtttgagaccagcctggccaacatggtgaaaccccatctctactaaaactacaaaaattagctgggcatggtggtgagtacctgtaatcccagctactcaggaggctgaggtagggagaattgcttgaacccgggaggcggaggttgcagtgagctgggacggtgccattgcactccagcctgggcgactgagcgagactccacctcaaaaacgaaaccgaaaaaactataaagcacagaaatatgggaccatttggtagatatagtaactgaaatcacatcaagttttaataaactaattagtattcataatggcagccctacatcttcaagaaaaatatacaataagcgagtttcaggatgctcaaaatatttaagatggccaagaagaaattatgcatgtagtacattttaggcagattttccttaaaactgactaaagacacttacttttttgaaacaagaaaagacttagttatttggataatttgcttatgtggaatatctcattgccagtcaatgttgaataagtgaggcatttattgtgtggcggaaaggtggttctttgggccagatgaagtaaggtgggaagaaaggaatatgaaatactgagagaaggaattactactttaaataatagatgtagctttggtatgtttttctgtgcaaatcttgagacaaagccctttttgttggaggaaatggcatgcaagggattttattttcagtttgaccatttgcaagtattagagctgtctccatgggagaaaggtgagttccctctggcagtgtggtttacgaaggtttgcttgggaggaaaagagaggagctagttgatccagagtggaaaaacaccaaagcaaagttttctccaaaataacacacacggatttctgaaaaacagcagttactttcactgaatgtgacaaacttcaaaaaaaaaaaaaaagggaaatcagctttgaaacatcatatgacacatctgttttggaaggttgctttgtcagatacagatgtatgttttacagtatgttactatgtaaagtttcgtcttgagcaagctcaatagatgtttttctgaacaggtatctcatttatcccagttttaaatttttgggggagagtttattaaacaataatagtacagtactttatcttatttttaggttaaatacaatttgattgaattatacccttctctcttagccttttattgaactgatatctctgcttagattttatcctttcagaaattgcttattgacccgacacagcaaaatccaaactttttgatatatgtcatggcatatatcatgccaagatcacaaactccatcacatgcttttagcaaataaatgccagtttgcttcttgctttcatacctacaataatgcaaattattggtttaaaaagttaaaaatcactgattcttgctttattacaggcctcttaaattgagaccttggaaaagtattttcttgcaagagctgatgtttcctattattattattattaatttattttttaagacaaggtctcactgtgtcacccagactggagtgcagtggcactatcttggctcattgcagtcttgacctccctgggctcaagggattctcccacctcagcctcctgagtagatgggactacaggtgtgcaccaccatgcctggctaattttttaatcttttgtagagatgaggtctcactctcttgcccaggctggtctcaaacttatgggctcaaacaatcctcccaccctggcctcccaaagtgctgggattacaggtgtgagccactgcacctgcctgtgatttgtttcctttttatgatatctatgtgagcatcatattttcttttcatcctgcctgctagaaagcgcagagctaggtttggcactcaaatgatgtagtttcctttagctaagtgctttgatgaagtttctcttttgcatttttttttccagaacacatctcatagttgaagagatggtaataattacagtaatacaataataaaaatgagttgatcctaagaacagtcttatggggcagatcctgttattatccccattgtatagataaagaaacagaggcagggaatggctaagtagctgccccaggttaaaaggctaaaatgtggcagcgctgggattaaacgtaggagactggctccatagtccttagagaattagcagcttgggagtttggttgtttggcacatgaattcatcactcaacaaatgtttatgaacacgtgccgcatgccaggcactgtgtcaagcactgggagagaggaagtaaaagaaacacagtccttgccctcatggagtttctggtaagtagaggacacacaaacatatgcccaaataaatgaagcaatagatttataaaagcttatatttgctataaaggagtaacaggtgtaacagtttaagggacctctgaattttatcaggtgcaatacaaaagtgtagttctgggccaggcacggtggctcatgcctgtaatctcagcactttgggaggccaaggcaggtggattgcttgagctcatgagtttgagaccagcctgggcaacatgacaaaaccccgtctctacaaaaaatataagacatgagctggtgtggtggcacacacctgtagtctcagctattcgggaggccgaggtgggaggatggcttgagcctggaaggtagaggttgcagtgagcccagatcgcaccatggtactccagcctgggcaacaaagccagaccttgtccccgtccacttacccccaaaaaactgtggttctgaaccacagcaactgagccgagcacaatccttctgtctctctaagacccagtctacactgagtagttctgttgatggcactgcttgatgggcctgtaactgccacaagctctggaaaaaccaggtccacagcttctcagagccttttagcttcactgtgaaaggagcaagagcacaccagtgaccaggtgttcataatttctctgcaaatgtcagctctcagtttccctcctaacagaagcacctgaagcagcaggctagctagcctgaagaggaaggaatagagtttagtcttataattgggacctatatattaagctgaataatttggcattcagtgttaagcatttgactcattcctgtaaccaattgtgagtgccctgattatgtataaactccttaaagtaaatgtgttttagttcgtggcccagtgtgtacacatggctgtaattaacaatattttgcacagccaaaccaaaagtttgcagattttccttttttaatccatggtctcctatctgcaatcaggaccagtggttataggcgatgattcaactccccagcagttgtggtttcccccttctgcccttcctgaccctcttacagtttctcatcttgccacttgtctctgcttcagactctgcaccccagaccctggccaccagccctaacagaatgctcaccaggcccagagcatgccacatgcaatgcatgttattcctccgtgcttttgcacacattcttacctctctttctcccatctttttctttcttgctagacaccagtttgcaaatgataaaaaagagaaaattagtgatcatcttaggtacaaatcaaggtctgagagatgaacagatttggtaatgtcatccctcagggttaatgaggtgtagctttgtagctctgcaagtcttactttgccatcagatattgcattagtaggaattaagttgtaatttttttatgggataaagttcagtttaatattttgaatctaagtcgataaagcatttgcattttaataaagaagtgtactatccttcagttattttgtatctgccaaattcatagggtaggagaaaaaagatcttattttctcccatccttcaaaccttcagatttgttcttggtctctgttctgagccaattaggcagtaacatcccataaattcttatcccctccaaaatgaatgctgtagccagtgtctccttctgtttaagcttccttcttgtgagaagaatagggacaggtgcaccatattattggtcaaaagtaaatcagtgctcggtgtggtgactcacttccagtactctgggaggctgaggcagaggcaggtggatcacctgaggccaagggtttgagaccagcctggccaacatggtgaaaccccatctctactaaaaatacaaaaattagccgggtgtggtggtgcatgcctgtaattccagctacttgggaggctgagggaggagaatcactcgaacccaggaggcggaatttgcagtgagttgagattgcgccactgtgctccagcctgggcgacagagtgagactgtgtctccaaaaacaaaacaaaacaaaataccaaacaaagtaaatcagaagaactgttggccaagatgatgccaactgattgtctttatggattgatggaattccctggaggcagaaacatggcctgttctcgcctttgggagttgtacttccagaatgtgctcagagaacaggaatttttactctaatactgtgcatagtttaatttaattaaaaaaatttttttaaagagatgggggtctggttattttgcccaggctggtcttgaagtcctggcctcaagcactcctgctttggcctcccatagtgctgggattacaggcatgattacagggagtacatgcccagctgtagttttattttaagtctttccagtgcaattcatagaaataatttctggggagtaatgctagggagtagtataagaacatcttatcttagatattttattaatcattctaaaagtttttagagaaaacagtttttgattggagaaaatgttctcattcatttatttctcttcccctcaagggactttatgtctctaatagtatttgaagtttgtaaagcgttttcacatatagtgcatcatttgatctataagtcaagcctgtcatagaataagagatcatggaatgcttaaaacccagctcctgtatctcctggttcactatttcccggtgcttctgtaatacaaggacacctcttgctatgtccagtggtgacttctgagacatgccactgcttcacttcaggtcataaaaaccatgaaacataacagcaccacttcctcagagggctgcagaaatccccctctgttggcacgtccagattgtatagtggtatcttgtttagatggaagagtatgtgccttttatagcttggcacttcccaacactttgagaatttggattcctaaagaacctgtgccctttgtttccttttgaacatttgaaaacacaattgaatacaggaaattctccaacatggttgctccatgatttcaacacaacaatacacaaatatgcactggcttttggcccaaaaagttggtggttgacttcttggaagagggttagtttgttaggaggaaggtttggatgtagattttgcttggagggtgaaagaaaccatgataagatatgcctaagagttgtgctgtagaaaaatctagtttttttccccctgagaaatccaaattacaagttttaggacttgtctacctttttcctactagggataagcttcagcctgaagccaggttttattgttgaaaaacccaggtaggagctgtggtagaagcgccctctttggagtttaatggtggtacattccaccgctccatccccaaggcgctgtagttccaatgaattgtaatttgagatggtacaaacatgagcatatgttatgtacacgtcaggcgtgtttgtgagctcagggcattccaggtgtttttttcttggagctttgtttttgcgtcatatcctgtgttggtaacattccttctcatgaagctcgattgaagtgaggcagtgctattggctgagaaatcatcctgggtgccctttcttacagattcttgcatcccatgggggtagaaaggattttcagcccaagggcagaatagatcctgtagtacccagtcccacaatctgtgggagtttgtccctctttgcagctgacagcatttcagaattccctgtgggacaataacaaaaaccttattagccaatggtgtcattagaataaaatctccccactgcgatgtcttggtcccagcctataatgttaccccttaattccctctgcatctttaccacttttattacagctgaacacacgctcctcattagaaccctgggtgatatggggaatcagagtgctgaaaattatgtggaataggtaccagatgtttgtgtcaacttggtatgcattggtatttagaatgcttgaggatcacatttattaaatgtgaaaattacttactatgtcttctccaaaacattaccccccccgccagtatttttgtccatgttgcatgaggtgtgatattagtaatttcttttggcactgattaaatttaaagtctgtgcagcaaatgcatctgttcccaaatgctttgtctgcgttctgtcgagttttggagctggcccaccgccagcagggatgtgggggttctgtaactgagattggaatgctgtgttgcagctaaaggacataatgaaagggtgagtccatttgatttttttctttaagtggaactgggaatttagacattgatgttatagcgagatcttaggaacgtttcccatgtgtccagataagcaagcattagtgaaaaggatggaggagggcatttggtaaaatgagaaacgagtttcattaagttcatgaagtcttttaagtcaaccaaaggtgatacgtgtgaaccgagcagtttattttattttagtagatatgaatgaatgtttacatttggcctatgcatctgttcacccagtcctgaggcgaggaactggaaagtacaaggcagaggcaggtggtgctctgccaggggaaaagtctggagctggagtctcagagacccaggttcaaatcccctattgccacttcctgctgatgtgtttcttagcctctcatgagctccagtttcccatcactctaaaatgagggcattaacactgtcttcacagtggtattgtgagaatcagaaacatgtacaagatgtgtggcccctagtggtgtggtaaccatacatatgaagagttaacccccagcttctcacacaaggcagcggcccagggagccaccatgtgcttcacagtgtggcctcaggtggcccagctgctgagcacccgagcggtgggggcctgctttgtgaaggaggctggtttggcagtggccttggcagtgtggccgtggtctgggccacctggggagtttctcaccagagtttatttgaatttgtgctgtcttcaggtcagtaaatatttttgtcagtagaagtagcatcttgtgggtgaagggggctgtgcctctgtgctggtggccgaggagagtgtaccaaacagaagagcagagcctgacttcagttcaaacaagacacgacacccggcaagattttgagatcagatttctcgagtaagccagcaggggaggattaaactcagctcacactttgagtccaaggaaaagttagatttctttgggagctacccttaaggaatcttgtactcgtcacataccagatgcccagaatgaactgaaatatccagattgggaggcaccagtgaggattgtctctggaggtgaatccatatggacattactgccaggaagcacttttctgaaatacacattctacctctgtgtggctcacaacagtttacttatagtgggttatagagtttctgtgaggctttggatgaagtatctgcaacatgccttttcatgatagagtatggtgtgaagtgagcacgcgtgtgtgcttatgagcattgttgctttcaggtgtgttctttcgtcatcgtccacgccctggttgatccttacgtggtaacacagcttttgctgtgctgctgataaggagcatcatcagagcatgtcactcacttggctcttgactgcagggaagagattgcgtagggaagacgggatgtgggttttcagccgtggccacaggagacactcccagccttttgaggctgccggtgagggcctacagtagcagctccagagctcacaggtcaccacaaaagtgagcagatgagtcagatggggtttcggagcatgttttcctggtttccaagccttcgtggctgggaggtgctatactcgggccccatggtggtcaagtgagaatctgagccactgtgttaactcaggcacttgtgctagagcctgtggggtggatcatgctgttcccaggtggaagccttcctgaatggagctggccctggcattgtgcagacagattgcggaaggaaccactatgaggccaagggggaaggatgggagacaggttcatgagctggctgtggcagagggaaagggacaggaaggctagggcctgacccagaagtggcaggatgaggctggggctgtggtgtgccaacggagagatagaggattgtcctgccacctggagagaggggattggccagaagagtgtccgggaagagaagacaaaaacagatttgtgtttcctgctttctgtgacagttgaaggtggggaagccccaactgggacttgattcttagcaaccaaaaatgccacctccttcatttcatggttggtgttttttttttctgccccttttagtataagagtgaggctttggctctcaggtaaagagtgaaagcaggaagtctgagacagacagtcccttattggcacaaagcccatgcagcatgcatcaccccatggttcttccccatttctcagcgataattgagtgtctgttttgtgccagatactgtgctggggtgaggcaggcagcagcagacagagtggttgggttctgttctttcgtggtgtttgcagtctttgggagcatgtagatgtgaaaccaataattgcacaaataattatgtacatctcatcacaggaagtgctgtggagagaaacggagagtaccatgagagtatgaaaaaatacagatctaacacagtgagggaggtttggggagcttccttgagagatcagtagaatgagcaggagtttgtcaggccatggtggtgggaaggaacagaaacggtggggaatgtgttcctggaggaaaccttgctattcagaggctcctttgggacaaaggttggcacttctgatgaaataaaagaaggcaagtacattaattagggtaggttaagctacaaatgtcagaaaacccaaaataacattggcttatataaaaaaaagagtttacatttgtttcctattaaaaaaaaaaaagcagttcagagctgatcccgtggctccatgttcatcaagtacccaggtggcttctcagttgctgtgccctcctcagcatgctgcttctgtctcatggccccaaaggcttgctctagtgctgcctgttacatccacattccaaccagcagtcagaaggaaatggcagaagaactgacctccttcccttcatacaggaagctgccagctgctagcgggattgggaaacatagctttcgttctgggtggctgtgtgtccagctggcacttgaagaaaggagaatgatggctatagggagacagtgagcacttctgtgcttcaccagaatggccaaaacacgggagcaagtgtccgaggaatgagagacggggccgtggcaggaagcagggccagatcttggagggccttgtaagtcacgttgaggttttggggcttcatctggacagcagagatggagtgataagtcttttaaagcagagaaaagcaggatcagacttgggtttttcagatcagtttggctgctctatagaagacattttggtggagataagaattaagagcatcttgcagtaatcagggaacgagagacgatggtgcccatggagatggagaggaggggtcagagttgagtggccagagagagaatccattgggtgaggagagggaaggggtgatgttggggcacctcccccaggttggtgccaggtgtacgtaggaagaggctggtgccatttacttagggagggaatgaaggaggaacaacaggcacgaggggtaaagatcctgagttctgcatgttgagattgggtgtccatgagacaaaagtagatggtgaaggagctgttgaatattcaggcctggagcttagaaaaagaagtatgggccaggcatggtggctcacgcctgtaatcccagcacttcaggaggccaacgcaggtggatcacatgaggccaggagttcgagaccagcctggccaatatgatgaaaccccatctctattgaaaatacaaaaattagctgggtgtgatggcgggcgcctgtaatcctagctacctgggaggctgaggcacgagaatcgcttgaacctggggagtggaggctgcagtgagctgagagcgcgtcactgccctctcgcctggacgacagagcgagactgtctcaaaaaaaaaaagaaaaagaaaaaaaaggagaaataagtaagtctgagatggcctggagtcatttctgtaaagagatgagagttgaacccatggatgtgtttgagaaaatctatggaaaaaggatagtgcactccaggaaggcctggcaggcattttacctggaaggcggcgatggaacagctggtggcagaagagcgtctctccaagatattcaaaggaaaacttcatacaatcacactgcctctttcctttcttggccagagaggcttgttttttacccaaaggaaaccctctcccctgattcctacactgtgtctgttctcttaggagaggactactctaccccatacttagagtttaacctacgtcctttagcctgggtgttttcacagggactttttgtcccctcccttaagtcttaatttttttcacttgtacattctgtaccccttgcaaacttatccagttatgtttttcaggataaaattcctagcgggaagttgctgggtcaaaggatgtgtaccttttgtggggccttggataccactgaaaaattataccaatttgctctctcagcagcagtgtgatgctggcacactttttgaggaaggtttcttaaggcatttctgggcttaattttttttataagcattgcctccctctcccaacttttctttaatgaaaagtttcaacatgtagagatgttgaaaccattgtacagggaacatttagattccacaattagcattttgcaatagttgctttatcaaatatctctccatctgtcaatccatcttattttttgggaggtatttcaaagtaagttacaaaacggtagatctcacccctaaatctatgaccacttttttattttcacagaaagtgttggcacagtagcccaggcattgggctggatgttcaccgtacaatgcttggtcaccctttccctctcctcacccagtggattctctccctggccacttaactctgtccccttctctccatctccacgggcaccatcatctctcttgccctgattactgcaaggccgggcacttcaggaccctgcctcctgagagagagagccgcaaggagggccaagtctgaagctttgggtgactggggcaaccttgaaacagttacttaagcacattgagcttactttgctttctttaaaatggggttagtgctgcttccttgcaatgtgtcagaaggatatgcagcacctagcattgcatagtgggcacttaataaatgggagcagtctctctctctctctctttttttttttttttttgagacagagttttgctcttgtcgcccaggctggagtgcaatggcgcgatcttggctcactgcaacctccgcctcccgggttcaagcgattcttctgcctcagcctcctgagtactaggattacaggtacacgccaccaagcccagctaatttttgtatttttagtagacacggggtttaccatgttggctaggctggtcttgaactcctgacctcaggtgatccacccgcttcggcctcctgaagtgctgggattaccggcatgagccaccgcactgggccgagcagtgtctcttattacgttgtatgctgaactgttaaagataccatttcttatatgaccctggggatggtggtagataattcctgattttttttttttgtctttttggtgtaaggatagtttaatcatatgttgtagctttttttctttttcaatcttggagggaaaaaaattctatgaggaacttcgaaaaccaaatactactctattgtgtcagatggtcaggaacacactgttgagtgtatttaaacgtcaagccaagtaagtctctgtatttttatttttattttctgagatagggtctcactctgtcacccaggctggagtacaatagtgtgatcacggcttactgcagcctggacttccctgggcttaggtgattctcccacctttgcctcccaagtagctgggactacaggtgtgcaccaccacaactgcttttatatacacacacacacacacacacacacatatacacatatatatacatatatgcatgcatatatgtatatatatgcgtgagtgtgtgtgtgtgtgtgtgtgtgtatatatatatatattttttttttttttgtagagatggggtttcatcatattgcacaggttgcttttgtactcctgggctcaagcgatccacctgccttggccttccaaagtgttggtgttacaggcatgagccattgcacctggcctccagtgggtctctgtaaagagtcgctgtcctgtcacttcatcagggtgtgccccatgcattgctttctcttttctttgaccttggactgactcatataaccaacccgtggctagagctctagcccttaaagagggtgtttgccctgttctggactctggcaaaacagagagcatagactctaaggcaagaagtgcacatcttcagcactgaaggcttcctggcactagttccctccctctttgggagtaccttattatttgatttgtttccattgagtttttgcccctgccccagtgtggaggtgagcagtatggtgatttaaggaagatcttaatgggtgatggtggcatcatgcagaggagggcagatcaaatagattgcaggcctttttgcagatgtgttttcagcctgttcagagctttgcacacatacaagaatggaactgaaaggcatttttatttgtgcttaatttgtgataattgtaaattcatggcaggaggctctgcaaccagttcagaagggtttcccagtgtgggtagctgtagccagtgtgtgtccccagaattgagtaggagtaggataatttcttgaagctctgggtgtgaagtataccagacatcccactgcggctgggaaagccggaggccaggagggcaggatgagggcagcagagggagcacctgcccatatggtttccccgcaccccgccaggggctccagggaatttacagtcagtacctcctgttgttgctctcgggacatcttccttcaccaccttatgctttctcagaaagcagctggccacagtccagagagtggcagtgactatttgagaaggcacatacttcatttcagaccagatagctattatcagcctagataatttctgtaagtcctgaaatagacttggcccaccaggcagggtgtctgcttctgggtgcagactggctggttctgaactttgtttgcaaccctggagggtacctttattatttagaagtcaggaagaacaaactggagtacattcaggcctttttcgtgggttctatctgggaggttgtggtgtagtgggcactgtttcagcccagtttcctgggtgattgaatggagacaatagcaccaagctcacagaagtgtgtgaggagtaagcatccagttccttcttcccctgggtatgtctctatcaatccagccaatgtgaaaggaggctgcagtgatgtcagggctgtagcagcctatttcccttattccctacagccaaatccaagtccctggaatggtgccctactcactgatctgagagggggcaattttttttaagctcaatgattcatttatacatttaacaaacgttttttgagcatctcatatatgccaggcactgcagatgaatgctgaggatacaaagatgagtacccacagccctcagagaggtcacattcgaccaataaagatggatgtgtacaccagtggctatcatgtaaatgcagtagtggagacaggcagatggattgcgggagggcagagaaagagagccttcctcagcttgagatgtttgttgtgggggcggagtgagagtggaagaggaatttgggtaaaggaagcaggcttgaatgaggacatggagttgggaaacatcctggtgtgtctggagacctttaaataagttgacgtggagtggggagggatgagacataggaaggggctagatcaagaagggcctcctgtgctctgtggtggagctcaggctttatttggtagggcagctattctgaagggacaggaacttcccacagagatgccaacggcaggcatttgctttgggaacacccgtaacattgagtgcctctaggttaggtggacagtgcctgtgtggaaggtggcatgcagagcttgagtcctcagactccgttcaggaaggtttgtaattgtctagggttggtaaagaagtagagatggagaggagtggatggatttaggatttaaggcttgactgattagaggaagagggaatgaagaagcaggaaccaagtatgaccagcactctactttttctatttgaggctctgctcagatcctacttcttttgggaggatttttctgacctctggcccaaattttgctgtacagctctggccctgatcgcctctacatgttacatcttgctctgtattgttcttaagtttgttttgctttccctaataaagggaagctctgaaaagataggatctgtatcttatacttttgttaagtgcaattttaggtatttaatattatttatgtatagtattattgggactttaagcaatttattttatctctgattttctaccaagagggaagaaggaattaaacacaaatgttaaatgggaagtgtcttctacccagaggaatgcattcatgacttgtgagtccaaaagggaatttaaaaaatcaaatacataccaaattatccaaaagaaatttaagagattgggattttagaagataggctagctttttggccacttagtcttggaacagtttacctggaaaggcatctctggtgggttggcagtggtttgatcacccttgcccctttggggcagaattaattgctgtttctgagtggcttgtgtttgtgattcccttggcaggtccagagcctggtgcactgtgtgaactgtcacctgtcagtgcctcccatcctgtccaggccttgatggagagcttcactgttttgtcaggctgtgccagcagaggcacaactgggctgccacaggaggtgcatgtcctgaatctccgcactgcaggccaggggcctggccagctacagagagaggtaggtgcaggtgtcagctctcagcccactgccactgagtctgcagagatgattttctggacagaagtccttttcttctcttctggggttcaacaaaagaagctcatgtatgaacataagagaacagatttaaaataccagctgctgtctggattgggcaactttaggatttctctgtctagagattggttggctctccccatttcctggccctccgtattggaaaaaaacgttcataagaatttcaacttttaggccaggcatggtgatggtgcacacctgtaatctcagcactttgagaggccaaggtgggaggatcgcatgagctcaggagttcaagaccagcctgggaaacatagcaagacctcatctctactaaaaataaaactaaaaaaaaaaaaaattagcagggtgtggtagttagcacatgtagtcccagctacttgggaggctgaagcaagaggattgcttgagcctgggaaatcgaggctggagtgagccgtgattgccattgcactccagcctgggagatagagcagaaccctgtttcaaaaataataataataatttcatcttttaaacatgattgtgagaaaccaaataaggtaccgttttctctgttgttgtgaaatgtctttcccatttcctcctgtgtcctctgtcttctttctttactttgtcatatgaacttattgcttctgcaggatgagtgaggggaaatgggaacactctggaataaagatggcggtactttgtacttgcctgaaaatccctgagcatagctccttatcactatctaggcagcttcccaaaggtggcggtgacattagcggagatggtgatgataaagatatatgctcatagttactcagcatttactctgccaaacactgttcgaagcactcatacagtaactccatgaatcctacaattatactcattttacaggtgacaaaacaggtgcagaaaacttatttgcgcaaggtcatcatcttcagagagaaatggcgtcctctttcctgtggctcaaaaatggcctagattgtgggtgaatggtcatcatttaagagtacagatttcccaacaagataacacagagtattctgtttttaagcttctgtgtgtcagaaatgttatcactcaggtattcgctctccagggagagagaaaccacaaaaaatcctgatcatagtgaagtataggaaaagtaatgcagaatggaatttatctttgagctttcttctggtcaagaaagttaatttccagagccacttgtttatgtgcctcagccaccccatccttttggggtggtaggaagaggagaagcacgagatgttaaggaaaagcaagctgattttaatctcatgaacgtgtgcagagttggctcatttcaaagacagatcatctaacctttccagcaacattggaaattattgttaatactcttggttgcttgccattgttgctgcaactcatatttcaggtcagatttctttatcccagtaatgtgcctttaattctgaactgatgggggagagtttgtggtgagagggaaaggaggagaggaggaaatgcagctcctatgaagcgttgctgactccagcaattctttagcagcgacaattactcattttatatatgcttctctcagaggaactcagagggaaaagaaagtccaagctgttacagaagcagcaacagcagaaaattcttgacgttaaattgtgcagtactgttgttgactctgaaaacaaattcgagtaagactactgaaacaagagaaaaatacctcgaggagtgacagcagagctctcctgcacttggttactatgttattcaaaatgggattcattttaggacctggcagtactgaggatacataacattagctggcatcagggacatagtgtgttcagtgaggaagaaaagaaagagggcctacaaagggtagtctcaaacttgtttaaaaacctgaacattattctctttcgatattagtatagtatatgtatgattttgggccagtgatttgaagatgtttctgagaatagacaacagacggacctttaagaattagatggttgtagttcaatactgtttgaaaacaagattttgggataactgatttttggagattccatctggctctgcgttgctcacatacggcagatctcagagtagtttgcatatacaaagtgagcatagaggataacatcagaatgagggtcaggacgagagaatgaaagattgtttgtggttggtaagatgggtgtgtataaggattaaatatcgctcactcttttgacatatgactatggagaacattcccgcagctatgcaaacagtttttaaaaatcatttgaaccacatgacccagcaattccactcttaggtatatacccgagagaagtgaaaacacatgtccacacaaagacttgtctgtgactgttcatggcagcattagtccaaaagtggaaaaacccaaattttcatcttctgatgaatgggtaaataaaatatggtatatccatacaatggagtgttactgagcagtaaaaaggatggcatactgataggtgctacagcatggatgaaccttgaaaatccactaaatgaaaaaagacagacacaaagaccacatatcatatgattccatgtatgtgaaatgttcaggatacagaaatttatagagacaaagtaaattagtcattgcttagggctagaggggaaagaaggaaatggaggttgactgctaaacgttacatgtttttttaaaaaagtggaggccgggcgaggtggctcacacctgtaatcccaacactttgggaggccgaggcaggtggatcacctgaggtcaggagtttgagactagcctagccaacatggtgaaaccccttctctactaaaaatacaaaaattagctggcatggtggcgggtgcctgtagtcgtagctacttgggaggctgaggcaggagaatgacttgaacccaggaggtggaggttgcagtgagccaagattgcgctgctgcactccagcctgagcaacagagtgagactccatctcaacaacaaaaaaaaaaggtggaggagatgacaaaaatgttctaaaattttaatggttgcacaattctgtgaatatactaaaaactgttgaattgtaatttaagtgggtgaattttatggtatgggaattgtatctcaatgaaactatttaaaaaaaccgtttgacctgctgacatgctaattagtctataaagtttacgttggctcaattcacttttaccaagattgcttactccttcaacttaaactcacctaatgctttttgttattttcaatggataacttggtttttgtagatatgtcatgatatggtctatgctaaaaataacagctgatctgttttgagggtaatagtaggagggccagaggcagcctttgtgcagtctctaccaattttttttttttttttttttttttgagacagagtcttgctgtgtcacccaggctggagcacagttgtgtgatcttggctcactgcaacctccacctcccgggttcaagcaattctcatgcctcagccacctgagtagctgggattacaggcatatgccaccgtgcccggctaattttttatatttttagtagaaatggagtttcatcatgttggccagtctggtctcaaactcctggcctcaagtgatccgtccgcctcagactcccagagtgctgggattacaggtgtgagccacctcacctggcctctaccaaatattaaaggcaaatatttttcaaaatgaaataagtgccgttacttacaaattagcaaaacaattaccgtgctggctccaagctgtaattgactatgactgaagactggagtagttggttttcatgatgtcatccttaaatgtgagggaattactaaatcagccccatttccccttggcttgttattggtgcaagatcagtatcaagatctattataaatcaccccatatctaatattttactattaataaattcctacctcccaggtgccttaaagttcttcagctggggagagatttttaattttcctgtgtagaggcggtgacagagcctacacccaaaagtagtaactgcagcaggttgacaagatttagggagacagtaacgcttaagttggatgaacagttttataggccagcagagaatttgtatcagaaacacacttgttacaacagtacataaaaagccctcagtaccaaagcaatgttttgtcatcggcctccctgctgggttctcctcgggtcagagtagacctattgtatttttcatctgagaacacacctctcatttgtaatcattggtttcggaaacaacagccttggaagcgaacaggaaactggaaaatgactttctggcaacagaggacagcagaagagcataaacaatgctgagagatcagatttatcttttagagcaagtgaggaccagtgtcatggtttccatccccatgaaaaccagctcctagtaccctctgactttgaagtaaaatgcagccgcccccttgtgtcggactcccgagtttaattgctcagggcgtttcctgattcctgagaggggttacagcaccattagaggcttgtttacagtaacatactttcattagttgctggaatggcaacaattttgtttcctatcatctaatttttacttgtgacctgcttttatgtggtggtgtgtcttttctatttctgacctatctaattgcttgcttattatgaaaagctgctgaggataagtcccaagttagccattacatatgtgtagaaaagatatggacatttaaatttatgcatttgttttgacattaaaggagcaatgggcgtgccagtgcctggctgtaggggtggagtggggatcaggaggctccattaccatgggaaaggggccaggtttaataacttcacccgtcaaaaagctcataaccctatgagcttctctgcctcattccaaaagaggatttgggatgagcctccagcaacaggcataccaacagtgtaagcagaaatacagaatgaggaccaagggaaaaagaagggtgcagcttgcgagccatttgggtttatgtggttggtatgattgtgtttgaaatttggctccaggctttttggcaggcacagacaaatgggatgtgtggttaatcacacatgtggctccaagtcacttttactttgtaccttctctgaggattggcataaagctgtcccttttttggttctttttgagggcaggaaagaccacagtggggagaaagagaaggaagtaaacactgtcaagtgctaactgctcgacttgcctcttaacagctctcacatcccccaaatgacaatactagcagccgtagtggtgaagactgcgtgtctcctgtgggccagccacctgccaggcacttgtttggttctgccagtcttgtcgtcagcctgaaagggaggcttggtggtcactgtttttgcagaagaggatgcttgggcttagggaggttatacaaccagatggtgagttgtggagccagcccccgagttgtgtctgttggattctacagtgcaagctgcaagcttttcccatactccagctagttgtcctttccttttagctcttacttggttctgggctacagaacctgctagtctgctgagtctgctttgttagacagccagcaagtaggtctgttagtgagggtttgggttctgtgcataggtttgtaataactctttgcagtgcttggagtcctttttgattcccttccttgcagctttggggcagtattaagttggtctgtgtgtggcagtgtctctttttttccctttcatggtttaggattatcacaccacatgtcagtaattataaaatgcagggctgagctcaggagccattgtgctctatgtggctgctaatccccatgctaaatggcaccaccaaggggccttttatgttcttgtctgttttcatagttaaacattccccccacccccaggccttcagctgtgttcacacaaatagctcacctgtcctctgcttataatttactacgtcttgtatccaaacttgttttaactgtgtggtaagagagaactagcatattaactgactcttcttgctaagaatgatatgcaagagcttcagtattcagacttcgccatctgatttgacatctttttgcttacattggggaatttggcaattcaaagattgaccattttggagatctttatctacctacctacctatctatatgtaatccttccccatttccacaatattaatacacgaacaccttttctctttttccccctcgattatcgagattcagataatacagtgcttggggaggagtgggtgtgccttgcccaacaccactaaaagaactgatacaaaatctcaaggctgggttttgggagagtacatatgtgagagcaaaaacattaaactagctacattcttttctctatctggggcattttttaccctgctgctattcataaatgacttcctaatgcagtcctgtgcatatgcagaaaaaacaaaaaacccagggctatttatgtttgagataccttttatgtggtatgtactaagcaagtgtcaaaggaaacccctcacacacagacactgtatatcagtgaaatttggtttctaaacaaatacattccgcatataagcactgcctggtgtttgtttaaaaggaagctgttctggaaatcacccagcttgacagggaagattacctctgaaatggtcatttagttttccaccagtccttaacagatactgtcatgcattgcttcatgacagagacacattcagagaaatgtgttgttaggggattgtgttgtgcaaacatcatagtgtaggtacacaaacctagatggtatgtcctactacgcacctcggccatatggtatatatagcccatggctactaggctacaaatgtgcacagcatgttactatgctgaatattgtaggcaattgtaacacaatggtaagaatttgtgtacctaaacatgcctaaatgtcaaaaaggtacaggaaaattatggtactataatcttatgagaccaccgttgtatatgtggtcccttgttgattgaaacattgttatgtggcccatgcctgtactatttctctctctctctcttttttctctgtctctccccacctgcccatttcctctctcctttcttcccttccccatttatttgagtattactatagaaatcatttcattacctacaaaggcaactgaatctgtctgtccacataggattggagggcctgaatgaataggacactcatattatataaaaagagttactcctttacttgaagacactcaatgcaatttaaacaatgacaccctgctaggtcgtgtgaaggtgccagtccaggcctggaaaggggagcagggttagggacagcaaggcaatgcatctgctagctgtcacaacagaggacaatgcaagcgagagctggcactggtcacactagtcaaggatgatgtctaacactttggggcaagatgttcaatctaaaattccagctaactctccaataggaactctccaaaaatgcagtcttggacttttagaaaaagtgaaagcagaaatcagagaggtaatagcaaacaccggggtttaggaaacaaaccaggacacaaggctaagctaagaagttaaaacgttcctaccaagatgcaggttggtcacgtcacttaaatcctgtcattcgtcacagtaatatccagatgctgtaaagttgccccaggaaagtacagcccctgccccggcagagggactgagcctggttggactcggcctttttagaatgaggtaatgccgatttatgttctatgctggctggacagattgtaaaaacctgtcattattgcctcttcccccagatagagactgccttgacaccccctttttttttcgagacgagtctcactctgtcgcctaggctggagtgcagtggcacgatcttggctcactgcaacctccgcctcttgggttcaagagattctcctgccttagcctcctgagtagctgggactacaggcatacgccaccatgcccagctaatttttgtatttttagtagagttttagtagagacggggtttcaccatgttggccaggatggcctcgatctcttgaccttgtgatccgtcagcctcggcttcccaaagtgctgggattacaggcgtgagccaccgtgcccagctgaccccttttaaaatttgtccagcagcagcattttccaaccagtatggtgttttgtctttatggaggttagggttagaaccctgacctgtactactgttgccatggtaactgcccttggctttaaaaaaagaattatataatttcctgaaagtgttgttagacaatgtttttacaagagcactctctgcatttaaaaatgtgacattttgctcttagaacttttgggagagtattaaaaaaaagcaatagacccaagtcaggagcagctctgcaaatctgagatgcagatgtgctgattgggcaaaggcccagtgcatgcgtgtgcagcgtctccagttttccagcttgagccttctccttgccattgcttatctgcttcttgacattctgtttgagagtaaaaggaaacttaactgctaatcgctgatttaaatacttaaactctgcagaagtatttattgcattgacttcaatcactccttccacggtattttctaaatatttctgtgtaagtttagacacgtttaattatttcacttttctttcttccacgatgaagaggccatgtatgacttggcccctctgatgcctcaggtcagcttatttctcttttccttcccctgctccactggaatgagtgaacatctgtacgtccttctttcccttcttccctctctgtggcctgagctaatctctggggagaccctgatgatgcccctttgaacaactcaagggctgctaggactagagggtccctggggtccacctagccctaataccttaggggaaccaggccagagggtgtagcggtgacatgttcactattaaccaagaacttggtgctagcactggactagcccctcggggcaccaacttctgttgcagagctgcctctacacatctgcctgccccactcttgctcctccccagcttatgaagcctccagtgctgtcaagcactccctttctggcacctccctcttggtttcctggttctcattctaccattccatctgtttttctgtttctttctcagctgctcactctttcttcttggggtttttttttttttccccgtgagacagggtctggctctgtcgcccaggctggagtatagtggtgcgatctcagcttactgcaacctcaagcgattctcccatctcagcctcttgagtagctgggactataggcgcacaccaccacgcccggctaatttttgtatttttttcaccatgttggtctcaaactcctgagctcaagtgatccactcgccttggactcccaaagtgctgagcttacaggcgtgagccagtgtgcctaacctcgggggttcttgactgaggcatagcccttggctttctgttttcctctgtctcctctccctgaggtggcttgtctggtcttaggattttgcttgtcacttccttgcttacaactccaaaaactctgcctgggcttctccagtggaactacagtcagatggctgaagcatcccggctcttgggtcccatcttgagctgccaggtgcctcagatatggactggaggagtggctgtcactgtggttcgctcccatgttagatacagggctagtctcagctctgccactccccatgtgtgaccctgggtgagttacttaattccctaagccctgtttcctcatctgtaaaatggagatgttaatagcacttttttttttttaattattactttttgtgagatggcgtctcgctctgtcaccaggctggagtgcagtggcgtgacctcggctcactgcaacctccgcctcctgggttcaagcgattctcttgcctcagcctcctgagtagctgggaccataggcatgtgccaccacgcccagctaatttttgtatttttagtagagacggagtttcaccatgttggccaggatggtctcaatctcttgacctcgtgatctgcctgtctcagcctcccaaagtgcggggattataggcgtgagccactgtgcccagctagtagcacttctttagagggttcactgaccattgagaaatgtctctgtggcacttagggccggtataggtacagtcaactgctagctaacagtaatttttattctctctaaaatagaatttaagaaccctcccaggccagttctcctgaccctagtgctggcttttcaatctggcttccctgacccatcaatgtcaccagtaccatccatcttggaacttttgaaccatcttgtatttactcatcctctttttttttgtctttttttttggagacacagtcttgctctgtcacccaggctggagtgcattggcgcgatcttggttgactgcaacctccgcctcccgagttcaagcaattctcctgcctcagcctcccaggtagctgggattacaggcacccgccactacacctggctaatttttgtatttttagtagagatggggtttcaccatgttggccaggctggtcttgaactcctggcctcaagtgatccatccatctcagcctcccaaagtgctgggattagaggtgtgagccaccacacctggcctgcccattctctttaaaccctatatttggccaatcaccacattttattgacatttcctctgcaattgcccttgaatttctctgtttttctccacttaccctggagcctccttaactggtctcctgggactggcctcttcagctttagaccctgattctttctgtctagcttgtgaacctcttcataaaaccaaacttctctaaataatgctctcataatgaatttgtttattcattcacaggcctgttcaatgaatcactattaagaacccactgtgtgctaggtaggtgctctgccagattcttactcatttttatgtctttagcacctattagagttgagagagaatgaatttaatgaaacatgacaaataatatgactaatatattttaaaaatttgcagaaggccagctgtggtggctcacgcctgtaatctcagcactttgggaggctgaggcgggcagatcgcttgagcttaggagttcaagaccagcctgggcaatatggcaaaaccctgtttctatcaaaaatacaaacagccaggcatagtagtgtgcacctgtggtcccagctatttgggaggctgaggcaggaggatcacttgagcccgaaggttgaggctgcagtgaaccacgatcgcgccactgcactccaacctgggagacagagcgagacgctgtctaaaaaaaaaaaaaaaaaagtacagaagcccaacaaagggtgtgttcattctctctggaagtgagggaaggattcccagaagaaagaacatttgacggagggcttaaaagtcaaattagtgttgttgagccaagggatgggaggactcaatatacacagagtgggcgccaggtgtggaggaaagttcttcacctacacggtgtggctggtggacagatcaagggtgctaggcaggactgaattctgcctgctgcctgtttgtgtttttaaaatagctttaatgagatataatttacgtaccataaagtttacctgtttaaagtgtacaagtcagtggtttttagtatatttatagaaatgtgcaaccagtggcccataatctaattttacaacatttccatcaccctaagaagaaaccttgtatctattaacagtcactctcccattccctgtgtgtgccccccacgacccggcactagcccaaggtagccactaatctactttctagatttatctgttctgcacattcatatgaatgggatcatgcaatatgtatcttttgtgtctagcttctttcacttagcgtaaagcacttgaggttcctcgatgttgtagcatgtatcagttgtttcattcctttttattcctgggtagttttcattgtgtggctataccatgttttgttaatgcattcatcagtccgatgcctgtttttaaagttttattagttttaaagccacacccatttgataatatgttgtctatggctgccttctcactactgtggcagagttgagtattgtgtcagagacctgcatggcctgcaaagctttaaatagttactattcagccctttgcaggaagagcttggcaattcctgtaatagaggatgaagacaatgaagggggtaggctggggctgagtggaagatgagactggaaaggccacgtaaggatttggacttaatcctgtggatcggcttctcaaagtgtgtgtgctgtgtgaagcccctgcatcggatcccttgatgtatagattcctgagcctccccctgggcttaccagctaaaccccttgccccacgcccttattcttaattccacctggacttctttcttcagtctctcaattcttgccactttggaagcccatgcttaggtcttagctcttcaccaaacccttgcctgattgctttaccctcctccatttctttcttttctaaacatcgctctgaatcttcttccccctaccacaacctgtgccttcccacagtatggaattatatgttttattgtattacttgctgctgaatcgtgtgtgttaattctgcacactcagctggtgagtggactgctttcgggcaggaactaggtcttgggtctttttttgcattatgcaaattgggttattgcatggcaccaaggatgttatttagagtataactgaaagtcttcttaaatgactttccttttgcatagtgcatctttatttgctttgcattctattagtggacttagtgtttggtccctaggcccctcaacattggagctaagcaggtgtcctccattttgtatgactgctttgatttacttttttaattaaatctcttttaattaatcttattttttactctaaactgcagatctttgttcagtcttttccctagcccatttctaaatctttgttacattcttctttactctgaggggttttagtcatctgctagtaaactagttagtcctttccgtcagctgggtaaaaagctataaatggttttcaactctatgcagctcccttgggttgctcatttgatctgagccaggtttgaagttgggccattgagaatgatctgtcctcatgatgtagggggtgactccagccaattcttaatattgctggaattaattaactttgattcctctaactgaaagagggcattttactctaccgtgtattattaaataccttataacttgatttttttgattttgttttcttgctcagtgagtacttaaaatatccctgccgatatagtaatttgttccctgtttaatatggctttttcctttgtttactctggactcaagtctttgtagcttgttttctaagtcagctcaaaagttgctggtcattggatttggcagccttttcaagctttacccaccagaatcctacaggaagttgtgtgtcggccagaagagtctgtttatttagagcgtggtgtccagcagaagcaatccatttatgagggtctggtcttaaagacacaggcatctgagtctgtgtttggaagacctgctgctttggcttccattgcagccatgttctccatgctttcctgtccagcccgccggggcacctcagtggcactgctggctgattgaaggagtccttgtctctgagctccttggccttgtctgaaaggctgaaatatcaaggcccagatattagacagggttctagtccaaagcaccctacaataatgctttgtatttatggctttttttttccacctgaaccacagagtccttcagctgaacctgaaatttgtacaactcttggaggatgaggggcaaattacaggtatgacttggatacttttgaagataagagagctaatgagatgaggtgttactgattctcactgtgaagcaaggacagagcccagctttaggatccaaggtcactaccatagcctaactcttgcccggagctgaagtgtccccttgtgcccattatggcttaacttctatttgttgatacatgtgtacacacatctgatccattttgaatttgctccagcaagtcggtgatgtggctgtcggttctctgtgcctagcactgggcttgccacaggttagggactgcatgcctgtggacccgtttacgtggaagctgcatcgatgtcttcttaaaaggtgagtccccctcccagagtgaggtgtggcctcactaccagtgatgtgagcacataccgaggtgccttgggggagaggggcagagaggtatagcaactgctgagaggcctgagcacaaaaggtcgaaagtgagctgtcgtacctctcagccctcgccatgcccctggggtcttttaatgacctacagttggattttttcatgaggtggaagttatattgaaatttctgcctcagaatagttcctgaagagcattgactctctgggagtcttaggtaaatttaacacttaatgaaggtaaaaacaatcctttccacattcctctgctcctcctctcaacctcaggtcagtcgatgtgcaagcagtgctttccttgggaggcagcagtttctgaaggtaaaggagaaagccctggtccaagggagccaaaggtccgttgggacacacatgattccgtgttgggcacatgggcatgtaggtgtctcctagccttgccaagctgtcttaaattcgggcatcttccaaaatcaaaggcaactgaagagcttaatttccaatgatgatacattttgcctcagtcatctggccccaaaagacttctgggggccgatcaccctcccttctattctgaacgccctcatcccctagattgtcacttggtgcttttggccagggggctctgcttcttccttgctgcgagttcttcctgctgagcccagcatccccgtgagggctttcacgcaggcccttcattgctctcggtatgttgtcagcccatgtgttgcagtttatttttgattcctgctttcataaggtttgaagattccactcatttttccagtggttgttaagatagtgagaatctaaatgaaatggtaatattaccattgtgaacaattatttttctaaaagaatcttttgtgttcatttttaatgctgttaagatctaattcccagtattttatttggaagctcttcaaatttcccaaatcataaaatctttcaaagcctactccaagttactttttcttgattcagctctcctatttgcatttaaaataaaaaggccagcctatttccaaatatggaaatgatctatgtttattagagatcagcaaagtgatatgggcccttgacttgctgtgaggttttttttttaaatgtgttttagagcaatgtacaagggcaatttttcgtcctgttttgtcatgtgttcttaaatacatttcctaaacactttctctggcttggtgctattactgtgtatacgtcctacatatgtttcctattttttatgactcatacttacggtactcataaagatttatcctttatcttggctctgagtaatgagcccacttgcacatttccagcagaactgtgggttagggattttacatttcattctgctggagaggcctctggaaggcatagcacaggcagcgcagcatgttccttgtaggcagtactcacttctccctgagggaacagttagctcagtttttgtgaatttactaatttttgttctctagcttttcctttccctttgccctttttagccattttgctgtttgagtgaggccacacaagagcatgaacagatgaaacaaatgctctactcctttttgctgctgagtaactgtggtggaggaagaaatggaaataatgaactgaaacgatattattacatgtggcaacaaactcaggcaaggagtcttcttgggtccaaataaacattcagacccatgagactatcataggccatgggtggcttcattatacttaaaagggtataggacaaggaccacagcttacggcatggcagcaaggcattcctccttgttgtgtgccttgtgactgttcacacatcagttcatcagttcacatagccatccagagctctccagctgatggctcaaatgccaggagatgagatctctgtgtgtgtgtgtgtgtgtgtgtgtgtgtgtgtgtgtgtgtgtgtgtgtagttctctagtttaaaagccttaggaaggccgggtgcagtggctcacacctgtaatcccagcactttgggaggctgaggcgggtgggttacctgaggtcaggagttcgagaccagcctaaccaaaatggtgaaacccgtctctactaaaaatacaaaattagccaggcatggtgacgcatgcctgtattctcagctacttgggaggctgaggcaggagaatcgcttgagcccgggaggcagaggttgcagtgagccaatatcatgccattgcactccagcctgggcaacaagagtgaaactccatgtcagaaaaaaaaaaaaaaaaaaaaaaagccttagacccttgcgggaactagtaggcaactatgtaggaatagttttcatggtactctgtctcataaatatgccccatttacaagaatcactgctctcagggaagcccccagatgtcacttcttatcagatgtcttaaaattttccagtcccaatagcaagctgccttgtgttataattgacatattgtcttaccagattaccagggttacagaattgagagagttaacagaagatcaaattctcatgtaaaagggaaaagctttgctcactgtttatccacacctgtacgttttattgtttttatttgtggtattcctgactgtgataggctaaataatggcccccaaagatatatccacgttctaacccctaaacctgggaatgttgcctttatatagaaaaagccttagcaggtgtgattaaattaagaattgtgagatggaggattatcctggattatctggtggcccctaaatacagtcacatgtatccttataagacagggatttgatgacacagacaaaagggaagactgtgtgaccatgcaggcagagattggtggtctggaacccacaagccaaagaatgccagcagccacgagaacctgaaagaggctgggaacaggttctctcctggagcctctggagggcatgtggctctgctgacaccttggttttggcctagcaatgctgattttggacttctggcctccagaactgtgagagaatagccttctgttgttctaagccacccagtttatggtaatttgttacagcagtatgggaaatgagcacacactcacattagtttgagttccatgctccctcctgtctccagtttgtttactcctgtgttccccagctctgtaaaggacgctaccacacagttgccagggccacagtccttggcattattatccatgacttcctgtgtttgctcagatgtcatatccaatcctatttgttctaccctaagaccatattctgaatctgcccacttctgaccaccaccttcggtctgacccaccatcacatttttacttgagaggcagtgggcctctggcccatccctcttaggagtgcaagatctggggtagagcgccagtgttggaagcctggctacactgctcatgagctgtggggctttgggcaagtcagttaacttctttatgcttcattttcctcatgtgggcataatcatagtatctacttcatagagttgctgtgacgattaaataattaaagcatgactggtgcttagaacagtgcgtggaatatcatcagcactccataaatgtcagctgctatcattgttagcaattaagatctattctctaagtggcagccagcatgatcttttgaaagacttccgtccagtcacgaagttcaccagttcagcttcctgccatggttttttacatttcaatgaaaatgcgcaatccccaccagagccctgaatgatcttttcccccttctcccagcactctcaccattgctcactgtgctgcagtgggccctgacatcttgcctcctgtccttggcatgggctctttgttttgcctgaagtacttctcccagttactcatgtggctgccttcacccagtccctgctttgccattacctccactgagaggccttcattgaccaccccatttaaaatagtcatagcaccccacaacagacacactctcttttactgttttactttaaaatgtaacttatattaccacctgatatttatttttaaatatgttcactgtctatctcttctgctagtatatcatcagtatagatgttttatctttagttggtattgccaggaattagaacagtgcccactacatagtaagcagtcaagaaacatttgtgaaataaacatttgcatgaataaataagtatgttgatgtagcagtttagcaaataggttaagtctagaaattctatatatggaagtttctcattaattatattttttgaagatctagttattgatattggtatgtatggcttgggcataaagtaatgtttcttaaaccaaggcttcaaggtatagaagacagcactggattgtgagtcttaataaaagacttccctcttttttggtcttccctctgttgtgatcttttttgtttaaacttgagggcaaatgtgtagacccatttggatctcagtttctttttttattttctgtcaatataaagacattgagaaaattaatatttcaaaataccaattgagaattagagtcaaaagcatttctggagttgttaaactacaaaatatccttaaagaaaccctcagcattcagtgaataaggaaccacctaagagctgaaatgtaaactaagggtgtctcatgtcttcttatgtgtgttttttttttttttttaacctagattaagtaggatttacagatctgggggcagatctggtctctgaatacttgggaaaatgcttttgagtttcattgcttatatcttactgccttgcacagtaaaaatttcatgattttccaaagagctctactgtttcgtcaggacagagtacatgtgaatctttccctgtctttcttttatttattgaaatgcagaagattagaagaactaattatttcagtttgttgagtggaggcctctctccacataaattagaaccaggcagttggacagtcagctgcagctgcctttgtgaactgggcaccggtgcaaagcattgcaggagtgaggagacaggcagccctcggagctcacggtcaccgtgcatccagggacaaagagcaacacctgtaacagaaagtacggagacgtagaaacatctcatcgccctaaatacacgagatagaaacttaaccaaatagatgtaatcaactacagctgggctgagataaacacgttaagtgctaagtaatcaggcatgttagggggatgtggggctggggctagggctggggctagagctggggttggggctggggctgggggaaggcattgctggaataattggagccaggtgtgcttgcctggtgctgctttttggaggtgagaaattggaaaggtttgaaatggggatgtggtttggcagagggctgaaaggagaattttccaagactaggggaggagactggtaaataaaatagagccgagttgagtatgaaatatgttgaggacagcaagtaccttggcagctgtgaaagcttcatctgatggttttgcctgttggtgttgatgctgggagaatggtcttcagctgaacaccacaggtcttcaaagccaggtgaattgtgacagcctgtgacactggaaggggcagtgtagacaggcctctgaagataaatgtttgtccccagatttccccactacagattgggagaaacctctagctttacctcacaatccagtgatgtcagctgccttggaagcagttccttgctttggcacttcctatgttcctatttttttggaaggtacctgccagggaggaaaggcagcgagcacaggtgattgagtttttgttcagagatttggggtaacctcagagtagatgtggtgttggggtcaggtgtggaatgaatgtggtcttcccaggacctttgtttgttagattcagaagtctccagaactacggtgagatttggggagcaaaacctgagcttgtccaggttagtggtgcctgaacaggaacaactagcaaagatgttgatgtttgtgctacctttcggccctcgtctttaatgagctccaaatcccaaaggtgaaggaaaagcagacaaatgacagaacaaccattagttcctcatgaggaagccaagtgtttggagggtcatgtatgcagctgccaccaatttgtcaccctgcttgaaaatccagggacctgtaggcaggaggtaatggcactacactgatcagagccaaagtcaaacgctggtaggcttctttccagagaattacaaaacctggcattttatttgtttttttcaacacccctggaagggagattctgttagctctgttttacaggtgtggaaattgaggctaagagaggttaagtattctacccaaggtcatgagctgggaaataattggtagaacctaaccttgaattcacaacacacttcctatagatggagttgacatgcactctgagtggctctgggcaaggtgggctttcccaaggcttaggcatttattcaataatgaaatcattatttattaagcacctgtttgtaatgtgtcaggcacagtgccaggcactggcagtcctgaccccctacccttgagaatttgccaaaggtaacaaaaacacagtggatagtgagttctcccttgctcccgctcccatttagatgatctcaagctctttactttgcttaaatgtgggcttagatgttgcacccagtgttgcgtgttgacttaatcatatgcaggtaagtctttgagctgcaatgaaacagccatcaggtaagagttaaatgtgaatagctgggctgtcatctataggtgaagagcttagaaagaggggcaggttagggcaccctgttattaacatcagctctgttctatacaaacaattctcttactggattacctgtgccaaaatattgctgaatagcttggaaacaggttagtattttgccctttagcaaaacagacaaaagaaagaccatggagttgaatttggaaaggaatcttggaaaatgaatgtttcagtacaacaatgtatcattcacatgcccagaaattcagcactgcagggctcctgctggcagaatcaggtgaactctgggatgcattctgatttggtcttgaattcttgcatgtcttgagtaggttgaaagttggttatttttgttttgctggcagtggcctttacttagaagtgcccaggagatattcttgggatagatgccaacaggctttgtgtcttttcccttcaattttataaaaatgtaaatgaaaggatttcccagcaccaagttgtggagctacctgggtattcaagtgacaggaagagttggttgttagggtggttaggaagggcttcttagaggaagcgtgcttgaactgagacctgaatggtgaaaaggcgtgaactatgccgagatctgggtgaagaagaggccaaataaagggcccaggccctcagcttggaagcagcttgttggagatgagagaggggccagtatggctggagtggagttagcaagggggagagtggtgggaggtgcgattggtcattgagggttggatcacgtggggccctgcggagtaagaagttgtttcttggcatttctttacatttctgtgttcttatctagtgattaaaagagctgaccctaaattctgaagacttggggagtccgtgtttgctaacaacggagaattggttctataaggagaaatgcgaatagttccactggcaagggaagtagaaactagattactagagtggatatttgggctctagtcccaaccatgccataaccagctacagaacttgggcaactcatgacctctttgggcttcaatttccttatctataacaaacatttggagtagaatgtctgtaaaatctcctttctcactagaagtcaatgattttattatatataaatttcatttttggttttatccttttgtttctttcagacttttaccagtgatcttacagtaaccaagtccactcactagttctgatttcactcttttctctattcctttgcttctggagtagccagtgaagtacttggaaaaaaaaatgtcaggagggaaagagagaatttcataactttgcacagtgtactcaacagtgcatatttaacacattgcctgttgccctgaaagaattcccaatcaccgcatgagtcgattgtgatgaccgagacttgttctcagactagtgatgtagggtttaaccaaaaaatgccattgtccttactgaggaggatttatcccatcaaaacggcatttgagaacctgacagtgggatactgttgtttgcatttactcttttttttaaatcatattttgatttattggaaacttatatttcaataaaaaaaacctgctcatctttcagtatcaattatacaactctctcattgaaaagtatatctaggccgggcgcagtggcttacgcctataatcctagcactttgggaggccgaggtgggtggatcacttgaggccaggagtttgggaccagcttgagaacatagtgaaaccccatctctactaaaaatacaaaaattagcctggctggtggcgcacgtctgtactcccagctatttgggaggttgaggcgggagaatcacttgcacctgggaagcagaggttgcagtgagccgagatcgtgccactgcattccagcctgggtgacagagtgagactctcaaaaaaaaaaagaaaagtatatctaaaagaaattagcaagaccaagtatattaacttgtttttagactactaccatgtcaacacttcctattttaaaatgcactgtaaatcatggtttacccttaggattagctttgagtatttcattatttgttttgcttctgccaaatgtaaaagactaagtgggcacactgacccagaattaaagttaaggaaagcaaagaaactctctaaaacaaacattatttaatttttcaagccagcatttcaagacattttcacttgttgaaaggagaaagcacttctattttgttctctagtattcactttggcaggctaaactaaactttttaaaattgttccttttaattgagtacacagatcattttagtgtgacatggcatttatgaaattgataattcagtcacatcaactcatttattgagatacattcatttctagagatcttttgttttttgagatggagtcttgctctgttgcccagactggagtgcagtggcgcgatctcggctcaccgcaacctctgcctcctgcattcatgcaattctccctgcctcagcctcctgattagctgagattacaggcgcctgccaccaagcctaactaatttttgtattttttagtagagacggggtttcaccatattggccaggctggtcttgaactcctgacttcaggtgatctgcccgccttggcctcccaaattgctgggataatgctcatgagccactgtgcctggcctagagatctgtcctgaagacttttactgactctattagttgctgaaagaaccataggctctagatttataggtggccatagagatagagtctaaccttttcatttatggggagactgaagcccaaagtaagatacttaagccaaaaaaaaaaaaatcatttatttatttatttttattatttttagagacaaagtttcactatgttggccaggctggtctcaaactcttgtcctcaagtgatctgtccgcctcagcctcccagagtgctgggattacaggcctgagctactgtgcctaaccccctttttaaaatgaatgatatgtcaggatcttacattaggaggaaggcaaaattggggagcaccggggtttgtggtttatagtgaaagttaatttcctctgtttctcagacaattaactttttttctccttgagggcaaacaacaaatgattattttctagaaatcagacaatcctatttttgttctaaaatttcatgccaacaatttacttactttcttctttgaaaagaatgagagagattctgacctaaaattgtctgaaatgtgtactgaagatgctaatattgtattggtaggtcttgccaagatttaagagggcatctcagaaagacattgtacaccattctacaatggtaacttgttttcaccttagagatgataaagtagagggatagataagaggcttaattcagctcatttcttacacagtagagaattatggatagaacttacagacttttacataaaataatgtaaccaggaccagaattaccaggccctataagttgttccttatagaaatgctcaaggctcctagctcagttgcttaattcattgatagtttatggttataccccaaactcaacaagtgtttattgagggactatgacctggggacaaagccaaggaacaaactcctcaagtctaggagatttagggttgagggctagagtttgatttttctcaccatgcaagatattccttggtaattcagcaacaatctaaaggtaccctttagatcctaaacaaaaatgggatttaaaattgttattagatttatgaatgatatgttttcttttgggcaagtaagtcaggtaatggaagttcatttagtgaatcagtgcagtaatgtggttaactaagtgacacttactaagccagaagttaatgtactcattatctatcaggaagcaaatcagggtctatgtctctgaaaagcaaatgatcgtctttcattaactggttaagcttggctttcaaggctcattgtgatctggctccagtaccctttcaacgacattcttctttattcttttttgtatttccttagctccgtctgaattaagtattcttcacacccactcatgctgcctccactgcccttctccttgtctggaccccttagatccacctttccccattcaccctctggcccagctgaagtgcccccttcctgctgcccacagatgtgtttgtatctgcctgtccctctgcccccatcaaactgtgagcttcttgagggcaggtattgtgtctgactcacatttgaagtcctttcattacttagtggtgcttcccaaatataagtttatatgtgctattagtcttcacagtttgtgtagtattcatatattatttgcattatttaccttttttttttttttttttgagacagagtcttgctctgtcacccaggctggagtgcagtggcacgatctcggctcactgcaagctccgcctcccatgttcatgccattctcctgcctcagcctcctgagtagctgggactacaggtgcccgccaccacgcccggctaatttttttgtattttttagtagagacggggtttcaccgtgttagccaagatggtcttgacctcctgacctcaggatccatccacctcggccttccaaagtgctgggattacagacgtgagccaccgtgtccggcccataatattttttcttaaatctactcacttaaaaaatgactttagcttcatcctcaacttcctaaacatgaaatcatgtttttaattcctgtaaaaatatatatacataaagtatatcttaaaacattcttattatctccacactttgggaaggattgactgagtaaagtgctttacacatagtagccattcagtttctgaggaatgaatagtaaatgcgcaaaacataacatgagaacctcttttccctgttagtttagtaacttcacgcttattaacctagagataaaaggaggagggtgcagctagaaaagactgagcaagcccgtaagccaagccattcattcctgtctgtgaagcatttaggtgttagatattactaattacctcttatgcattgcaaactgctgggctagaggggcctatggaacaataaattttgtggattgcagagtccctgctgacttactgagtgagcctctgctgaaactccagaaattgtgtaagtggaccccttccccacaaaagattcagaaagcagcgcactatacatgggacacatcctagagaaaaggggtgtggtaagtatgtgtacacatcacatggttgttgttgtatttctcagtgttcctgtttggggcagtttaagttacagatttctcactaccactaagtgttttttaggaatgcattgtgtactgccaacataacagaggtctgaaggatttttctataaatttgctaatgggaattgtatattttttaacctaatttttgaggatattgtaagattactcaggtagaccaatttgagtttctttaaaaagaacaagttcctatatattcaagctatagttaacatagttaataattaaattaatcatactaataaatattgaagcctcttataaatccatgaagagatttctgttttagttactatactctatatttgctgcttctatagagtgtagaaatagtatgctgtagtttcttatttattatgtaaactgcagtatagatttagggtggcagatcagagactagaacaggtgatttttttcaattggtgtttaataaagtttaggtaattttttcttaaatctgtaggaatcagtctatgtaagttcagcatgggataaagtctatttagggttttatgagaaaaatcacccactcttttttttttttttaatccagggttgggatcaacagttgttctagcatgggcagggtaacttgatataatggcatacatttttaccctggtctgctcttagagcaaatttgaaatggttgttttggaaaatgtgctatgagtttctctccagacctttgcaccagggcaggcagtccagcctagcaaatctttggcacttgatgcgcatctttcataacagaactttgatgctgagactcagtgtcttgaaatcagcacaacaaaatggtgcctgaggagcagtgtttactttgatcattcttcaacttctgtgccccagcctttcacagagcacaaattgctttaccagagttacggtgctgaagcccacgactgtttttgtagtctggttgctgtggtgatccttagccttccatgaaactcccatctctagggaaatagaaacctttgcagctgtctcggcctttttggttttgtatctggtggaggtcttcaccgagcttgttcaagcctgagagtgatcggtttgtgtcagagtaaaatacacacatggaaacagggcatccccttcaggatgtgttgtattaaaaaaaaaaacaaaaaaaacaaaaacacagctcccttatccttctctccaatcatgtggggcctttgaagtatctccaagtctggctagagtgaagtgagccttggagatgttgttggtcatgatagtgctgtgagtaagctttgggagcgtgactcaggaagtggggtggccaggtggggaagaaagagagtgggggcaaaggggaaggttaacagggcccgtgtgtgcccagagagaagttggtttaggaggagaatgtgggccgagtccaaggatgccagcagcttgatgtttagaggactatgaggaaacccgttttgacttgaagcctcaatggaggatggtatagacaagagcttccttccataggaaccaagggaatggagaatagcagctgtggttttagtgggtagaagtaataatagctaacacttagagagtgcttaccagatgccagtcactgttctaagtgctttcgacaaatgacagatttaaccctttgacatctgatagaatagatacaattattatccccatgttacaattgatgaaactgatgtgagtagagtcttaacatcctcgaggccctagggtgggtaggtggagagctgagattccaacctaatgcctggctctgagtcactgttcttaaccaccaggtcaaactgcctgtaatttagaaaggaaggcagagtgacccaaaggattgggttacgggagatgtggccaacttagaagaaaatgtagatcttggaagagatgaaattatgctttaaaatgtgtgtgttgattcatgtattagtccattctcacattgccataaagaaatacccgagactgggtaatttataaagaaaagaggtttaattggctcacaattctccaggcagtacaggaaacatagcagcttctggggaggcctcaggaaactttcaatcgtggcagaaggcgaagggaaagcagacacatcttacatggatggagcaggaggaagagagagtgaagggcaaggtgctacacatttttaaacagccagatcttgtgagaactctctcatgagaacagcactagggggatggtgctaaaccattcacgagaaactacccctataatgcagtcacctcccattaggccccacctccaacattggggattacagttcaacatgagatttgggtggggacacagatccaaaacctatcaatttcttcattcagtcattcattcgttaccaaatattaatgtaattcctgtaagtgctagatactggacaaggttctaaggtgataaaaatacaagtcccaccccatgctctgagatagtttatatgtacaaagttaatacaaggcagcagattctggatgctgtaagagatgggtcaacaggacataggtcagtaatatcctctggacacaaagtcttctattttttttttttttttgagatggagtttcgctcttgttgcccaggctggagtgcaatggcatgatctcggctcaactcaacttccgcctcctgggtttaagggattctcctgcctcagcctcctgagtagctggaattacaggcatgcgccaccacacccggctaattttgtatttttaatagagacggggtttctccatgttggccaggctggtcttgaactcccgacctcaggtgatcctcctgccttggcctcccaaagtgctgggattacaggcatgagtcactgcacccggccaacacaaagtcatcttaaagagcatggctttttttttttttttctgtgatccaatgtgaaaatacaaaacagtaattaatgcatttatccctccttccagaaagaattgagaagttactttgctgagtttgtatatagtttccaggagtaaaatagttcctgcctcttactgctatagagcagcttcccattctcctctatgtcccaagactaacacccaagattaaagatgggggtgggtaggtagggggagagacagacagacagacagggagagacattcattctacttccagcactgtcattttctagccatatgactttggcaagaacaccaatttctttacctttaagatgggagtaattagatattacgcagagcacttccttttgatgagagcagcaaatctcaacaggagccatggatctacctattgtctttccttaggagatgatgatgatgatggttattactactgctgccaccatgatttttaacaataatccaagtgcggtgtttttgaatgttcatgtcttagtaattactcctctctggatttctgatttctgctagcaaggtaacactgtactcctaaagaattccttaccagcttcaggttaatatactttctaagattgtactttagcccaggggaatccaaatgccatcctttgctgctgagagcatcttaaatcgctacctgactacaactgcattttgtggggttttgtttgtttgtttttgctattacaaattaactaactttaagatgctgcttaaacagaaatccttattgagatcttacagccataataggttcattgtccaacgtgcgtggcaagtcaatacactgagataccaggttgcagcagagacagaggtttaattgtacagctgctgaactgggggaaaactcaaatccatctcccacaggagtttggggttggagtttttaagggttttgggtgggctgaaatatggagattgttgatgggtcgaagagtgcagggtaaagtcgtgggacagggggatgaagaaactgtgttctcatgctgatttggtggttcctttgtgggagtctttaaactggttggtgtcagctgtcccgttggaattcaggatctgctcatgcaactctcaaacaaaacccttaggattctaacatcagacatcctatctatctataggagcaatggggatgcaaatggtgagaatctagtgctatgtgacttggttacaagaaactaggtcaaagagcagcatgttaatgcttaattatattttctgtccggaattcttgttaacccagtgaggacagcttcaatctctgactgcacgtagcaggtggaatgattactccagtactcagattttgtgggaattgagttcctgctatgcttattttgtaaatcagcttctaatgatcactctagtgattctctttattatgcagtttgatacatcacagtactgatgcacaggccattctaacattctgttgttggtaaagacatatacatgtgagcatactggcttactaaacaggtatgtagcaaagctaatttgaagcccattataaaatgtagaaattaggctaggtactgtgtggctcacacctgtaatcccagcattttgagaggctgaggtgggaggattgcttgagaccaggatttgagatcagcttggacaacatagcaagaccctgtctctacaaaaaaaaaaaaaaaaaaagaaaacaaacttagctggttatggtggtttatgcctgtggccatagctacttgggaggccaagacaggagattacttgaggagttgaaggttacggtgagctctgattgtgcaactgcactccagcctgggcgacagagtgagatcttgtctcaaaaaaaggagaacttgagaggaaatacgtttgtatagcacatagttatatggggctttggttacatattagtgttaaaaacaaaaagtgatctgaatggatgtatttattaaatgtgacagggaatatatatatataaaaagcaaactttccctccattttaatcaatttgcaaatattgagtttcttcagtttgtctaaaattttaatttctaatcattctaacacacttaattgcctacatgcaaacccgtgtaaaattctatgcctctaaaagatagtggaatatttgctcaaaatattttatctttgttatctatccctaaggaagaaaacacgctccaaaggttttttacattttatgtgtttttatttgcgtaactgtttaagataacaaacattttctattttcttttctttgccttttatggttcccatggatggcccaagtgccattctacgctgtcttacacacagagaggatgatgatcagggtggcttgtcctacaaagcctgggagtggccttggcatgctgtccagcataccttccaggaagcatctccgtcatttgtttcagtagctggaatctgcttatcttgactgtgtgttaatgttctgtttactatatacaccccaacccccttgttctggccagaaaaacaggtcaatatgactctgtaattattatcctagtcacatttcattaataacttttgttcgttccttcttttattccttctttcagagaacttgtggactgcctactagatgtcctgccctgtgctaggcctaaggatgcagaaatgagtgtgactcagtttctgcccttgaagaatgacctgaggaatttatactgtgacaggggggacaaacatccaaaccagggcgtccgatcttttggcttccctgggccacattggaagaattgtctcgggccacacataaagtacatgaatgctaatgaaaactcatgaacgaaaaagaaaaaaaaattgcaaaagaaatctcataatgttttgagaaagtttacgaatttgtgttgggcctcattcaaagccatcctgggcagcatgtggccgtgggttggacaagcttgatctaagcagttcattatagtgccaggcagaggcagaggtagaaacaccagtgctgtctgagagagctctggctctgtctgagggagggggaaagattttactggagatggcattgtgagctggacccacaagtccatccggagcactgtggtgcactttaggccagaatcctgcaaggctgcggtgtgttagtgatgtacacagtaccccattcacacaacctatcttaatgccaaagaatgatagaaaagtgcctgtctgtgtcctcagacttgcatcagtagtggcctgctgagggcactagcagcgttcctccacccgaaccacccacacatcagggtctccgctttgcctgcctctcttctccgcagccgggggagctgtggctgctctgggaaggaagggcctgggtctctggaatctccttgcaacggctcccaggacccctttagaaggtcatgacctgtagtttcataaatactcctctgtttatatgagctcttgcccctcaacccccaacccaaatttagttcccagtatttttccagggcatacaaaatatggagcagagcttatttctgcatcccgtttcagactttcattttaggttttttttttttttttttttttgtctcttttgtggttatattagatgattttcagaggctctcagggaatcctgaatcatgtccttgttggggggaagggagattagttttgaaatagactgacagtgcccctctcagcactttaagtggtttcaagacaaaaccattgggaaagagcttgataccatttgaccaaggagaatggttagttgagtgccccaggtcaggatggggaccctgggtgtgtgtgggggggaatgtgtgtgtatgtcaagatttcttgaattcagcaccaactgattaatattcttctagaaattcagagaaatataaaaataaaaaggaaaaattttaaagctccacacccagttctctaaaaatattttgagggaatctttttatgccaattcccaaatggtgaaggacaagcaatggtgaataaaatatcagctgtaggggttccttagatcagaatatactttaaatactgcagcagcaactaagtaaatactgttcccacccctagcagtcagttgcacattttagatccatctggggtcaggtttgagttcctaaaagtcatattgcccaaatgtcagtgaaatttgagttcagtgggaccctagtgtcctgaaataggtttgtgcctttccatttgtgggtgcaaagtgtgggtgctgggagacccagattcaggatgttttcagttactactaacattgttgccaagtgggatgtctccttacccctgaagaggggacagatgatggctatatacagaccagcatgtgattttatgggtcttggttgtaggcacgctgttggagttcttttcttatcttagtgtaaactgattattgaatcatccatttcagagaattatttggtctggttttagataataagagtttccctggtagtgttttggatgacttcattgcttcatgaacagcccacaggggctgttctaagaatcagaaatgttgaaatggacctcactgacacgttagcaaaattggacagctgttagactagcatatcagttgccttgctcactttgctttttcgttcgttttaatgaaccccagaagtagggggtctaactaattcatattctgaaatctctatggtagaaatgccttgcatctatattatgaatcttgggaaattcaaaacaattttcataaggaatctttccataaagcaagtagggtttccccctcttcctgtaattcattttcataaagtaatctacagagtttgagacaatagatagtttttgcttatcaaagataacctttggagaacccagaagccttcactataacaaggtccagaaaagattgtccttgttattttctgctgataatgtgagcaaagacgttcttcccaagtgagagatagggaggtagtgtttccactcagaggctttgtgctccttagagttgtccttgactttgggcaaagttgtgttcagattccccagaaaaacactcagaagatctgctttgaatttctttataaaattgtatgtttgttgcattgcacaggtaactgcagaagacctagtatgaatagatgttgtagaacaggttagaccaattaactcttttccatttaggggaagaatcagcaatgtatgagggatggtgttacataagggatgtggcagatcagatttgcttgcattttctcacaccatcaggaataccgaatatccagcactgtttgaaaccagcatggttagaacaggaactcttggattaggcttcatggaccagtttgtggtcaaagtacgggtttcacgagaaactgcatgtgaaagtttttttagttctgagtcttcatctattaagttcttctgctgaaaggatgacatcttaagaccagcggtgtaatttgtagtttaattagatggatccattttgttaccattgttgctcttagaactttcttactcttttacgatggggttcttaatctgggttaatgggtgcctaacggggagttcatgggccctgcaatgaatgtaattccctgacattgtctgcaaaagtttgtgtgatatggatgttttttgtttggtttggtttggtaaggagagggtgcacacatgcattcagttctcaaatgttccatgactcccaaagatttacaaagaagccagtggtttcgagactggtcattgctgctcctttgagctgcatcccctttggttctaccagccttcacagcttgcatggtcccagtgttcaattccttattacttatcagcccatagacaaagctgttaacctgtatttttatgtgtaaatttgacataggattgatggtcaactctttaaactactgtttggatttccaagctggagatttctggatactctttgtatcatttcttcatgggatatttatttgctgtagtctgcctcagctcggcctttagaccatgagcactggagagtgtaaccacaaaaagcttcaggatattcttatatttgtaactgtagtctaccctgagctataattgatcctaaggaggattttctttttcttttcttttgtctttttttttttcccccaagcctgggagaaattgagcaacttagccaggaattctttgagatattgctgtgtgttctctctacatttctggaagcttttataccatggttcttttgttagctgttttggttgtcctttatcttcccttcagcaagatttactcaagcgggggaagcatagaaaagacaggttgctgagggattaggtgagcaggcacttgcaggactcattgtccctgccaaatgatcttttaaagaaactattgggtatttttctttgaatttcccaattgtagtgtgaattcttctttgccaaatggcttttggggctctgcctggaccctgtgtgccagagtcagagattcatcttggccagacactgccacatattgaagagggagctgtttccaggaaagctcagagagctgtggctcctagaaatcttcccttgattgtatgagccaggcctcagcacttttgaccatctggaaaattttggacctgagcaccaatatctgtctcatagatctttttcttctcatttcatgagcttttataaaaaattcttgttcatttgaaatacatacttactagtattttgtagtatatattttgaccgaaacttctgcatatctatgagctctaagaagaattgtatgcctgaggactgcaaagaaaatcttcagaagaagggttgatgcagcccctgcagatatacattactagtctttgcatcattatggtactcagtaaatagtcttgaataaataaatagagaaaccttttactgatacatgctattagtgaaagagtgttgctttgcagttttcaggtacactggaacaaatgatgatttcatccctccttcattctccatagtgtgtgtgtgtctctttgttcagtacagtttgaatctttgcttctgctatttctatagcatctcttcttctcagtggctatcaatctgtttatttctagatgcggacagcatctccaaagtgtgctgtgaggtagagtctttacaaccaaggagcacattactttgctgtagctgtacttgacatcactgttcatctagtactttgatttagtgctatgcttatgccagatataaaaatgatcctagctgtgtgcagaaatagctcatgacagttggagtattgcttatttttgtatttttttgcaaattagccagctaaattcctttgaacctttttttcccctttaggtaacatataaatatatgaatttgctgtgataagtcaatatttattgtgtgtgtttacttcccggccttttggctaagatcaagtgtattatcgtgtctatgttaagcacagttttttgtttgcttgtttttgaaacagagtctcactctgtagcccaggctggagtgcagtggcacgatctgggctcactgcaacctccacttcctgggttcaagcgattcttgtgtctcagccacctgagtatcaggtgcctgctactatgcccggctaatttatttttgtatttttagtagagacggggtttttccatgttggccaggctggtctcaagctcctggcctacagtccattttggaaattaagacatgcattctcaagctagtgaacaagatgatgcaagttattcatagaatatttttgtggcattgaaaagcagagaattaaaacattattttgacatttgctgagtgcttaccatgtgctaaagcctgggttttgaaagataatgaaagtttactgttttatttatcaatgacctgagagcatactatgataagtgacattggtcataagtggtccctacaaaaaaaggtagaagtatgttgagatcacagtgggctggcagccattgggaaaatgtgaaatagtccagcatttagtgctgtatccctgatggttgtatagacacagatcgtggatctagaccatgtcatcctcatgaggattctagctgagatgtactattattcccagtgcatcattcagtctgtgtctttctagcctaagtccttttttgtcctgtccctcccttattactttatggttatgtttgatgagttcactctgtttaaatatgtgattcttgggtcttgcctccccgctctgtatggaaagccagtatgagacagactgtatgaaagtatctagtcaatatttccttatatatccctttgttctcctatgttcatgttgccctgggctcatgtgtgccaagaggactttgttgagtccatggtttgcagctccattcacaggtgctttttggtgatgttaatgacaacagtgatgacctgcaatagtccttgatctgctgtcaaaattggttacagtttttgtatccatcccatggttttcttccctgttttttttttttttttttttttgacaggggctgtatacaatcactctttattctgtgtgtcctctgtgcttcatttctttggaaaagcccttcaagctaaaagctgagacaatgaaagccctggcagcctcccttggcagccgctttttctcagctttcggcacttttctttggcagaacccatttcactttatagaggttggagcttacctggaggagaagaaagtcatttctctggagatccagagggatgaccccaccccaaggggattttgttttccaagtttcaccttagtcatttgacctaaagcttaaagcaggcctaagggaaggtaacttttgttccacctttgctgacttttagaaagaaaaaatgtgttctgtttatttgttctttggcagggagctaaatcatgctttggttgagattagtgtggttgactaatatgaaatagccattttgtagtaaaaaatggtcaaatattggcaatatcatctggttcaacttaatgtatcttattcatagaatctgagctacattatagcttgtttctgttgatagtgagttgcaaaaaaagtattccagaggctgctctgagtgattttcatggaaagccagggctaagatttctgccctctttctgttgcttcctaggtcacacttcacctgaatcccatctcctcagtccacatccaccacaagtctgttgtgttcctgctcaactccccacaccccctggtgtggcatctgaagacagagagacttgccactggggtctccagactgtttttggtaagtgcttaaacctcccccaaactgatccttagcacaaggacataatggtccttaaactttgccaaacttttcataaaggcttactttcactgaaataatgccagagtccaaagagtgttaaatttggaggatgcacttagtgatatttggatgatgacatagataagcattcacagaaagcagacacacctgcccatcttctgtgggcagaggctggggtctagtgcgcacattagagcaggacctgtcgtcatactctgtgtggcctgagctttggtttcagctctgaaaccccccttgtggcatcaggagccctgtaaatattgtaactggctaccgggtgtgtggtccctgaccacaaaatgaatatgcacggacccatactatttgtatataacacaggcctaattcctgatatgaggatctgtttgttgagaaagtgacacagtgagctccaaaatgaagtcatttgtattttattaaaaaaacaagctggaactcagctcttgtcgaaagatccaaatattacctactatttgtaaatcatgtccctttgagtttgccagaacattcaagtgtgctagttgtggagaaatcgatgggttgtttggatggaatttttttggtgtgatatcatgtctgatgatgagcagcactgcaacttggtagttgtaactcacattgtctattacgagagctgcaggctaatgtcctaactgcggtgcctgaggccttaaacctctcttgcccacaagcatccaaaacaagtggagtccccagttaatagttttcctcttgcctcatgaataaactttgcccagttaatgtctctcaatccagatctgtagtttctttcccctgtgtttgaagagtacttctaaaaactcaaaggttcttgttgaataatgtaagaatccatagtcaatacaattattataataagtacataaatgaataaaagggagaaaaggaaaagctcatctttatagtaaaatgccaactagaaaatctagaaggagcaaaggagttagaaaatgatcattttgcaaccatcataataaaagttgaccaggcaagaattatcaacagatgctaaatctagcagagatggagggagttcaggaagtagtatatttagatattcttaaaatatctttcatacaaattacttattaattacacataaaaaatagtgactatataccttggggatatcccatgataccttaaccaggtgattaaaattcatatcagcaatgtggggcagatggacgctgtgtgcctataaatgagagagaacacagcatcacttttgtggtatttttgccagaaatgcatataacctgaatctaatcatgaagaaacgctgacaaaaccaaattgaacgacattctataagataactggcctataatcttcaaaagtatcagtcatgaaagacagagaaaggctggggagccattccagattagaggagacaaaaagacaagacacatgtgatcctgagctggatcctgttgggtagggagtggggcagctgctataaaagacattagggggacagtggattgtattttatataaataaattataattgagcctatagattaaaatattatatcaatgttatattccttgaatttgataattatgttgtttttatgtaagagaatatccttaggaaacatacttaatactctttaagattaagggctaaaaggtcagatcattcaggaaaaaaacatgttgtatagagaagaataaagcaaatgtggcaaggttttaaaaactgatgaatctagttaaaagggtatagtagagtcctttgtactagcaactttgctgtaaatttaaattaatttcaaaagaaaacatttaaactcaaaaggtacatttacaaggtgggcattacaataactttattgtagccttttctgggaattgcaactcttattctatattaaaaaggccaaaaatcaaaaatcagtaattatttagttgttattactagcacatttatttagcacttaggatatttcaggtcactaaatgctctaatactttaattctcacgatagccttctacagtaccatagtgtagatcctttcttatagatgaagaactaagatttagagaagttaagtagtgggccaaatcacatggctagttacttgcagagttggtactcaaacctagatgggacccattctacaagctgttatgctaaactgtctgccttcgtactcataatcactgtcagtctcctctaattaaagttacttgtgatagtaatactaatggctctgatcataaagtcatatgcacatttagccctcatactgtagagctatactgtccaatactataggaaatagctgtgcgtggctacttaaattacagttcttcagtcctgcttagccacatttcaggtgcttagtagctatgtgaggctagtggctaccacagtgggcaggttatggaggcattatgagcaaaggcagtgcatgtcctggtttagatccaagcagtgaccttgggcaaattaatttctctaagccggatttttctcaggccctgcatcatagggctgttatcttgagtaagtgagatcacatataaaatgtttatagacatcacctgctgttgctgctcttatttatttctagtcacagtaaagagcatgtgggacgggtgttgaatttgcatctgtatttatgaaatatctagtttggctggccccagatcaaaaggggttctgtttctctgggctataggtccagatgaaagtgtgggctacgtatgtcatagttgtacttatcgctgcctggattctttcttcagtctgccagttcatgggttttgacggaaagtgtcttactcttagttattaatttgctttaattttgcttaaaatctgtaaaaactgcttcttggtcatcagtttagacactaacaatgaaagaaggtggccgctttagtaaacaattgaacgtcagccccatttggatcaatcccatgtaaggagattgcagatcaagtaatgagcctaaaattaccaacacgtgggaggcagcatcaggagaagtcaaggatttaaattccaggacacctgaactctgctttgttgtccagcaggcttcctttagggaaaacggtttttttcccgtctgcacatttcttcttggcctggaagagacgatggaacatctgttgttcattcacgttctcacatcagcagacaacgagtgatgcaagtccttgcacaagctgggccactctccttgggcaggcttttcccttcctctctgtggcctgaaatgaattttagtttctcctcatctccttgatagcctttgccacagagggtctggtgatcaatagaaatccagtagtgtgttctctttatccatttgtatagttaagagttaaagtttggggataagataactaaattattttatataaagtgttcatcaaacacttcagagggcccacgggatctctggaaattcaggcttcaccgttttcatcactgtcttctccgaggttacccagggagcctaaaggagctgtggaaagcgaatgggtctcttgactctcagtccacgatgcatgtatccttgcctgtttcctgatatgctgctggatggtttgcatttctgtctcagagctgtctactgtgtacgtagagttacagaacttttaactgtttttttttaaatagggcaatgagaaaagttcaagtaatagcatctactcatttatcagggtgacctttttatttaaatggacatgtctgtgttgttatgactgcccaaattaaaaaaggaaaactttcataattagttaggagggccttatgttacccaggacatcgcagccacccttgagggtgactgaaaacatactttaatactagtaataaaggcatctgtctttttctgtcaaatcatttcagtccttctcaccccctcacagcacaggcaagaagggaacgtgtcaggcagggagaaagtgggatttggttttctctgcaggtgcagctcctttatctggttattctggttacctaggaaatatgagtgggatgaagagtgatgctttcaggctgagtttcaagtagtgaatctttgagtgtgagtcacacacacacgtgatgaagttgtaataatcttatagttttccttttgcagggtgtatgggtggcccagagaacaatcagaaataaaaatcatcttaccctctcagtgtgccatgttgaaactgcaaataatctcttagaaggatcacataagcctgtttttatttatgcattcatttctacactgaaaaaaaaagtaagataacttaactgggtgatgatgcctgaaccttcaacctgaatttgctaaaatgagagccacagtatgaagttgtctttaaggacatactacaatttaaatacacggtttctagagaaaagacacaaatggccaaaaaacacatgaaaagatgctcaatatcatgagtcattagggacatgctaatgaaaaccacagtgagatgccacttcacactaggatggctttaataaaaaaggcgataacaagggttgtgaaagctgtagggaaattggaacacgcatacattgctggtgggaatgtaaaatggttctgtggaaaactgagcaaaacacatgtccccaagaacttgtccacaaatgtccaaagcatcattattcacagtaaccaaaaagtggaaacaacccaaatgtctaccaacagatgagtggatgaaaacagtgctatatccatataatggaatattagccataaaaaggattgaagttctgatacataccacaacatagatgggtcttgaaaacattatactaagtgaaagaagccagatgctaattgtcacaagttgtatgattccaatttatataaaatgtccagaatgggcaaatctatagaaacagaaagtagattagtaattgccaggggctgatgggaggggaaaatggggaatgactactaatgatacgagatttcttttgggaggtgacaaaaatgttctataattacatagtggtgaatataccacaccttgtgaatacacacagaaacactgaattgtacagtttaaaaggctgaatattatggtatgtggactgtatttcataaaactagtaaaaacttgctgcagcacttttttttttttttttttttttttttttgaggacagagtctcactcccttactcaggctggagtgcagtggtgcaaacatgcctcactgtagcctcaaccttctgggctcaagcgatcctcctgcctcagcctcccgagtagctgggactacaggtgcatgccaacatgaccagctgattttttttggtattttttgtagagatagggttttgccatattgtccaggctaatctcaaactcctggtctcaagtgatgcacccactttggcctcccaaagtgctgggtttataggcgcgagccacagtgctgggcagggactaggtttttaaatgtatctttttactttattccatgtacctgatttttttttctttttttctttttttttttgagagagggtctggctctgtagcccaagctagagttcagtggcatgatctcggctcactgtaacctctgctgcctgggctcaaaccatcctctcacctcagcctcccgagtagctgggattacaggcatgtacccccacacccagctaatttttgacttttttttttgtaaagatggggtttcactttgttgcccaggctggtcttaaactcttgggctgaagccgtccacctgccttggcctcccaaagtactgggattacaggtgtgagccactatgcccggcctctaattttttttttttaatcttgctttatttgtattccaaacttgagcattctctcctgcaaggtctgtagacttggagccctaggacaagcagacgttttcaagatgagaccctagtgcctggcttttaataacctaaaatacctagtccagaggccttggccagcttacttatgtcaggcttagtcactttgcatgctcataaggaaaaaagggtatctaagattagaagtttcaagaaataagcagcttcttccaacctcattcactctcgatattactgtgctgtgatctatttttttctagccatttatcattaaaatcagagagcaaatgtatgtgaatgtgtgtatgtttgagtgggggatggggcatagaaggggattttggtctttgaggtacaattgctggagctggcatataaaaatagaggatgcccaattaaagttgaatttcagataaataacaaatcattttgttagtgtgcccatgtagtatatgggacataacatatactgaaaaagtattcattgtttacctgaaattcaactttaactgggtgtcctgtactttattgggcagctctactcggaggtaattcaggtttttgtttccagttaacaccctggcctgggtgttaggaggcctgagtactagtcttggctctgccactaactagttatatacatcatcgggaaaaaaaatcacttaactactcagacctcgtttcctcatttctaaaatgaggggatcgtactagctcatctctaaagttcctcccagcttttaaactctgtgattctttgatagtacgactgctagatgttatatcccaatttaatttggaacagaaactggcaaattgagcattgcctcttcagcaaatccaagtaaatatcaaggcagggcagttgcaataaatgacagaaactaaactctatgctattagctttggattaaaaacaaatcaaaacttaatcctaatgaaaaatgtaaattaataaatttaaaaccagttttgtattttcaagaagcggggagggatgggtgaagaagctggagctgccaacatctagtttattccttttacttaaactagaggcattaaaaaaaaaaaggtccaaatattttgggcctctgccaccaaaccacaggcagttctctggtctgcactggagtttggatgactgacaagactcagtgaaaaacaagtgctatttgttttcctgtgcctagtatttaactggaaatcagaaggctaaatttccaatcagttgctaaatagccccagatgtgtgctcagtgcagcactaggaagggacacgcacagcccataccaccgtgcatgtccagctgttaccttttcatgaagccaagtgatgtgtaactgagggttgtagtgtctgtccaaaaacgccctaagaataactcagacattcaagtttgcttgtggagaagggaactttttttaaaaaaaattctgtattctattgtgttacatttaaaaatctggaaataatttttttctttgctaatttccttctttcccttctttggcagttcccccacccccatgtttagaaaaaaacacagaattagcataccgggtatgatggtttatgtatgtgcttgttcattcatccaacacacagtttttagtgcctgactgtgaactgtgctagctgtggaggatctagggaaaactggggtgaattgcctgtcgtcagggagcttcccattgtgtgggagagctgattgaaaaattgggaattgcagtttagtgtgctaagtactattacgctaaataatagtgaaaattggagaagatgagaatagtagaaattggagaaaatgagaattctcttcttccaaatgcaatcaaggcagcttcctgcatgaggttggctctggagaacagcatgtggcaaatgggtcaaggttgcagacacaaacacagctcttggctcggccagaagcattacccctgtattccagggacccggatataccagtttgtgttttgcagtgaggtctttccccagataaattctctcttgaagggagattaaataactaaatgtttcaagattgctggtggttcttcttctttttttaaatgtctcttgtggaatgactcattgtgtcctgtgggatattccaagtggttgtgtaccatgcatttttattccggagtctgctcatctgttggttttgtggcttgtccttaagggccttaattatatgggtcttgatcctctcatgaactagggtcagtcaactaccctagttcaaacaagtcattcctgtttcctaggaataggagtttttggccctattgtggccattgagctcttcctaaatgtcactatggcaattagaacattggaaagagcccagtttcaactggtaaacctggtccagaaggggtttttgaaagactccctgggatttattctaacttgctaggttaaggctggtgaatgttgtgagtgagtgaatggcccgtggcccctgggagatttgcctgggtgtatttttcctgaggaagacctactgtccaggagggttcacgcaagtgtagacttttcctggctctggctggacttgcgtcatgtctgtgtgcaggcatgggttgcagccctgtgaaggctttgctttcattcaacaaattgaggtcaaataaactcactttcactgaggaggcaaggttggtgtttcttcgtgtggagtcccataacgtcttttaaggctttattgtctaaggctaatctggtaatcagatgcatctgcccttcccaagtgttgggcaattgtatcaaatgtcacatctctggtgccctttgttgacgtggtggccagcctccagagagctgttcggtagaaaaagtgactgttttgttaaggaaggttgcagaatattttatttccatgtaataggaggggaaagaaaccccaactgtctaccaggagactctgggaggctgacttgaaggctgtggctgtgccttgttccgctcataaattatagacagtgatgcctttggtaagggttctccacaggtgacctacactctccatctcagaaagcaactccaggatggtccaactccttcctggacacaggttgttgggtttatttgaggcaaattggttcttgcacctcgagtccacattatctaactctagcttggaagctacttctgatttcgcaggggaggaaggagtccctttagccttctaatttctgtgtctaggatagaatttgcttttctcaagatctgcttttgccttttgttcctaacactgtatccttagatgacccagggtctttgttgcaactgtgggtccttaatgccactgtgctagggagtcaccattggtttgcctctgccttgtcccactgaggtggtgaatgacacagtgtatacctggaagtcagggggtcttccgtctgccacctctagcaaaagtctcacagtccatttgatctctggcctttccatctttatcacagagagcctgttcttgagattctattggttctgggtgatacagatggcagagtgatgttcagagctgctgtttggagccaagcctgccccaatccattaaaacagggtttttatatccttttcttgcagtttgtataagaaggctatggtcctgccatagtgaggaatgactcgtggcctgtcaacctcagcatctgtcagacaaatctcatggcccaatgtgaggatacatacacacatatgtgtatgtttaacaagcacttctagtgtgtgccgtgtgtgaggtactcttctgagtacttacatgtatgagcttagtcttcataataagcctgtgaagtaggtgcttttgttgtctttgttttaagatgaggaaactgagacaaagaggttaacatgtacctggtcccatagctagtaaacgggggctctaacccagggacagtgcttagtaagtactcagtaaatgttagcaataataataataataataataataataatactttccagaatggtaaatggggacctcattgggaacagtcacactgctgactcgagggcatgactatgattttatctctaactctggcctccagtctggagccactcatgactgttccaagaacagggcttcagaattgaacctatagagccaaatcagggcatcgcatcaggtgagcaaacttcttgtttcagcaaagtgttttatgcatgacttatttcagtactgggatctagatcatatcagtatttcacttgaataaagattttaaaactgtttcttgacccctttcccaagagctttccctctggggtcccagttggagcgtttctggatcagctccaccaggatgccctaatatctacatctatcctgaaccctgtggggaccgtttgttaattgatgctaaatatgtgcagttcaaccttctttgctttgacctaggagaccaccttgatcatcttcagagacttcaatgtagactgcaaaatgggtgtggcctgcttaagagggctctgcctttgcttcagagctaattttaggaagctcaaggaggctccaaccacagttatttcgggctagaggcctcacctccattcttgccctccaaggaaataccctttagaactttttttcccaaactgttgttaggtctgtggttcctgggccagaatatgcagctctgtttctcctagggcttgcaccagccattcccaggagctatcagtcagcatttatctagagaaacagaaccagtcggggatatatatatgaagagatttattacaaagaattggcttatgccattgtggggacaggcagggcaatcaaagtccgcagggaggccttcaggaagggcagctcaggcatgagcggaagccgctgtccacaggtggaattttttcttcctcagggaagccttgggtgtgctcttaatggctttcaatggattgaatcaggcccacccagattatctgatacaatctcccttccttagtgccacctgattatggagtttaattgcgtctacaaaatacctcacagtaacgtgtagatgagtgtttgattgcatagctggggaagatggcctagatacgttgacatataaaactgaccatcacagaaatttttaagatccttgagcaatttgttgttgtttactctaacttgacttctagccaagtaattatttcgttgctttaactgtttcatttctatttctgtctgtcccttccattccgttcctctccactctgaccagcacagctcctgagattgctggggaagaggggacagagagggaaataacccaccaggagaatctctgcaagcagcagtgaagggtgggagccccctgctttgcctcactgcttttccttttcactctcctctaagcctggagaatgttcctctgtatttgcctacccagacttggtagaaagcttgccctaagacacccaggtctttgctgacctgtgagccagtcagttccctcaccaacgggagatgacctttccaggcagagtgtccaccttcccacagtggaaagagcatcatttttggagtccagcagacagtttgaatctgcactcatttcttgctaaaggtgtgtaatctggcactttatctaattgctcagagccccagttgtttccactatcagatatgaggattcagaatccatgtgacatgcacttaggaagtgtgcagcctgagcttttgtgattaatatcatatttcctagtgttttattaacatgaggctgagggatgtgcgtgtctaccctacactactgatttctgagcctggtagctgactcttccacagcgatggaatagaaagagctctagagtgagaaaccaggtctttggttctattgtcaaccctgttgtctgccagctgtgtgccttgggtagatcctttagcttctgtcagcttcaatttccttctctgtaaaatggagttgagattatcagccttgatgaaaaaaaaaactctataaagagaattctaggaacatgtttggagccaggcatttgtaaaaatcagtttttgctcttgaacttgacttggctgattggatgtaacttagaagaaaaaaaaagagagtcttccctcctgtggggttctccaggagcacatttggaggacaaaattagataaaggaatatggcaagtaatagtaatgataccaacattttattttttttcgtgaaaaacatcatttagattgaaatgcactttgaatttgggggtaagctcttccatcaggctaacattggcagatgaggaagggtaaagttaggagtctgaagaattttttgtaaagctggacaggattcctgtgtggcctgggactctactttggaaaactatattagaaagcagcttgtgcttcatcagtttggtaacttgtggggacttagtttgttttttagatggaaagacatcttttgcttctctttgtgtatatacacactcacatgtactgttgttctgataacgtttccatgggagatgagagtattgcttttgtactggctcatgttcaagtttgtgcatgtttgtgtttggagggcagcatctcagagctttcctcttggacgtgtgtaaacatgcagggtgttaagaacatggggcggtttcagtcatttaggttttttttatatttcagcaaaaattaagaacaggatgatcatcatgaatgttttgagaaaaagtaatagtcaaatatgttttaagtcattttattggaagaaagtaatctggtttggggtactaaataaaatcacccaagaatttttaaatggctgcatggatttgtgtttcatgaatgcatgattggcagataccatcatcacatggctcatgaatatgtagctttgcaaattatgaacctaggttcacaggcatggaagttattatttctttgaaatgaagcttttttaaaaggcattgagtcatgatatatgttaatagaaaacatgtttcggattgcatttcacatcacatggcttcagaggaaataggcaagtggggtcctcccaggaattgggtagggagaacgtgtgattttcctcttttaaaatgcagggttcagtcttcatttggaaggtaaatatttcagtgctgttccagtatgtttgtttttgctggactttgtgtgtccaaaatacataaaagcataatctttgtaatgcctttctgtgtgggggctgtgatgagttctagggccaatctgtagatcccacttaaacctcaactgagattcttgaggaatacctattctcctttaccgtgtgtcttttccccctggaactgagccagcaagttcttggcatggcaggtgtttctgaaatatcagtgtgtttttctttgctttctttgttttccttgttttgctctttctattttcctaagcaggcaactccaaaaagagatttgtttgtgcaggagtcaggaaaagggaagaggaatactgaaagctgggagtagggcaggacagaagagggggaggagtctattttcattgtgtaagtgttgaacttccaccaatgccaaagtcacggacatgtgtgcagttggatgtgcgagttagagcagccccaagggcctgtaacctgaatagcaggcactcacccagctgataactcaagttccaaatggaccacagctgagttgtaggggatgtgtgtgtgtgtgtgtacgcgtgcgtttgagattcctggaacagatttcctctgagatctcaacaggctttttcattatcattggggagctatggtttctcttatttcacaaggcccatttcttccttttgagatgtgcaaggagatgactccatccatgacttggctttacactctccctcttggctttttatcatcagtgcagaggagagattcttgctcgttcttcaaacaatctcattcgagctttataaagattattggagtttaaataatattcatatctatggcctagaacaatgttcctcaagtatgcgtcagaatcatgagtggtagagggaggattataatgtagtttcctacatttctacctcccaccaccctggagtctgcattttaacgtacttctgtctgaggatcagactttgggaagcgttgggcttgagatgttttcttgacattgatttatgttgagaccagaccaagaagcagatggatggacatgatcagttcataaacatgttcctttcttagggtcaaattggaggaggctctagagaagcactgtccaatagaaatataatgccaacaatatatgtaattttaagtcttctattggtgcatttaaaaagtaaaagaaggctgagtggctgggcatggctcctcgtgcctgtaatcccagcactttgggaggccggggtgggcagatcacctgaggtcaggagttcgagaccagcctgcccaacatggtgaaaccccatatctactaaaaatacaaaaaattaaccgggcatggtggcaggtgcctgtaatcccagctactcgggaggctgaggcaggagaatcgcttgaacctgggaggcagagactgcagtgagctgagatcgtgccactacactccagcctgggtgatgagcgaaactccgtctcaaaaaaaaaaaaaaaaagtaagtaaaattaatattaatgacactttgtttaacccagtagatccaaaataatatcacttaaacttgtaatcagtcaataaaaattaatgagatagggatttttcttgtgctaagtggtatgcattttacatttatataacacaggtcaatttaaccagcaacatttcaggttcaggtacttgatggtgccatgtggccagtggacactacattggataacagctgtagagcaatgatgccttcgctaaccccctggcagacacgtggttgctcatggcatttgttcccatttctccactgctcctgaatatgacctcagaatccttctcagcacagaaccttaggcaggcactgccagttaattggacatcaagatttgttttatttatcaaacaaatacttaacaagtatcttttttgtacccaacacttggggtatacccatggacaatgcacactaagatcccagcctctgaaggaaccttctagtggaaggagttgggcaataagcatattatatggcattttagaaggtgacaagtactgtagaaataaaatgtaaagtgagtttgggaaaatcagaattcctagagtggggctgggtggtggggttgtaaatttaaatgggcccattgagaaggtaacatttgaatagacttgaaggaggttgaggtgaaacttaagatgagacttaatatccacttttgatctagggtggcctgaagtttcctcaagacttcatctgggagcattctttttggggtaggggtcaaggaggcaggaggatggggatgtgtggcactatccacagcaagttcctctcctcaccactgaagactaaaccaacgttggggaggcccagagagaggctacaatgcaacctgccaggtggtgagtcagctgatgtgctaagtgctaaagcaaagaacctcagtgccaggaaaatggtgtctgtgctcattagctgggacttgtacacttcactcaggcttgggagatcaaccttgaggcttccgtggatccgctgaggactttaagagttaaagcttaaagacaggtgtggaaacaaagggctggttgcctctttggcttttttcatgtagttttggatgaggttgttgaacctgatccagaaaaaataataaacttggctgtggttgcctagccgtaagttcttataataaaactcccagcaattggcagatagagtaatgttctgctctttaaaaaagtctggtagcataacctgaatttcaaatacaaatgttgtgcatggttcaagtagggaggagcattcaggagagtccagggtgcacctcagcatcccaggatttgtttgactgtaaagtgcttcatggttccccttcaacaaacgtttactaggaattgggacccttggagcccagtgctctgttcattcccacaggaagacatttgtcatgtcagggaatgttagaggattgggttttaattagcaagcaggaggaaagttcattgggttgtggggaagacatggaattactaaatatgctttaataattggtttttaggtggagttattaggtgaaaaatcaaatcattagctttaaagcttggccaaaagctcatttcctgggcagtaagggaagcaatgagtttgggtaatgggaatgaatcaattatggtgtatcttttcctgtaggtaacaacattgagctttcattcaacaagcaattattgggtccttgcttcatgcccagcactatgccaggcccaagggattcagaatgaacaaggttttttcttggccctcgaggtgttgctctttgtcaaatgagggtggcaggtatgctgataaatagttgcagtccatgtgagagagggatggactaaaggtctgtacagtcacttgtgtgcagctcattgtgaggagagtagggagcctgggaggcttcacagagcaggtgatactcctgggaggacacagaacggtttgccatgggagcaaggtaggatagacgggttcaggcagggtgcagggtgtaaaaagacccaggagtgtgtggcagcatgatgtgttctacaactgtgagtagttcttgggtatgtgggagggtggcatgagatgagggcgggcagaggcacttcagtcatgcgccatgttaagatgcttaggtgccattccgctttatcatgtgtttactttttagaaggattacccaggtgacagtgtggaggaggggtagaaggaacaggaatagcggctgggagggtagaaagttactgcaacagtttggttgagattataaggacccaaaatgggacagtgttgtggcaagcctccagggataaggtggaagatggggcatggaataaatagtctcctcctctggcacacagctcctccaaccctcatcatctctgaagtgttaagtacctttttgtatgctggtgagatgactggtggctggggctcctggatagcctctggatgggggctggttgccaagggaaccaaccatgtgattagaggttagaactttcagcccacccctctgaaggaggggagaagggctggagattgacttaatcatacatgaccaatggttttatcagtcatgcctgtggaatgaaggctccctagaaatccctgatctgtggggtagggtttggagagctgctggttggtgagcatgtggaggtgccggggcgtgggggagtggcgctctccgagagggcacagaagctcctcaccccttccccgtaccttgccctgtgcatctcttccatctggctgctgttcttgagttgtatcctttatcataaatgaataaacttaaaagtatttccttgagttctgtgagccattctagaaaataattgaacctcagggtcatgggaacctatgatttatagccccactatcagaagcatctgaagaggggcagtcttgtgggactgagcccttaatctgtgcggtctgacctatctccaggtagatggtatcagaattacatcgaaatacacagcatcaattggtgttctgagttggagaattagttggtgtgggaaaaacacccagacatgcgatgtcagaagtaaactattgagagtggtgtgagcatagagaaaaataggttgtttttctcctatacactcttgcagttatcttccttgcagtgatgattgcaaccctttctcatattagacaaaattattttccctacatttcttatgtgttttgctattctctttatatcctatgttcttctacaagccagactctgataagggtgctatgccatgaaaattaatgcagtgtctggagcatggactggtagactagaggaatgacctggaaatatcttgtcttcatttcagcaaatgatatgatttgggtctatgtccctgcccaaatctcatgttaaatagtaatcctgtgaccgggcacagtggctcaggcctataatcccagcactttggaaggctgaggcaggtggatcacctgaggtcaggagttcaagaccagcctggacaacctggtgaaaccctgtctctactaaaaatacaaaaattagccgggcctgatggtggacgcctgtaatcccagctacttgggaggctgaggcaggagaatcaattgaacccgtgaggtggaggttgcaatgagccaagatcatgccattgcactccagcctgggcgacagagcgagactccatctaaaaaaaaaaaaaaattgtaatcccagctgggtgtggtggcttacacctgtaatcccagcactttgggaggccgaggtgggtggatcacctgaggtcaggagtttgagaccagccttgccaacatggtgaaacccgtctttactaataatacaaaaattagccggatgtggtggcacacgcctgtaatcccagctactcgggaggctaaggcagaataatctcttgaacctgggaggtggaggttgcagtgagccgagatcgcaccattgcacttcagcctgggtgacaagagcaagactccatctcaaaaaataataaataaaataaaataaattgtaatccccagtgttggaagtggggcctggtagtaggaggtgattagatcatggggatgggaagatttcctcttttgtgctgttctcgtcatagtgagtgatttaccacgagatctggttatttaaaagtatgtagcacctacccactccctctcttcctcctgctcctgccatataagtcacgcctgcttcctcttcaccttccaccatgattgtaagtttcctgaggcctcccagccatgcttcctgtacagcctgtggaaccatgagccaattaaacctcttttctttgtaaattacccagtcccaggtatttttttatagcagtgtgagaatggactaatgcagcagggttcttggtgggttgtagcatgatgcccttacaaagatgaggaaggttctgtgaggtcccttggtagttggctgaacaacctggaaccccagcaaggactgctaatgtgctcaggttagtgtgggagtgtacgtatgagtcacagacttcagccttgtcttggtcaacctctcagggatttagatgaaagtgcagaaggtgtgctataaaatttaattatttatagctaataaaataaggatttttacatggtctcttcagacttgaaatatgggtctgaagaataactataagactttgcatttattttgggagaattatgggtataaggataggatagaaaagcctcgaactggtgaaaagaccttggggggttaggtaccatcatctctaccatccttcctggtgtgagtgaccactgtttctcacctgaattattccggaagtctactaatgatctcctgctttttgtctccccttagactcaacatagcagccagagccatcctgcgaaaacatttggtagatgtttcaatagtccttacaacggtctacaaggtcctgttgggcctactggtctcctctgggacctgtgtcctaccaaccttgcctcagccctgtgtcctaccaacctcctctcagccctgtgtccagccacactgacctccttggtcttccttcaccatgtcagaccttacacttgctgcgtctcaactgtgaatgctccttgccctgatgtttgtgtggtttgttctttcgtctcctttaggtctttaacttctcagtgaccttattgtgctcctctggctgtcttattagactttaatctccataagggcagggaattttttctgtcatattctccactgtgtctctccactgtgtctccagcatggagaacaatggagtaggcaggcactccataaatctttgttggctctatgtttaaagcatagattagtttattaggctgttcttgcattgctaaaaagaaatacttgagactgggcaatttataagaaaagaggtttaattggctcatggttctgcaagctgtacaggaagcatagcaccaacatctgcctctggggagacctcaggatgcttttacttatggaggaagatgaagcaggtgcaggcacttacacatggcaaaagcaggagcaagagagagaacgtgtgtcgggggaggtgccacacacttttaaatgagcagatctcacgtgaactcaagacgagagttcacttattaccaaggggatggcctaagccattcatggggggatctgcccccatgatccaaacacctcccaccaggccccatgtgaaacgttgggggttaccattcaacatgagatttaggtggggacaaatatgcaaactatatcaattagtaaatatgagatcatagcagggttcagctgatgccaaagctaatgtggatgcttcatgcagtgttcacatatatggagaaagagatttattataggaattgtctcatgcaattatagaggctaagaagtccaaaatctgcagagccagtgccccagttccagttcgaaggcctgtaggctgctgtagcaccgggaagagctgatgttccagtttgaaagccatcaggtagaattcttacttgtgagagagtcagctttttgttctattcaggccttcaactgattggatgaacccatacatgtcagggagagaaatctgccctactcaatgtactaacatttaaatctcatccaaatgcatcctcaccaaaatacccagaataatgtttggccaaatatctgggcacctgtggcccagtcaagttgacacataaaatgaaccatcacagtatgcttctcagaccatacctggagaccttgaatcttgtcccgacaccgtctttcagagactatcctgttgacgctctgacaaccagggtatctggggcagaactgaagaagctaggggtgttgccctgaaaaagcaaacatgtgattgaggtcagatgacacctttaaacacctgaagtcttgtctcatggaagaaagacgaaggaattctttgttctagtaggcatggctcagactagtgtataaaaaatgaatctaacagaacagaaatctgctgtcttgggagctagtgaggtcttctttctggaagggtgcaagcagaggccagctgtgaccaggagtcagaagtcttaagttctggtctgggcctggtgcatgactctctggccttgggtaggccattagactctctgaggtttccgcttttctgctgtagaggtcaccgtagcctgcctcacagttccgcaaatcagatggaaataacatctgaacaataccttctaaaacaacaccttctaaaactcagctgtagccttgtcagggtcaggagagctggcagtcaggaggggagtgctagctcactccttgctgaagctgaaaatttccactgacctgcagtcagggacacctcactgcagctttgctttcttcttattggaatgtgcctgaggagtggcagttaactccagttccaaattcctcagccctgagtgtatgaagcttattgctgctggcccgtgaggacaacaatgcctggagggagcagagggagttgttcctcctccacgaatcagccccatcaccagcttcatcacggcatcgctctttaattacttcaggacacaattcggagttgccgttgatatcttctgtatttgtgctgtttgctttcttgcctctggaatgcaccagtgtgacatcccgctttccgctctgaaaaacgtactctgtgtataatgtatatagggttgctgtagtttatggccacaacatgaatgagaaacaagaagcagaacatccagggtttctcgtctaaacattcagaactgtgctggcagtgggacaaaggcctctggactgttgtgggttttggtgacagccttgataaaaatgcctttttagtacaagtgaaaggaagattttactacagtgcaaaagtcaaaaaattagataaacattgttggaagttcagtgttgatgagtagctaagcctcagagaagttacacttaggtgggcatggttattttttggcaggaaaatgacctaggatttttttcttattcaggcgacgtcaaaacaaggttagagctacatgttcccctctggttttgtttataactggcatcaggacattcagaaatgatcgtgactacacttgacagcactgatacgtagtaagtgtgcagtcagtggtagctgttgtgagtagctttggtttacaccgagtttattagtgattaattcagggcttccacagagccctgtgtagttctacacagctaccactgactgcacacttactacgtatcagtgctgtcaagtgtagtcacgatcatttctgaatgtcctgatgccagttataaacaaaaccagagtggaacatgtagctctgtaccatctgtgtggcccgggcatcaggatatctagaaacttttcaggtgattctagttttcagcttgcaacattagtaggtcatggaatcaattaattgaagtacttttttttgccagcgtttttagaagatacgtttatataattgtatagaaaatattaatgcctagcacagtagctgggaaaatataattttgtgtgtgttaaaaatgctgctgtgatagaaccactaataaaatccctgccctcgacttgcttcttagtcttacttcagaaactgcatgcttttcgttatgaataaatggttcatgtgaaatttaatacaagacatttatagttctatgacctgagaatttgtgagccttcttgcccacattttgaggtttcactctgacattgaaaaaatcagttattttataaatgctagccaacaaaaatggcatacatattttcaccagcaactaaatttgattatagcacagcaacaagatgatgattttcctcctttggatgtgttaattacacatataccatgatatgctaggtcagcagtggtctaaatacattcagcaagaatgaggtacttgcatacgtcatcctgaaagttttattagatcagtttaacagcctcttgacttcattatctatgggaatttgggggtcttacacaataaactgttacaaacattcatctcactcttatgaaatagagcaatgtgatagaaaggctggcaacctttggccatttttatctcagtgctgaggtgaacataaaccaagaggactctcgctgtttccctattgtgatgactctgttggcagatgctgcaactgtggaagacctgaaagtcgtgatcagttgctagcaggactttgggatcacttgtcttgatcctgaagctttttataagcccacgagaacattcatcaaggcttcccacttgacttgaaatacattcattgtaagattggtcttcgatttagatttcttggaaatagcagtgataattcttacgattactcaatgtgcaatgcagtccgtcctcacaaggttctttcagagttcagagggacatcctgcattggtagttttgcctttgtctgggaggactaggcttgggattattccttgaatccgctgcttaaaaacgctgatctgcttgtataacaaagggaagaggttcgatttacaagcacttcgatttgagaagtactttctctaattatgattcagctccggtgactgcaccatgttaaatacgcaattctctttcctctaggtgtctgagggttctgtggtccagttttcatcagcaaacttctccttgacagcagaaacagaagaaaggaacttcccccatggaaatgaacatctgttaaattgggcccgaaaagagtatggagcagttacttcattcaccgaactcaagatagcaagaaacatttatattaaagtgggggaaggtaaattttatgtggcttcagttaatgactgatttatgacaggcaattgttttcttttctgaaaccaggtggttagggcaaggaatcacagaattacagaatgttggacctggaagggacctgaggggtcatttggccccaggcctctccaccgccccccatattccctcccttcttttttcctcctggggaagcaggcctggttatggccaagtgaaacacagggaggagcagggggagagaggagaaggttgttgtgtgggatttagaagacacccatgcacagaagtcaaaaaaagtaagtggaggtgagaagctgagggtgtgggaaggaggtgatgactgatggagtggaagagctggcagaatgaatgggtcagcaggtggcttcctcttacctgtgttctgcaaacgtttgaagcctgtgtcagtttgtggtgctgagacataggttacattttggacaatagcaaaggaaaagtatttaaatatatttttagtacaaatgactattacaaggacaaattattggagaaaagaagtgtagggtcttgataagagattgcctatttaaatttccttgcattgcaaagggatagaaatatccagaaacccagttttgaaagccttttttaaaacaaaaacaaaaacaaaaaaccttctctttctttctcattctttcattctttcattcttttcctccctccctccctccctccctctctccctcccttccttccttcaacagggtcttgctctgttgcccaggctggagtgcagtggtgcgatcagtgctcactgcagcctcaacctgcagggctcaagtgattctcctgcttcagtctcccaagaagctgggactacaggcatatgccatcatacctggctaatttttacaattttttgtagacacaggtcttgctgtgttgcccaggctggttttgaactgctggttaagagatcctcctcccttgttctctcaaagtgctgggattacaggcatgagccaccgcacctggccagacctttttttaaaaatcattattttcagttgagtatatttggaacccccataagttactaggaaataactcttgtgaatgggtccttgttatagctggctgattgtgtgaacactgcgtttaaggtcttcagcatccagctgctttctgttaaattctacagcagctgtcacctcctcatagacaagacagggaagggtgggttagtgaacacttgatcccaactcttatttggatctgggctgctttaaagtgtgtgagagacagaggcaggaaaggtggacgtggacgtcggagaggatgctacgtgcagaagccatttcaggggccttcacgtgcatcccacttaaccccacagtaaccccaggaggaagatgtcatttccaccgttttacagagggcttagtggagggctaagtgaacctgctcacatccaagttactaacaagtgacaaagccagaacacaaacccaggcttcctgactcttgagtttaacgcttgttgcctgagctgtactttaagtcctagccaaataagcataactcaaaaagggaagtggtccacctggatgaacatccttgtttagttgaggcagagagaaggggacttagaggagggctgggctcaaaaagtctaagtttgtttctgtactctcatgataggtagctaataacagaggtcaaatcccattgagacaaaatgaaaaatttcttttaataaagactctaagccctggccagcgggccgcgtttctgaagcagaattctagtagcatgaaagaatgttgattaccccttggaatttgttagaataagaaaatttgttataataacatttagaatgttggactgtgttctctcggcagtgcatgagcttctttctaagcacagtagtcacttaccctgagagccacgggttgtcacttaactggttcagcctgtgcacactgggtaggggaagccaacttaaaggaccttgtgtctggtgcagtaaaaactgttaactccttggtaacaccttcggaacccctgaaacttgactccagccaccagttgagtatgagtcaccgggccatgccgtggagagaggagcagtagggaaaggaggttccttggtgaggtcagtggaccataaagtgatatgtttatcaccacggctcagactgcactgagcaagcttcatcccccacttcccagaatccgacctggctctacctttcttgtacccagcgatcgcaggccatgaggcctggttgctctaacccgagcagttctcagagtgtggtttttgccccagcagcatccgcatcacttggggacttgatggaaatgccagttctcaggcccaacccagaccaactgaatcaggaactctgggggtgggacccagcagtcagtgtttcaatcagccctttaggagatctgatgcttgctgacgtttgggaactgctctcatctatatacccagaatgaaagaatttaagagttttgctcttatcccagctggtcttgctgcgaggcttcaagcaacattgacttaccaccagagcctcagtttccacagcaggaaaatgaggtgtttgcattaccccccaggttcattcctgctctcagagtatatccttctgtgtctcaaagtcatttgtcaatctttccctaaaatacaaataagcatgtgactccccctgcccccaaacttgccaggtttctacccgggaattcccctttgtggtttcctttctacttggcactcggtataagttttgatgccaggcattcggaaagtcattggggagcgggggagaaaccacacacaacaaaagtggtcagcttattcaacttagtgacaatggcttctgggactagagcccttaataacatcaacttttgaacaattagacctttcctagtggcttcacatgagtgaatattttgttatttgtctcaaatctcacatcattgtttgttaattcaggaaacctataccatatgcccactatgtgccagatacaagccaggcacacctatgaactggatatgccggccacaatcccaggagggccctagtctcttgagttccagactgtcctgtccctggcccatagacgctctttcttaattaaatttcaaccttgccgttccaatatcattttccatcctgtgatgtgggggaggcatccgcagggctgcagctgcacggtgtgcatacctcatttgctcatctggcaaaaccctcagcagatgtggagggaggctgctctagcagcctgagtcagtggagccttgagcttttctctctgagggggaggggaattagaggagactgcagagtgcaaacccaatgctctctcgcaacgagccgacaaacagaggctttggtcccctttgttctggggtggtgctgggggtgctgtggtggccagagccatgatgccccagtgtgtgctgcggacctcagcacaagggaggttgcacaagtggggagggggagggacagtatcaacccagtcttgggaccccctggttggattccttactccaaagtgagacttccatgtggacttgaaccctggcatcctgtcctcaaaatggaaaaggcagaagtctgttttatagtagtgccaggcctctgattaattatcccttctgaaaaaagcatgctacacctagaacttccttgacactggtcccagctgtcacactgccagcagtttctttcaagttctgttgaaatatttaagcccgtggatggaaatcccatcagccgccgtgctgtgtaaatggcatgtgccgttgtgggagtgtcttcagattctggtacttgcatcactttcccgggtggaggtggtgagcaactctcagcacagtgagataatgtttgcgaaagcactttgtaaactgtaaagtgccatataaacttgagttgtctgtgttcagattgtgagaaagagtgaaagtctgccttctttatttcccccaaattcctacctttcatcttcagagtataaagtgctgtgaggaatacatatgagggaaagattaattctacatggggtgtcggaggattaattaggtggttgcttctcctgatagttgaaataacaaatatccaaggaggagtgcatttggggatagaatggattgaatgttaaatacgctgaccatgaaatacataagtattggatttttagataggagatgcttggtagacagatgacagtataagtcaactgctcagaaaaggagtcatgatctaggtacaggttgaaaccatgggagtgattgagatcacctagaaaaagaatgagatagaaaggggattgaggaaggagctgagaagttcttagccttggtttatattggaatctactacgagcttttcaaaaaagaaagctccctaggccccgcctgggtgttctgaatcagattctctgggttggggtctatacagattctgagcagaggaggaaccagtggaagagatgtgaaagataggtcagaggaaacagacgaggacaggaagtatcacagagaacatgcaaggagaagatttagccaaaagaggcccctagttgggggctagtcaataggcggtcactggtgaccataacaggatgcatttcagggcagtggttgcggacttcacagacgaagaaccatcctttgagctcgtggttccctgtgtctgccatttgctcagtttcactgtcaccctccttcctttgaatctggttaccgagtacctcagtggtttgacagattgtcctgtgcctctttcagatcaagtgttccctccaaagtgcaacatagggaagaattttctctcactcaattaccttgctgagtaccttcaacccaaagcagcagaagggtgtgtgatgtccagccagccccagaatgaggaagtacacatcatcgagctaatcacccccaactctaacccctacaggtaagtgagtctaagtgtgtgagtgtgacaagagatgaaagtaaagatcttccttgacttgaggcagggagaggtgtagcccgtcctacaccctcccctacgcaggagggaagggagccattgatgcttcacgcaggagggaaggtagccattgatgcttcaggtgtgcttcatcagatgtgtttcacagaagctttgaagaacagagtaaaggcaccagtggtatattttatattctgcatctgtccctagatcccagatatttcagatgaattcctgaagcctgttccaaacttctgggtgttaattacaggacacagtcactcttccttcatctttatcacctctgactaaggttatccctgataggaaaattacaaaatatgccctattaatataattatcatcttagtaaccttctgtttttaataaagctctgtttgtggtgtccttagagcgcttaggcactcagagctgtttgcgttaaatctgtgtgtgtgtgtgtgtgtgtgtgtgtgtatgcgcatgcacgtgtgtggtggagtggctcttcatggtgccataccaaagagccattcgatagaacttgcctctcccttgtgtgcttggtgtgtgtgtgtgtgtgtgtgtgtgtgtgtgtgtgtgtgtgtgtgtatgctggagtggccctccatggtgacatacgaaagagccattcgatagcgcttgcctctcccttgtgtgcttggtgtgtgtgtgtgtgtgtgtgtgtgtgtgtgtgtgtgtgtgtgtatgctggagtggcccttcatggtgacataccaaaaagccattcgatagaacttgcctctcccttgtgcgcttgttctccctctcagcttcctacccctggattggaaattcgaccctccctatcaagaataattagggaattaaagaaaaaggagaaaaagtaggttcttttcccacatgagcctgcatttcaccctccttcctttgcatctggactagtgacttgaaaatttaaatgtatattgtagagggatttcgaggtgaaaatgctaatcggggtttgactttcaaagcgtgtaagctacagatcgttttgataagattccactctggccacttgaagaattttgtagaaagtgaaaagggaatgggaataggagcagtctggtgaatgtgcttcgacgtcaggcctgaggcttcattggagtataccatgcattttatgctttacaagtgtgtaaagctgagatggaaagaaagactgttcccttaaattcagaatgacagggatgttattgtttagtaaaaaattctcttttttacgaattcttagaagtttgggttgtgttcatcaattttccagtaatcacttggttgaccatctgttttctttattttaataaccttatatccagaagtttgggaaagtaaatgcagatacgattctgtagcaattgttaatgacttaagcaaaccttatataaatcaagaaattctttagccttttgtctcttattttactctgaagtttcctaatttttttttttaccaccatgcttcccttatcccaacaccccgcccccaactcaccaaactgccacctacttcagttttgaaggaatttgagcatattagccaaatgggaatcctgtacatcgaaggtgttgaaggttgaaaaagcaacaatactgcttcaaaagtaaactcttctggttcgttcaagtccacttcaaacagtggctgcattaagtaaccacctcttttccatcaaagaagagaaaaactttagtgactaattatcagcaagcatatgtttctattgttatgtaaaacaattttgttatgtgtgcagtaacaatctgttttgcacatgtcattggcctgggatcaactccagctttttaatcaactggccagacactagaaacatgaagacttggaagaggggagatagttgcaactttctggcatgtaggtcttaactttgcctttgtcttccattcacagtgctttccaggtggatataacaattgatataagaccttctcaagaggatcttgaagtggtcaaaaatctcatcctgatcttgaagtgcaaaaagtctgtcaactgggtgatcaaatcttttgatgttaagggaagcctgaaaattattgtaagttggtggagcatgtcttttgttttgtttagataaatgacaacaatttaagctgtactttataagtgttatttttaaagttcctgcctctttggactctctaagctctgtcaattatttttcactttgcaaaatagcatgctcctataaaataggtgcggttgttcaaacatggccttggattaagacggacccaggtctgagtccaggtaatcccactgtgacctttggcaagtcccctaacctctctgaaccccagctccctcatttgtgaaattcctgaaatacattagtatgctttccactaatagtaagtgtaaagtaatgaacacaattaagccttcatattgagcatcccacaaggacctcagtgtcatagtaccgaatatcagcttttattttggagttaggtacttagagaaagtatggactattaggctgaccccagctcacatcattgacttttctttttgagttaaatacgaaatattggcatgtctttttgcttgcttccaactcctaagtgtgaaacactgatagaagaatcacagtaagtgcgaagtcagtgaaatgatgctggacaagtctactccagcttgttcccaaggccctctatttaatagagatgtacgcacaaggcttagcccattggcatgatgggcaaacagcagctggtttcctcaaaagttgaatgttgaaacttggtaaagtaaatcttatctcaaatatgcttaggcaataactatttgactgaattatattgaaagttaaagaaaaatcctcctccctattttttaagaagataattatctctttagtatctcttctatgggctcaaattttttttttttttttttttttttttggccaatctctcttttagttcctgcactgagtaagctgaagtgggttttatgttttcagtattttgggagagggatgcccttggttttggtattattcattcattcatggcaccttccatgtgataccacagtgagcaaagccaacagttcccttggcaacgtcatgtaaaagcactcaccagaggcagcaggcaaaaccactagcacacatattttaattttaaagtaatcgtttctggttcccgtgggttttttttttttttataactttgctaggatcccagtgagccatcatatgtaatggtgatacattaatttgttgtcaagcccaaagcctagccatgatctgaagtcagagatgttttgattgccttctctggcatggcatgaggggtgttggtgacctaggctgtctgctgcttttgctgcctggcacaccggccaaatgtttttaatttcagaataacaaaaacaggaaagggaatcatgctttgaaaggcaaaaacatacggtacattttaattccctgctggagttcttgtgtaaatattctttcagccttgacccttcgatggctctttccctgagtatgtgtgcctggtccatggcagtcctggagttcactttgaatgtccccatctctcatatgaatcagaaaggctagaaatgagattgctcatcccagtgcaagatctgtttatgttcctctccttggctgtacgcttgttccaggccaattttggacaatgcatgacaacattactaaacaattaggtaatgtttcatgatgttcttttttattctcccaaccagtttatgctttgtgattttctaattccctgtttcagatgtgaattctgactgtgctgtgagggaaaggtacctgctcccacaaaagtttaaattactatttagaaagggggcaatggtttatagaaaccttgtttctagtatttcctttagagacagcatagtgaaattgaaagaatcttgactttgtgccagacagggctagatttaaatcccatttccaattactactcctagtagatgttgtgcagtctgactgatgaacacggagtctgtttggtcacctgtgaaatgggtatgatgatagtactcaccttgagtttgtggttcattagctgagttcatttgtttgttcatttatttgccaaatacttgttaagggcctataggatatttcacctaaagcactggacacagggcctgcgcatgtaagttctcagctacatgtgttgcttctgtgagtcttaggttctccttctctaacaggaatggtaatgcctatctccttatattttggaagagaaataagataatatatgcctagcagagtgcctgccataaaaagggggttcatcttccttccataaataactctttcagagtgtctataggaacaattagggcacttctctatacaaggtgaaaagaaagaaagatgtctactaagggaattgtaaggagtctgatggagtaatttaaagaagagcaccattaaatatggatgtcttatgcatgtgtgtgtcgggggtggggcatgggcagaatgtgtcctccagatggcaaaatggtcaaaagaggtgcaaagagccaggcagtgggcaagaatgggaacattggaggtgtctacattgccttgtccagctctggctcttttctcaggtcctgtgtggaccatgcataatcacttttatggtaggaagaacctctaaaacataaaaaaatagatggaggaaacctgttagaggtttcctcttatattatttcatgtggcctcaggacttcagggttgatgatgggcagcttgttcttagagaatacatttttaaaaatctcagtgggcatatgcactacgctctctggccattcccttccttagtcctccctcccctataccatcagtccagatgtaaatatgggggagtgtggaggcacttagacttaactccttatctttcatgaagatatggctgggaaagatggtggtggtttttggagacctccttgtacacctgcatttggcgtagctccactaaagctggaaaaagcctagggacttccagaagtacagtgtgagaatttgctcaaagctgggaaccaacttgtctgccattgtcccaagccttgctgctttacaaatgtgtagatagatgttgagtcttttaagttcccagacataatcaaaatgagatgtattgacagctcctagatttaatctggaaaggtgcaaacagctcattccacattggtgcaaaaggacaggtggcagttatgatgatagtgttctggaaatacgatattttctcagctgtccaacaacatgaaagagactagggcagatgagggcaagcagtgttgtttaggccaattgttgtgattccagccaatcaaaatgacatgtagctctaaaaggctggaagaagctgtacctaagaaactactgttgactgaatgcataaaaagttctaagaataaattggatctttcatgatctcattttagctctttccttccttccttcctctttgtttctttcctccctagcccttctttaccctaaggagtttttttctgaattggagtaagagctaaaatattctgaatctattaaactgagtttacaaatggccgcagaagttggttaaagttctgtctggttcctttgcatatagaatttgtgactggtgagtctggcagtattcccacacataagcactttaggtaatagaaaaatatactgaatgagatcctttaagatttgagttgaaatatatgtggcttcagccaatatcccacaaccacataggccaagagaacttagagcctgtgaatcttttagggttttacagtgggaaaggattaatatttagtcatgttaggggcaaacagaatgggaaacaaatgaggaatttaggaaaaatgctgcatgcatgcaggagaaaatcactgggcatggaaattaaagtgatttttatacagcacgaaaatggtgtaatctgcatgctggaagggctttccagccctgttggtgcagttgttgaaaatatggtaccttccctttggggtcccctctgcagcatttagctctctcaccctctgagaagagcactgccacaggagtcagcaactgatgtataaatttaccttccatgtccttgttgaataacctggttgagtagagtccatttatatcctttcccaaaaatatttctgtcattttaattttgtaattgattatccagtgaaagctagtcttttttttttttttttttttttttttttaaggcagggtctccctctgtcacccaggctagagtgcagtggcatgactatagcttactgcaacctctaactcacgggctcaggtgatcctcccacctcagcctcctgagtagctgggactgcaggcaaatgccaccatgcctggctaattttaaaatttttgtagagatgggatcttcctgtgttacccaagctcgtctcaaactcttgggctcaagcagtccttccgcctcagcctccccaaatgctagtattataggtgtgaagtattgcacccatccctgaaagctaatcttaagacctacttgtattactggataaaacagtgatacttaaggggagagtaacctaaattaattaattaatatttagaatagaagatacaagtatattcagttagtagaattggcaaatgaatacagttatagaattactaattgatcatacattttagatgaaatataaacattggttgttttaccatgtggaatttaatagtttatatagatgggatagtctccacactgaagtacagtcttgagcatataatatggttcagtcagtgagggaccacatatacgacagtggtcttatcagattgtaataccatatttttactgtaccttttctatgtttagatgcacaaatactgaccatcatgttactactgcctacagtattcagtgcagtaacatgctgtgcaggtttgtagcctaggagcagtaggctgtaccatatagcctaggtgtgtagtaggctctaccatgtaggtttgtgtaagtgcactctatgatgctcacacaatgactaaatcacctaatgatgcatttctcaggacatatctccattgttaagtggctgtaagtgattgtgctatctttcattgaaatctaggggaataggaagtggaagcatgggaatttgagggcaatataacatgtctgtttgtatactttatatgtcattttaagtaaaaaaaagggaaagtttattatacatatgtactgtgtgtgttaataatttaaacattagactaactgtacagttatagactaggcatacttagtatgtaactacttacatgtcattggatgattttttttatcagcataggcaatacaaatagtatgatcaagcagcatacgtagatgtcttttagtcggctattaaaggtttttcacatcatcgttcttagcccaaggaaaacaggggtcaaaagaataaataattccctcatatacaatatagaatctacttatttaagatatttaatttttattatctaaagtactgtttaattttagactcatgagtgatttttttgctatatcttcaggctcctaacagtattggctttggaaaagagagtgaaagatctatgacaatgaccaaatcaataagagatgacattccttcaacccaagggaatctggtgaagtgggctttggacaatggctatagtccaataacttcatacacaatggctcctgtggctaatagatttcatcttcggcttgaaaataatggtaagttagaagttttttaagttatgtaaaaaataccccccaaatgaagcttttccagtgaggaactgtcatttcagcttatatgttgctgtttttctcttgtacattttaataatttgactactttttatcagaaggcttaaaattacctagacagagattttgaggaaactgtaatacagattttcagtgacatagagttgaatgcatattcagagaactttgttataggttatctttagtgtgattacattaggttcttctctccgagacacctaatgaccacttatggctgagaatacagaagagttaagactgcaggaaagaagttcatggtaaaaggctgtatcttttaggaaaatagtcacgaggactcatacttgagtgttcatacccagaggatggcaggagttactaccccagctgaatggggtggaaagcagagggtcaacaaattcttgaggttttctggagtcttctagctagcatgacttgaaaccctagttttgtgatccctagacctgttcctcagctcatggtaccaccactgagtgaaatgccaatagaataaggattaggagtacaggttcaagccccagctctaccatttagtcactgtttggggagaagttgcttcacctctgagccacagatttttcttcagtaataaggggaaaataataggacagaccttacagggttgttgtgaaggttttcgtgaaagtacaaattaaaaaccctacaaagctatgacttattttggacccttacagctctagcgtcctttccaaagaatattattaaaggagagataatgtccaactatcatcttcacttccagcttccactgagatggatttgacctcaagtgtacatcagttggccttagatagtagatataaagaatactggggaaattattatttttttagttgttagaaatacgacaaaatattgagtattgattgtatggaaatacgtctctccctttgaaggaataaatgtatctatgcagctatttcttatctttcaagggaatatgttccaaaaggccaaggtgcccagatacctgttaaaatttagctgtcaaaaagaaggtggtgaagtaattttaacataccaatattgtttcaagacatcattagagaaattattcaaaagactctcttgattcaaggaaagtattttagtggcatttcaatggaataatattgcatcatgtaacttaaatcacagatttttctagcttggacagccttagaaactgtctgttccattggttctcagtcttaggtgcacattgcagttacacatggagagactaaaacatattaatgattgggtaccaccccagagagtctgagtttaaattgtttggggtacaacctgggcgtaggaatattttttaaagctcccaagtgattttcatgtgtagccaaagttaagaaccactgatcatttccaaccacttaatttaaaaaattggaaaagcaaatttgaggcacagagaagcaagccgcttgcctaaagccactgagctagttagagagaacaccaggactagaattcaggcttctagacttctaatgacctttatgcactgcttattaaaagtcattttacacctgcccattctatgctaattcctcctgttctgcctgtaatgatgttggttgtggcctggcatcaaacactgctgatgttttgccttcttctttcaccagcagaggagatgggagatgaggaagtccacactattcctcctgagctacggatcctgctggaccctggtgccctgcctgccctgcagaacccgcccatccggggaggggaaggccaaaatggaggccttccgtttcctttcccagatatttccaggagagtctggaatgaagagggagaagatgggctccctcggccaaaggaccctgtcattcccagcatacaactgtttcctggtctcagagagccagaagaggtgcaagggagcgtggatattgccctgtctgtcaaatgtgacaatgagaagatgatcgtggctgtagaaaaagattcttttcaggtcggtgcagctgattacaggagggaagagaggctacctcctttcccatctggccctagtctgcatctgtaatttctccctatctctttcatttttgaactccggaggcttgatactgttttctcagttggatgggcctacttccccttggctgtgattctcacctggttcctgttgttctcagtgacagggggtgggggttccagatccttgtgtgtcaatattttgctattgaatttccaaggccaacagatactacccttgagctgttgagaggtgggcagctgggaagagatacttggggaaggggcacgatgcaggcctctcatcgcctgtccttggaagaccaggcaattgtcaattgtgtcaattatacaacagaactgcctgtgggcctccaaccatgtctttggtggttgttgttttaggccagtggctactcggggatggacgtcaccctgttggatcctacctgcaaggccaagatgaatggcacacactttgttttggagtctcctctgaatggctgcggtactcggccccggtggtcagcccttgatggtgtggtctactataactccgtgagtgttttccagaacaaagctttgccctttgccagagcctggctgtgtgctcccttaaagttagtcttaacatttctttgaagatgaagagggttttcaccccaggcctgaagaaagccaagtgtcagttctcaacaaaatggatgtactttgaccctgagctctttggttttatttgttttattggtgagtctttgggaattggaaggcctgttttctcaccccccgtttccgtctcctgatgacaaaggctgcactgtcaaggtgattatgacttctctcagtgcccaagctcaactggcccttataaggataaaattttaaggccctgggctatatgaacgagcagcacctctgcacagccgggttaaccagatgtgtggtctctctggcctcatttgagtctcgtccagaagtaggagaacttctccctccttcatgaataaaaatccaaaaagagaatttaaaactcaaaaaggacctttaaggaattattaagtctctctccacctctaagaaagaccatacattgaagaaactctcctacttttgaagttacttggagaaagattccacagatttcccccaatgataaaccgttgcaatagctaagctgcattttccagaaatctttcttctcagttggtcaaaatcttttcagattaaacccattctcttgggtgcagagactaggcagtgaatattaaaagaatttaaaatgtgaagttccaaaagaactttaaagtgctgattttgcattttgggttttacttttaatggtaaaaataaggctcagagatccctgtgtccacctttgacacagggtgggttggggtgggagggggggtgtcttcttagtgccatatccagctttgacatggggtggctgagctgtggctgctagttcgaccccatccagagaagagaggctagcaatcaggtgctctggtcagcgtggttcctgtgggaagtgactctcccatgaacccaagcatattgttcctcagagaatattagactgttggagcagcaaataaccctaagatgagcttattcagcttcttcatttcacaggtgaggaaactgaactccaagaagttaaaaagacttgcttttttaaactccagggatgggctaatggcagagccaggacgactgaatccaacttcctgacctcttgtccactaatctttcctagacaccaggctaggccctgctaatctccttttgttactcaaataattaatttattaacctttgacctcctgataattgcagcatgaattttcgttcagttatccagtgtctacagatataatgaatgtcatatattactgaaatacttgattatggcattttaaaactggggtccaagttaacaccaaaagtggctacagtaatatgtctgttaagaaaaaataaaaaaaaaaaaaagtcagttgcttcaggagagaaaggcatgtaatgatcccttaaagttcctttttttctcacatatttttcttttctttattatgatctttgagtttagcaatatcctagatgcttcctttaattggcgtcagtactttctttggaggacctggtacagagagaaaggcagtttgttttttttttttaattttcttcccatcctactccctttggagactgttttagctgttctcaccaattataattgtttgtagtaattttcagacttactatatatttctattttgcatcatgttcagaatccaagcatgtgaagcaaaagaaattaggatttcatttatggcgtcatgacccttgggtgaattttctcatcctatttagaaataatccaggaatcataatttcaacctatgtcaagatagattccgggaatatatctgcaggtggatagcgaaaaaggtggaaaaaaaagattcctggaataaaacgtattcttttccacatccatacaccatagagaaagatttcttagggaagaaatgagcaaaagttagaggggtacaagagcggcaatgaagagatgtgctccatagtaaacattaggtccttcgctgctgactccaaccaaactttctacaactcttaaaggatatatataaccaaacattaggtccttcgctgctgactccaaccaaactttctacaactcttaaaggatatatataaccaaagcttcttgtattcgccaactgctagtagttcttagagtttataatataaagactcttaaggggaagccccttctcacggtataggcaagtctcttgacaactccattcaactccattctagtatctagtgttttcccaccatttgaaatcatttgtaattattcaatatggttacaacataaatatttatttttcacaagagaagatacaaatattagtttagcttttaacttgaacctgcattgggtttctccttattcttcatcactttgaagatataattcgaaaaagcctggatgttattttattattttgtcttaaagtcagattttcaatttgcatcagaatgattacatgagtgtttgtgtgaggcagaaccaaacacacatggtttggtgtttttataacattggctgtgctttctttgccttttagattgtgatacaggttccagcccttggggacagtagtggttggccagatggttatgaagatctggagtcaggtgataatggatttccgggagatatggatgaaggagatgcttccctgttcacccgacctgaaatcgtggtggtatgtgtttgttatcagtagggggtttgtggaaaatgctgtctattttgttggctttagttagggactatctgaaaataaaatcagatgttaaaagccaaagctcatgaagctacagggccttcatccttcatatgactgtcattaatcttcctgtgggttgttatttccagtttaattgcagccttcagcaggtgaggaaccccagcagcttccaggaacagccccacggaaacatcaccttcaacatggagctatacaacactgacctctttttggtgccctcccagggcgtcttctctgtgccagagaatggacacgtttatgttgaggtgagacctgaaagttagccttgaccttttaggttagtgctgggctatagttccttagacatcagctaaaataccctgtacagacctcttcctgtcctacctcacagaccttcaacaggtctgatgagggattggctcagagaacgcttccagactgacttctgaccaaagcaggaaatttcaagatttaatacattatgctaagtgaagacagtattttgtagatgaatgttaacaaaaaaaaaaattggcaagtgtgaattctactggtaaagccctgtcctttgcttttggaacagtagttcagtagttgcagtgttagagttaaccatggaatatttcaaaaccacctcatatgttatcttttatttctttttttttccctgcacagtccccttagcccccagcagggcagccaaatccctgtgggtccatgccgccactgaaactgacttgttatcttttaaattgcactcacttttaagtgaaatgctatgtgctattataactcatgacatttttttttctagatcatgatctgagtatctgtataaacttatttaaactatttcctatatataatgttaataatcatgtgcaacctaaatctggaatctggagtgactacacaatattaggcagtggcggtaataatgaaataacaacatctaacatttgctgcagatttattatgtgccaaacagagttgtaagtattgcagcagttagttaactctttagagccatcctataagggaggctaataatatcttcattttatggatgagaaaattgaggcacaaatttgtctgaggccacacagctggtactagtggagttcagattcagtgctcataggccgtgtgactccagagctctgactgatcttcgctggatacgactatcacttatctccaaagtgccatttgaaaggggagaaaacataacgtcttatcaatgcaaacatccaggttcagagagtggattctagaaaagataaatgtccttatggcaccaggatgtctgctgtttcttgtgccctgggtacaacctttcatgtttcaaccttagtgtttcaagtgggcatatcatctgttggtcttatgggaaggtcctcatctaatgagctggttttggtgctcagctgcaagctcagcttcatagtgggaggggtgagaagcttaaagggtcaaagtggggtacttccatatgttaaaagtgactttggtgcacgtgtttctgttttggaaagacacataactctcacattcgcactgactctgggacagagcccgctggcgctagatgttgttttccttgatcatatggattctgcccctcccccattctgagagttctctttctttgagcacaccttctttctccattggggaaaatatactgccttctacatgcttttcctaagccaagatggctgtttttctcttgcttttctggctgtacagttcacatgggcagttggtcaacagcaccctattgcgctgtggatttcaggggtgctgcataattgcagattgttcttttccaaatctatgcctggctttgctgatttatgctaatcagtggtcaatcttcctcctgtaccttaccctggatattttgggttttttcccccatccttcaaatgctggcttacttgaagtgtgttattggtagttttttttttccattcttgttttcccatttataccttttcatatatcacctatatttctcatagtttatcctctattccctctacaccatacagtccctttcataatccaagttaacagtgttgccacctgttcattggtcatctccaggtgactgttggtcacataatggcagttttcttttggttcatttgtcttggggaatttacaaacccagttgttaataacccaaaattttaaatctagaatactactattactaataggtagcatttattgacactctgggaactgtgttgtttgcatgtaacttttactttgctagttttcacaattatgatatcttgtgggtattcgtgttctcattctgtaggtgagtaaactgagtctcggtgcccagcacgtgagcaggagagcatgtaatttttatgagctcgtctcactacaaagcccgtagtccttctcctactcacttctggtctaaaagtaaaatcctttttagtaaaagatttgctgataatttatatatataaactatatatacataaaatatattaaaaaataatatatattttttccctctgctacaaaggtatccctttttgggataccttagacattctgccgctacatactttcttttgagattagagaagagatttgcagtccctctgttacacattttggcatgtggtttctgagttcatgttaaacggcagtttttagtaatagcacatatgtaatttgccacctttccaagatagaatatcttgtttttcagaagtattgcaaaaatactgaagtgttagtatttacagaatgtcaccacagtgacattatcagaatcctcttcattagcattttcactgttgagtgtcctgcagttaaccaccacgtaggaatctttcacaacagtgctgcggattcaaagccccatgtgatgtcaggggtttcccctgggtatctcagcgtggaaagtctgtttctatctccatgtcttttgaaatgattctgcggctgttggtctatgggtaaggactagctgtttctacaagtgtttaagtttattttgatcctaaatttagtcaaagaatgaggcatagcagggaggggcagttcatgcagtgatccacgtgtcaccaaatggagaatctcctctggtctggggattttagctaagttcaggatagttgaggtttgaattctgtttacacttggctaaacattacttcctgtttctaaggaaaagaaccttaacaaaatttggacgtagcccatacaagtgttttcaaagggggaagtataaatgagtcggaaacgtttccagattagatttcccctaaactacccctgggcttatggagcgaagggggagtacttggcaaggctgatttggatctgtgagcagctgggacactttaccaggcccatgatggcctccaggttgcaccgtcactgacacccagcgccggagccagctctgccttctcgccgatgaagcaggactctcatcaggcttactctgactttttgcaatttagaagctcagtcttcctgcctaggttaaatagattttgccgctgaactctattttttggtcagtctttaaaaagagcttagcttataagtgttgtactattaaaacattagggactttgcctactggtgttttatttacttcggaaaatccactttaaatgcaaaatatgtttttatttttagctctcagaggactcattgggaggtggaagagacttactcatcttgtatttgaatctaatggactaatatttgaaagaaataattcactgtcatcatctatatcaaattgaagtggaaaatatctttttctttcaatgtgtgtgtgttacttttgtaattagaaagaaggctataactatgttatgaagataaagcagcgtgtcatctgaagggctgtcttggcatatggtccttgtgcctaaagtgaaagtgagatgctaactcatttcctaattcatctttctgttctttcataggtatctgttactaaggctgaacaagaactgggatttgccatccaaacgtgctttatctctccatattcgaaccctgataggatgtctcattacaccattattgagaatatttgtcctaaagatgaatctgtgaaattctacagtcccaagagagtgcactttcctatcccgcaagctgacatggataagaagcgattcagctttgtcttcaagcctgtcttcaacacctcactgctctttctacagtgtgagctgacgctgtgtacgaagatggagaagcacccccagaagttgcctaaggtttgtgggccttcatccattcggatggttattttggcatttttaggtgaggcagaaaagtttaatcccaaggtcttgcaggttgaggttttttgttttggaactgcccaactgaaatattaaagtcactattagcagggaactgtgagttttatggagtcttagataataaatcctgacagcatgagtttcttttttccatgcgtgctacttagtagtaccttacgagtgataaatcaagacgcttttccatggagggagatttctggctttatctttgcttttcagatagtttgcaggccaaaaacacagcaagccgaaaggacaagttcattgtgagaattaatttttccaggtcctgctgggactggcattgtcattgttttttaaccttttctgtgtgaaatataaggttgacttgtctcagggagacttctaggggaaactaacaaatattttagcttttctcagtttcatatcagttcatcatatttgcctcctgtcactctccagattgaatgttctattgccataacaaaaagcagaaccatttgaccttggtggaatgcatttgataggggagatctgcaaggttaactatgatacccactaggttggtcttgtatatgaaaggtatcttctgccatagttttgtttctgtgatctgccataattatgtataatttcatatgtgcatttattctgtggctatctcacacagagtaaactgatttccagtcctttcgcagtcatatatcaatgtctaaaaggctaagaatcaagcagtgttattaataatgtatgtatggaattttctcatttaactcacagattttaagtcttaggtatggaggtaggaggaaaaaccaccatttccaaatagattacaattgatctgaattccttgcatcattatagtcccctgggcatccttttctctgataacacccaagagaattttgtttgcatacgaaaatagagcagatatgatcataatcattggggagcacatatacagtgatttagactatattcctaggtttgcttttgcggcggtgatgccttagccttgtaggcattcaccatcagggttggggcttagtggacagtggtagagagccatgaggagcttcatgtgtggctgtgggaccagctgcttcctgtgggcagaagggtaacgtttaagggttagaggtcttggaggggagacctagcagttaccagggatctttgctgtggctttggctgttacttctctctgacctggcctggaacagcccagcttcatgtgtgttaatctgggaaaattaatcgtaaagagagttctaagcctcaggggatgacatgatgggatataaccctaaacctcaagtcgccctttacccccaaggtaagataacatggaaagagcctgggactgagaaggaagctctgctgccaccaatgggactttaagccagtctctggaccccttagagcctgtatttcctcatatactgttataatcatacctggcttccctcctgggtagaggagcaaataggacagtatgtacaatgacagccctttatctggcagaggcttggatgagctgttaccactgtctttctgtttgctgcttataggtaatattttcacatttctattattttctgagtgctttctgtgacaatagagagcgccaaagaatcttctaggaagagatctcagagattgttgagaccaaccctgccctttgctgatgaaaccgagacccggagagcagagtgtcttgcccagggtcacactccactgagttaaatgcggaatcatagactcttgcttaactgaagagctcaataggaaagtaacagtaaactaaaacaggaaagcaaaatgcaactcttttcagtcatcatgcctctccacagaaaatttgttgtttttctttacaagagggctcttgttaaaggcttttctctttttgagggggtaagagtagggcagtgagggttgtcttataagaagtgtctgactggcatgttgctcagagcagcaatgacagcaaggcctaaagtctttgctcttttgtgtttggaaaagatggaacttgattagctttttgggatgcctgctatagacttaaaatgatggctgtattaatatgtcttcttaccatagaagctgtcatttactttagagttatacctattaggctgggcgtgggctcatgcctgtcatcctagcactttgggaggctgagcttggcagcttgctgggagttcgagaccagcctggtcagcatagtgagacccctgtcactactatatatatattagctgggtgtagtggtgcacacctgtagtcccagctactggggaggctgaggcaggagtatgacttgagcccatgaggccaaggctgcagtgagccatgattgtaccactgtactccagcctgggtaacacagcaagaccctgtctcaagaaaaataaaaaagaactatacctattgataaatatagacaagaaaacaaagttattttaaagaaaaagtgcggagtgtgatcatattttttcaaaacagatgtagtgggcctgagcatgctcattaataggtttgaagcggctaatctcatggcctccacaacctgggcacagcccccaggatctgcattttgaaacattaaaagcagatgaccctggaaagtttagttttacatgagcctataccaggattaaaaatgaaacaaactcagcaacatgattatcttattggagaaaaatgtaaaatctgtcaccttcataatgcagtatagacagtccccatacaaccattctgtttttcaatctaagtattcaataaattatgtgagctattcaacactttgttatgaaataagctttgtgttacatgatttttccagctgtaggttaacgtaagtgttctgagcatgtttaaagtaggctggactaagctgtgttgttcggtactttaggtgtattaaacacattttcaacttagtgatattttcagtttacagtgggtttgtcaagatgtaacctcatcataagttgaggagcgtctttatgggaaatttcccacaatcaccaatcacaaacatgaaccgtgtatatgaagcccagcttggtgaggaccaacactaggcatatagtttttctgtttttcaaactaacactaaaatgtttagttttgtgagaagaaggggagggggaggacaatattgagaagctatccagtgatatttgcatcttcaggtacaaccaaaaatccactgggcctgctgtcatatctcccaggttatttggtgttctctgaaaaacacccaccttcttgcttttctgtagtgaacagctgtgtgctgtctgataaaaggccacaggacagctgtgcaggtagagctggtgaaggcacttttgagtggcccctgattctgtgctttgttctgcctgtctgcagtgtgtgcctcctgacgaagcctgcacctcgctggacgcctcgataatctgggccatgatgcagaataagaagacgttcactaagccccttgctgtgatccaccatgaagcagaatctaaaggtgtgctttgggaggcacgatcagagcatggggcctgagctctgcttgttaagaagacccaatagtgtaaatcaaagtccagctttattcacaagataactaaagggccagttagttactttagaagaccattttttgcccgaagagtcttttctttagctggttctcttacagccattatggcttagttgtaagtaatctatttgaaaatgatttcctctgtaaaaagaatcaggtctaggttgttcctgtcataaggtcactctcccttgcattcaaatatgcttccttgagtatgcaaaaaagggttctagttagtcccatgtcccgggaattgcacacaatccacagttcatctttctgtgatctactgctaaagtttatgctggctataacctattgtattgctttatcaaaattgcaaatgcctttgagaatatgtgaacattattcatcttaggtgtaacagatgagaaccactgcccaaatgcatcttaaaattcagttttcagaattttgcacaatcacatttgttgcttggagccaagcatgcctctttctccacaagcaggaacattcagcaagctgtatcttctgtgagaaaaggaaggctgtgccctaaggggtgtggcatcagtacctgagaggacaggcagggcagagccagacctggcatgggtctggccagccagagcagtagagaggcagaactgggccctaacaaatgttaggagtggatatgaggccctgtgggcggtgagaagagcatctgacaaggacccgcatcacagctccaagggttataaacaagcaaggacacaccaggcagctgtcagcatctgaggggtggaaccaaatgtcacatgggatatctaggcaattacagttgtcaccatctagtaacattgatatctaagggtgtcaaactgagagaaggctgggagagtgaaagtggattccaagcggggttagatatttcaggattagagctacaggctgcctctcgccactctgaggggcacagaggagcctgggcaccaagggccttgacaaaagccagcacactgtctggctccagtttcagggtattagctggaaggcctgctgggtggtgctgacaccagatctagggtttggtgtggccctgggatggcattcctgatctgagcatgttggattgggatttggcaagactaggcagcaggggtgacccctggacagtgggcagaacctaccagaacagaggcatgcaggtactgtctagtgtcttattggttgactaacctctgtgaaaacagctgtgccattccaattgtgtatctggtggtggcatctgcccccttcctatgaatgaatgtgctccctcaaaatggcagaagagtataggtggcaggcacactggattggagctgggagcctaaggcactgcttttagctttctctgctaactggctgtgggacattggagaacccccctaccaccagctctttgggtttcattttctctatctggaaaggagaggtttggactgggtgacttccaaaaggtcctttcagttgtaatactcaactatgctgtttgaagaagcaaaataatctttaattcatttttctggccgtcctaaagttgttgtgaagtgtacatgagatgttctcggcaacatttttgttgttgtttgttttacttttattgattggttttcaaccatttgaaagttataatagacccagtctttatataaatggatggtccaaatagttcctttttattgggttcaggagaaagaaataagaatataaattgtgttgcagagtaatcacaattgggcagcagctggctccattttgtactatgaaagtgattttgttaccagaaaggagtcccaattcagaccccaatagagggttcttagatttcacccaagaaagaatttggggatgagtccacagagtaaagtgaaagcaagtttattagagacgtaaagaaacaaaagaatggctactccatagacagagcagccccagaggctgctggttgctatttttatggttatttgttgatcatatgctaaacaaggggtgggtaattcatgagctgtcctagaaaggggcaggcaattcccggaactagggttcctcccctttttagaccatatagggtaacctctaggctttgctatgacatttgtcaactgtcatggtgctggtgagagtgtcttttagcatgctaatgtattatacttagtgtataatgagcagtgaggacaaccagaggtcactgtcattgccatcttggttttggtggtttttggccagtttcggctggcttctttactgcatcctgctttatcagcggggtctttatgacctgtatcttgtgaccttctctcccatcctgtgactgagaatgcctaaactcctgggaatgcagcacaataggcctcggcctcattttacccagccctattcaaggtagagttgctctggttcaaatgtctctgataatttaacaataagagcagctacctcggattccatctgttactcgtaactattttgagagaggtaattctgctagtaattgaaggcagcggcttgctttttcccatgccagacaataattaggcattaatattgccgcagtataacttccagcaattcatccattcttcttttgagcctggtgacatttttctaagtaatttctcttgcaaattaggtaattacttttatttaaacttagtataattgtactgaaagttcaatgttttcttgtataaaagttcaagaggaaagttttaccaaatatcaaagcaattttatgagatttgctaattgagactagattttagttgagaagcatgtgggtgaagaaagtttattacttaggtttgttaaataaattgaggcggttaaactgtaggccagcttcccaggggctgtatgcaaatttgctttctaactttgcgcttactggggtaagttttctggcaggtttcagctgtgtgtgactcctctcaccttttaagtttattttcttttgactctaaatcatttatcctcaatgcagaccactggagtctgtgctttctgcctcaaggtgaattggaatagtcatttgaaaagagactgtgggctgggcgcagtggctcacgcctgtaatcccagcactttgggaggccgaggcgagtggatcacaaggtcaggagttcaagaccagcctggccaacatggtgaaaccctgtctctacctaaaaaaaaaaccaaaaaaattagccaggcgtcatggcacacgcctgtaatcccagctactctttaggctgaggcagagaattgcctaaacctgggaagcagaggttgcagtgagccaagatcgcgccactgtactccagcctgggggacagagcaaaactctgtctcaaaaaaaaaaaaaaaaagaaaagagactgtgaccatttgcctaattgcattggtttatttgaataataacaggtcacgaatgtccttcctgtcagacagctttatgtctctttattgtagaatctgtgactttttgggtaaaaatttcctaaccaatgggacgcttcactgtgcttttactacacaggtgctctttgaaggccatgccaaaactccagctctctctggtcatttggttcatcttatttttcaacacttggattttctgggacagcagataaaggctctggttggcaacttcacagctgggcagagagctgctctgtggccaccactgccaatagcattgacatactttagtgtttcttctgtggacaggaaagtaggcaatcaagactataaaaatgtttctggattcctcctctgggccactgtttttaatggaaccttcctgagcacatctttgccacttttgatctctaagtcccttgggaatcagtgttgggttagcgttcttttaccatttaaatttttaacaatagatgaaagtttaaagctgatggtgatgatagtgatggagatgaggatgatgatctaacatttgttgagcatttactttgtgcaaggctctgtgctaaatgctttatgtggattattatattttatcctcatagcacctctgtatagtgataacttggccaagggcacacaacatataaatggtggatctgggattcaaattcaggcactgtgattccagagcctgtgctcttaaaccctatgccttattccagatggaggttgattctagtttttactgaaaactagaatcatgtgcatctatgtcttcacacccctcttcctgccccacttctcccttttctttctttctttctttcttttttttttttttttgagacaaagtctcactctgtcacccagactggagtgcagtggcgcaatctcggctcactgcaacctccacctcctgggttcaagcgcttctcctgcctcagcctcccgagtagctaggattacaggcacctgccaccacacccagctaattcttgtatttttagtagagatggggtttcaccatgttgcacaggctggtcttgaactcctgacctgagatgatccatccacctcggcctcccaaagtgctgggattataggcatgagccactgcacctggccctcttctcccttttcataccatatcacattagtattcaaggtaacaccccaaataccctaatgattatgaactaaaaggaagatgaaggattttaggaaaaatgtctgttcacccaaaggattaagatgttgggaaatgtgtaacctgtttagcagagtattaaagttcaggagaagttctgtgattttcagtagtaactcagaaagcccagagaacataaatagtttatgcatattatggtttatgacaaaacatttaaaatagttgaggtggtgccatcctaccctattttctgaaattttgaagtataggcatattagtgctgtttgccttggattctgtgaccgctttttacagcatttgagaacacttgggcttatacagtaaaaatgattacaccacgtcggtgatgattttttttaaattgtgaaagagaggagtaaccatttctctgaaacagtgcacatacacagaagagcatggatgtggatgtcatcaggagcaataaatatcattccaaaatttgccgtgatttacatacctatagatgtgtttaattcttagcaagttaaatgtttgagatactgaattttctccgtattttcaccacctaactttaaaaaataaaaatgcctgcatatcttggatactcagtaaatgttaatttcctccccttcctctcaacctctcagcaaactagaggttttttgggaagggagggttgaggaagggaaagttgtgaacgtcagttggaagttgatccaagagaggcattactttttggaacacatttgatctttccagaataaaaatactctaaaggaccagccaggttttgtcctcgagctgaggtcgaggtgaggggaaactgagtggaaagatggtagaaatgcttaattgacagaccagggcattcattctctatccaagaagggaaggagggatatcatatttttttttttaacatcgtgtattttacattatttatttatttaattttgagaaggagtttcattctgtcacccaggctggagtgcagtggcgcaatctcggctcactgcaacctccgcctcctgggttcaagtgattctcctgcctcagcctcctaagtagctgggattataggtgcctgccaccacgcccagctaatttttgtatttttaatagatacagggtttcaccatgttggccaggcttgtctcaaactcctgacctcaggtgatctgcctgcatcggcttcccaaagtgctgggattacaggcctgagccaccgctcccggccagtattttacattttaaaacctttttattttgaaaaatttcaaatatatacaaaaatagaataagtctcaacaattgccaatttatggtgaatcttgttttatcactttctgtcatccactggattgttttgaaggaaacccagacatttaatttaatttcatccatacatattccagtatgtacctctaaaagttaagaaccatcagaagatctcaagcaggaaactgatgattaggtcatttatttttattttattttattttattttttgtatttttagtagagacggggtttcacagtgttagccaggatggtcttgatctcctgaccttgtgatccgcccgtctcggcctcccaaagtgctgggattacaggtgtgagccaccgcgcccggcgattaggtcatttaggaaggctactctgaaaatggtgtgaaggttgcattgctggggaaagtactcaagaataaaatatacgtgatatttgtggttatttattcaaaaaaatatggtaggtgtatagtggacaaattatcttgtctttaaggcctttacagcctagtgcaaagtttctcaatctcagtacaatcagtgtttgggctggaataccctttgtagttggggggctgcctgtgtgttacaggatgttaagcagtgtccctggtctctacccactacatgctagtagcaacaccctcccaccaccagcccagttgtaaccattcaaaatgtctctagacgtttccaaatgtcccctggaataaaaatcacccaccacgtgagacacactggtctagtggcaggatacagataagtgaacaagtaattgcaatgaatatcataaatattgaaagaatccagaaaaagggttcagttacagtgacgttaagttagtaaaaactctgtcttaaatggggcctgcacaaagacctcctgagtctccaggaggaatcttcctctccccattcttctctttgccaaatgccaatagatgtgggtaccagttggacgtcttgtttcactgtgggcccactccgtcctatggtgcctagtaccaaattgagcactaaaggccaaaagctgtggtcagttactcatgcataaccccagaaatatcccgtttatgaaaaccatgctgaacaatctgaagaggggaattttggttctagaggtagaccaaaatttgctcagcgtatatgaaaagatttaattcagaacattgattatagtttgtcctttctgtaaagaaatctttattgttacagttctctttacagcaatagctaagattcctttcttataatcttaatcttatccttaaaccaaaagtaaatattgttgagtccactcttttcctctcagcatgccaactcgatggtagggttccggtggagatcaagccattttagttatactcaggggttcttagggattcgggaagagaaaagttcgaggatagaattctttaacctcagttctgcagcttctgcttgttattgtttgtgctcagaaatcacgaagagacttcacccaggggaaatgaacaacaactgtttctgtttagctctgtgagaaggctcctatttggggtgggggtaaaggattagatcataacagaaatccattaagaattttaaaacaatgccatccatcacacaggccttactataaaacttaaactcttacatgggaggtctccttaggagagagtcataatttttcaaccgcttggggattctgagtgagaaagtttaaccatgggtggttgattggatggaattattcccagaagtgtgtatatttcttacatgatgcatcttgtagcaacctttaaatgcctttgaacttagttcagggaatcaaatactacgtcttgaaaggagaagtttgtgggtagatactcttccttcatagagttcttgggagtttaaaatgagacaatataagtgaaggccgaaggctttttgtctattgcaaaacaccatacaaatgtacaaatgtaaggcatcattgttgttattggtgccaatgaggctgatgggacccagctcccagggtagtgcattctgtagttagcgtaattagtgtgtgttctgcatactgaattagattttcttaaaaacatacaatcatttttattttcttagtaattgtatttaagtatacttttgcatatatcctcattccagggccactatgttgcacaactccagggggcaccattcaattgtggtggctctgattcatccagtagcattccttcccctagagccagacattgataactcatgtggccagaatgttgacccacccatcggagatggttaatcctgagaatttacaattctgttttcttttatcctgtctagcttctttatttttatagacatcaattcagatgctgcttgtttgggtcacattttcccaagttctttttgcttccctgtgaattcagacataaggtgtgtgttccttctgtggtgaatgaaaatggagatgaaaagagaggtgctaaacatgtatcacttttaaactccaaagagtagggtcaaggtctgtagcaggactcagcacactttttctgtaagggaccagatagtgattattttttatttgtggctcatacaatccctgtctcaacaactcaacgctgctgttacagcatgaaagcagccatagacagtatgtaaataagcatagctgcatccatataaaacttcatttatggagtcaatttgaatttcatataattttcacgtcatgaaatatccttttttgatttttaaaaaatcatttcaaaatataaaattcattcttagctcatgggccatacaaaaataggtggtggaccataatatctcaaccgctggtctcagcctcactgctgaggataatgagtagctgtgcacaaatagttacttcatcagtgcttccccagctagggacagagctacgctcaccagtcatttagcctgctaggcagaactctggaattctgattcaacttctgccctgatgctttccagctgtgaccttgggctctagtcacacgatatcagagtctcaggctgctcatttccaaaacagtgatacaaaatttttttctgccttcttcatggcactggtgcaaactgcatatgaacgtcttcatagtctgattgctggtttcctctgtggcctccatttgcaaaaagtacattaacattttaatcatccttcaccaaacatttctggaagacctattctatgccagtctgagcccttggggatatacagatgactgagaactagaccttgccctcacagcaaaaaaaaaaaaaaaaaaaaaaagcaaaagaaagagaaaaagagagagagaactaggaggtattgtggcccaagtgtaacagaggagggatggaatgagcaagggtgggagagactagctctgctgggatggagatggaacagtgggagactcagcaaaggtcccccagagaaaatgccaacaaagcaggtctggggaggagggtgtcttgggatggcttgcaaagcatgatgacaaagagcagcatagagaatttgggaagcttaaattactaagtatggggagcccaccatgggtgaaggactccatcaggaaaggaggctggagagagaggatagagaagggagggagaactttgtgtgccatgttaaagagtgtggatttttttccctataaaggaaggagagtcatcaaggggtttagtcagggttataacatgatcagctctgggctctagaatattcactctgggggcaaatgtggaggaggaaataattggggggagggtagtggtggagataagggggcctctgtgataatcctgatgagcaatgaaggggagttaaactataggataatagcactaaggctaggagaacaaagatacttttagaaaatgtgtatattaaattaaaagaatattttgaaggctgggcgcagtggctcgcgcctatagtccctcggcctttgggaggtcgaggcagatggatggattgcttgagcccatgagttagagaccagccagggcaatgtggtgaaatcctgtctttacaagaaatataaaaattagctggtgtggtggcacatgcttgtagttccagctactcgggaggctaaaatggaaggattgcctgggaggcggaggctgcagtgagctgagggcgccactgccctccagcctgagcaacaaagtgagaccctcaaaaaaaaaaaaaaaaaaagaatattttgaaagcagaataatattagactacactggaaaagcatggtacttaaaggtattgaatttttttgtaagtaaataaaaagatatacacaaacacacacacaaattgtcggacccaaattccctaagtttaggtgtttgccttcaaattttcttcaaattggagagcctatgcaactgattgtcaacaaaatgcaatgcttaaaatttctgggtaactcattatagttttgatatctaaagaggatcattgacagagctttctcacagtatttattaccaaatggaaaagtgtcagtttctgctgagactttgatgaccctttgcttaaatcttggttctccatagaatacattgtgatttatgtttttgtttcagaaaaaggtccaagcatgaaggaaccaaatccaatttctccacgtaagtctttatgcaactatttcgaaataaaacctcctgggctttcctaagaatgagttggttagtgaacatttgccaaactttgagttttgataaggagacttctgctctcattcccccttcccccttcccctttcccctttttgctcatattttttcctttcctctgtcctttgtttatccctgctttctttttccctttcacctttaccactttaaaatattaatttgttgatccattggcatgtatggcttgaatgggaaggtagtaacttatttagagagacaagttaatgacttgcatgcttatgtctgctctaacctgcaagaattcacatacagccatggaagtggtttgctttaagtcttatcaacaatatttatctgctcagaggcgtaatgctaagggaactcattgctatactttcaagacaatccgtagtgcaagggctgggggccccaggaagagcatgtaagaatgaaagagaaagcaacaccaattgctgcagaataaggacttggaaattgtctaggccaatttcattattttatgcagaagaaaatgctgacccagaaatattcctgcctcattggcattgaggcaggacttcaacctggacttcccagctgtccacccagagctcttctagataatgttgtcttgtgaggagaatttgtgaatctgtgctttttttcctttcctaagattcccaggattagtctccgtggctgattcactacatttaacaatcagtctggaaagttcctttcacaaagcacttcataaaccattgtcttaagtggattattttttttaaattatggaacaatatgaactcaaacagaggcacatatggacacatatctatctttggagatttagaatagtttcattaaaaacttgtaatcatgttcaatttttgcatctgtgggtataaaaaggcaaatcatcttctaatatcagttttaaggactagattaaataggttgatggctcggttcaacttcacctccagggagctcttcccacctcttcctccacctgacttcagcaggtgactaaagctatccgcatttttcagaaggtaaatgaacacaccaaagagcacaggtctagaagagtggggaccagaacttgggagttcggatccttccagacttgttccaccacagcatactttccccgagcctttggagtgctgggctgcccaaaggtcacaggagtgtatggcagtcttcaatgtaaaaaaaaaatagctttctttacactgaagtgagttgaaaggcagggatttaatttatacagagatcactggagttgcttctgactggagcagaaagtagaaataatatgataatagtggggagatcctgtatttcccacttatattcaaaacccagagaccttagaaattgtattctacctaaaactcctcccccttggaaaccaattttaactttttataagtgactcaaagaaggtagttctcttaaatgaaaggaaatgttctatttctggggcctggaattaatttcaaatataaaaacctttgccaaatggagaaacaattggttctatttatatgttttgctgaccataaaactgacatcactccccactgggaagtatttccgttccccttatagaaagatcatggttggaaaagtgttaaaaagtaggttgttttaaatgatacaatatgaagctgttaagattaagagtttaatatgaggagatcggtgaaatgttataatccacaggaatagtttatttttattctatattctcctttctttctgttatctttcatacttgtaaatgttcacaaaaatatgtgtataaagtattctaaggtgtgtgttttctgtgcagtgtgtcatttttggagatgttcagtgaataagcagcagtaagccagattttgatcatggaagttcactttattttccaaagcatcttaacctgtgaattttcaagctaccctccattcaaatagtaggtccttagagtgagacaatgagatgacagacaagattttactgagtttgcaaatctgattttttagttagtttgttgatcaaaataaattgcaaactgagaatactttggaaacctgataatttcatttaacctttgaaaaaaatttgcaagttacaaaatacagtgtattttattggaatcttcattgcattctccgattttattagtgctcaacctttatgacagtgcttgtgaaacaaatataaaattgcaatgcatgatgcagactaaccaaaaagttgtgtgtatcggtttctctcctttatagcaattttccatggtctggacaccctaaccgtgatgggcattgcgtttgcagcctttgtgatcggagcactcctgacgggggccttgtggtacatctattctcacacaggttagtgtgactgttgagtaagagttggtgaacagcttgtgttcctgccacacaatagacactcagtgttttgttggatgaaataacgaatgaaagagaaagttcattcctactatttttacatttacatatttggtataaattgggtttcacaaaagtataatttgccataaacagtggaaagaaaaggaaggtttaaactgtgctaattgcgattgtgatgttggtgaaatttagccgctaataaagctactttgttgttagagtttaaggttaatgcagacaacgtacagaaatacaaaccattccgtcaaaaccaaagacttaaggataggcatatacatgagaggaagtgaaaaagaaagccaagattttattaccacacctgccaaggtattgagcactgtccatcagagtccttaatcaatgacttaaaccagattttctcaacctttttttaacccatgctatgtcttctttgataaaacataaaattttcatgtttttctataaagttaaattttctaaatagatttccatgaactgaaaaaaaaaaaaaaagtgatgaaacagagcacttcattttcaagctattatccctcaatcttcaaaattcagatgtgctcctccctaccaatcccaaggttgaaacatactagcctgatgagagaacctgttctgaccccaatacagaatgcaggccagcaaagggagtctttagtgcaatggagaaagaacaaatggattgtcctgctattgattctttcttagtttcctttcaactatgggcaggagtgacatgcattttgcggcattctggagaactagaatgtataaaatcggtcttgttcttgtttgttcttggatccttgtagttttatactgtgaacctagataaactgtgctagattgatccgtcagaggcaagtggcaggcccagcttctctgtttataatttcattaattgtccattaaaccaatgaatgccatgatctttggcttccccttgggccaagctgaaaggatggctgatttaaagaggaaggaagtactgaaggatattttggagagtcatatctttaccctcttgattgctagacaaaacgtcaagctgttgagaataaaagcatgacacagtgatcctctgatagttaaaagtgtcagattcaaatcagaattttcactttaaatactacatctcctgcctgaggtattttagattacgccagaaggagaggaatggactctttcatgcctagcatgggacattcacccaaaaggcaacctcttggcaaaaatgtagaagacttgaatagagagactttgagtcctcaaatgcttgttcctagtcaggatactttgagtaaagtatgtttacgtgaaagattaaaaaatgacttctcataatcctagcattttgggaggcaggggcgggaggatcacttgagcccaggagttcaagaccagcctgggcaacatagtgaaaccatgtctctacaaaaaaacacaaaaactagcatggcgtggtggtgtgcatctcttgtcccagctggctgaggtggggatcgcttgaacctgggaggttgaggctgaagtgagctgtgatggtgccactgcactccagcctgggcgacagagagagaagttgtctcaaaataaataagactccagtgtcatgattctggagtattatataaccatctgtgaatcagtttaggaggattctccctcatgaacagtttataaaaggaccagaaagacagaatttagcagagcagcattttaaagtaagtaattttgtcgcaggaataccgacatgttcagatctcaagctaacagttctttgcaacttttccaacctcctgcctggctgagaggttctagggctgttggcagcctgtgttggctgttgggagtgagtttgaaagtcctccaagaagactgggtcacccacagatgtttaccatgtgcctgctcagccactgactggccttggtcacacagctgcactctcatagctaatcttgggccaggaagccaggtccaggcagaatatagggcaaccagataatactcactactggaacatgccccactgaaatccccccaataatccagactgttacccacagccaagcacacaaacctgataaaaagcaaaacttggtggtatggcatgtattcatcctcattgaatttggaagtctgttgttactgatcctttttcccccaagccagagacttcaggagggcctttcaagtactgttaatgtagaaataggtttgtaagtaaatttaagaaaaatgaaaccaaagacctccctcctgtgatgctttccagcaaaatgaattacactgattcagaaggtaaaaggtttatagacactgtcatttgggcttaaaatccattggcatgacttatgagacagcttcaaaattactttttattaaaaactgtagcctctggttcattttatagattgctcttgaggaataccagcatcatacaagcatgaagaagactcacttcaggaccacatgatagttcttttccagaaccccttcagtttgttacctgggtcagctagcagcaatttagattaataaggaagattataatgcagtgggcaatggggagagccaggatacaaatactgactcagtccgttcaatttcaacagtgattgaagctgtggaactcacagatcgtatatgctgtatttgggggttcagatagcatctgcctctgtgtgaaaaacaatccttaatttgaataacttttcctttgtttacgctttccattccatgtgcagcacggagcacaaaaccaagtcacaaatttggattgtggatatctacttacatacctggaatgtgtgttactctacaaagactgggttcccactttatcatatgacaactctgggcacaataagagatattcccttaaggctggattaattctgtttggaaaactccattcctaaaacttacattctctcctaagatgctgtagagaggaggggtgcttgggggctgaaatggtgctggaaccatagaatgttcatgctcctaggaaccctacctagttcaggggtccctaacttctagtccatgaaggtccctaaagtcacatgcaaaatcttatctgtttttttcttgaagggaggaacaaatgcttttatttttattttctagtaaaactttttagcttcatcaaagtagtacatgcaaatagtttaaaggttgaaataatcctacaagactcattatgaaaaaaaaatcacacccctactgtccttaccttcttttctcactccccagagcattatttttggcgcttagctcatccttttggatgttaatccatacttctaaataacctgagtatattgctgctttttgactttgcaggtttacacctttgctctagacctcctgttatggaaaatgtccccttcccccaccatcctcttaatagaaatatactgacattttggttagagcagcatttactgtttacattattatgactacctaaatgctaatcacagttaactcatgtagtataatatcctgcatgacttttaattttccctagaattaattattatctttccccaccctaccccattagcttaattttcttttcttttttttcttttttttgttttgagacggagtctcgctctgtcacccgggctggagtgcaatggcgcaatcttggctcactgcaagctccgcctctcaggttcctgccattctccttcctcagtcatcagcttaattttctatgtatttatcattaattcttctgctgaccctgccagctgtctcaatctccttttaatacattgagacatatggaatgttctactgattccttttcttcagctctttcctggagcctctgacctgctcctgtctgaaccggttccctccatttctggacactgctgtcttcctatgatcttcttcgctaccattctgtgcattcccttcacttctcttttgagttgtggatgtcctgtgtcatgtatctcctgcctttcttcttcctggtttaaagcgtacagaggacgcaaatgtttttcacaccttgcatgtctgaaaatatcctcatttaacagaaacacctggtagacagtttggcaaggtacagaatgttagattatagacactttttccttcggacttttgaaagccctcctcattgtcttctagctctgaggattgctgttgagaagttcagagctgtgcagattcctgatcccttttgtatataacctgttttttctttctggaagaaattttacaatgatatctcttgagttaggtgtatgtttatacattatgctggtcactaattgggccctttcagtttagaaactcatatctttcagtactgagatttttaagaatgatttatttttttctcacccccttttttctgttttctctcattttagaaatcattttatttgaaagttgaacctcttgtcctttaattttcctttctttcctgttttccatgtgtctgctttctttattttctgggagattgtctcatctttatctttcagttttttactgagtttttaatactggcttcaaattttttaattccaataacttttttaattctaataacttttttcctgtgaatttcttttcttttaaaaaaagttctattcttgtttcatgggtgcagtatcatctgagaatattaatataggattatttaagaatgaggaaaaaaaaagaatgaggaaattctaagctgtgggtgggatgtattgattgtgaacttctttaagatgatctgactgggccattttattgatgaatccctgatacctcatcattggatctttcctctttagctcttcaggcttccataaaatatgtttttttgcctcctgcttgaaaggtataggactggctgttgaaagaccattataatgggcactgataaaaataaactgacatggcaacaaattatatttggcaaatagacaccggaaagcaaatatccagacttcccggccagggtataatcctggcgcttttcccgaatgcaaatagtgaagcgcatggcaaattctgcaggagacaaatttgttacaaagtaggactggaaccctactttcttgattcagagtttcactgttgctagatgaggcaaggccatctggctttatctccttttaggctgagcaaaagaagcccaggtgagccaaaatacgtattaatatatgtttgccgaatcccccccttttgaatgtggtactcttgccctcaaatgtgcctggtgttgatcatttctggaaccttcagtttcctcctcttaagagagtaaaattcccgtcttcttcctggattaggaagggcagatctcagcccagtggagcgagggaggaaatgtagagaactattctgcttctcatatagttcagccaacccctcttgcttatagccatatgttcaagggaggtttccagaggtgcctgatgccaccattccctgagttttttaagggttcggcgacataaattgcttgtttctcagtttttcccactgttggcttaggtttcggctctcttgagtctgccaagtcagttgctactcacccatttcctcaccagcttccaatatattttattgctgttatctttacttttgttatctttgttttcatgtgtttatgcctttaaaagtccatttactgtcattctggtaagatttgggaaaggaatgcaagtcaatgcctttaaatgcactatctctatgcaaagtcgtacccttgcttttttttttttttttttttttttaatcagtttcttaaagggagtccttggaaaattactagtctgcatcagcatttcctttttacgtagcgagaaaactgagcccagagaactgatgtgacaagctcaaagttacccaggcacagcggccaggactgaaggcttgctttcttgattcagagttcactcttttcttcctgttctgttattacaaattcaaaggtcacgtagccataatctttttatcctccttctgcttatcagataataaacattaattaacatgtgtttcggtttttctttttgcctctgtttagtgtcagctaaatttttttggtttgttcactcatgtattcgttctttcactcaacttattcaatggattttttaagctattgttaaatgccaacgctattctaggcactggtaaaatagccatgagcaacagaaagtccttgctgtcgtggagttcccatatattcagaggaagagaataaccaaacagactgattataagcagattggctcaggcagaaacccagctacaggcacacatgccaacctttaggaaagcaatgacctgatgaactgtgtcagaaaaatggagaactgacaagggaagtctcactggagaaagaagaagtgtttctaatctgaagaattaagttttctattaaccttttatggaaactgaggggagggtgagaagaagggggaagggtatgaatggccagatgctccgggaggtgctttgttttttgagagaaaaagacacaccaatagacaccaggaaagccgaaggcattcatcttaacctctgtgtttaatggttttataaaataatgatatgggcatttgagtgaaaagagagtggagcctgccttctttacagtcacattggggtttccgtctgttccagctgcatctgtctgatccctgggacttggtctcttgcctcctaccttatcacaccttagtctgtctgcttgctgtttctcttttcatcgggctacacttgggaacctggagaaacctcaggcctctgaacacattggcacctcccgagctacttctaatgaaaacctcttacctgacttgggtggacttttgggtatgcgcttgacttttgctttaagaacacatggtgtgttccatggagggttgttgaaaactgcctgatgagttgggacgggcacacctaattcaaaacttcagcattttattatgctctgtgaaacagtgttccttacacgcttagattttttttctgcttacacatcagagcagccttaaagttgaaaaagcttttattacgcatttcttgttttaagtacgctcaccctaataaccctgtgaagtagtgattatctctgtgttgactaaagggaaacacaactaatatacctactaaggtagcaagtctagccattgaacaaaccagagcttcaagtccagtttctgactcagggttgtagcgatagctgtggaggacagccttcctcctccacctgatttctctttccctcttgcttttcttcttcttcttagttattatcagattttgcatcctattcaggggccacaaaggcagggaagataccacagaaaaccaaagtccatatacaaacaggttggccacactgcaggaatatagaaagaaagtagtaggcaggacattgtgaaaaactttaattcttgatatagtcttttccccgtgacttctaacaacatctaactcacccctcctggagaattttgctgcaaaagaagagtcttttgtgtggaggctggggaggaatgaaatttgaaaatgataaaaagtgattgaagacttctctaaattaaaggtagtatcgttcactctgcttaaagagtgagcttgtgaattaattacagttaggagatcaagaaactgagacattaattgatagaaaatcgcatccaacacgtagatctagaagaaaatatctttattttctttctagcatcaaggaatattaaatctaaagtgtccccaggtatatggttttcaatcctgtgcttaaatatctcctgagaaggagattccataaattccctctataactaaccaatcctcataatcagcaagttcttttctatctgatctaaatccctagtcctgccatttaaactcatttcctcatgttctgccctccagggagataaagaacagctgtctgctcctatttgtaataatcctcatggagagtatttgcaatagtctcctttggcctaaataccaagcttgccctcacctttctttttaactcttctcttgtttccccacagagtcctcccatgctattcacatctttcttgaatagtttcttccccaggacctgccatggtgaaagacttagaaataagaatacagttgtaatatagacgccaaagaggtagcaggaagtcagatctgggcaactccatgccatgctaaagaaataaaacattctccattaagaaatgttttttgtttgtttgtttttgcttctttttttcttcttccccctggtagagacagggtctctctctgttgcccaggttggagtgcagaggctcttcacaggtgagatcatagctcactgcagtctctaactcctggcctcaggagatcctcccccttcagcctcctaagctggcactgtaagtgactgcacctggctttgtttttctatttcttgaggcatctctggcagtatctaggcccagccataggctaactgtgagatgggtggaattaatccttagtgtccttatcctcagtgtactctcctcctccagagtatgtcaggcaccaaattcctctctcccctactcactctccctcctctcaaatctctgttccctcaatgtggtttgatattttaggaggaaagcaggaagactgagtacatttcctctgctggccaagtctgatatttatttacaagcaaggcgccctccttgaatttcttagatgtgttaattgggcctagtctgcttagccacgaggtcctccctgcccatctcctttaggagcagccttgttatacttgtcacccaagggatgttttagagaaagttggtgctccacgaaatcagagaccactgcagtggagagcagacagccaaagacccatctcagaaaacccaggggtctctgttggcccattaagtagaagcatctgtacattcaactttcttcctcatggtgaatttttctgtagcatcacttccatttgacagtgaaaaaacttaatctgtcaaaaggtaagagttatttttaaaacatggttatattgagaaaccttgcatcttacatgtgaaaatagccacagaactggaaaggatggtctgaagaggggactttcaatatttcccagcagattctcagacagagactcaccttggcccattattggatcaaagtcaatataatattaggttaacttgacttatccagctggtgagatgcatcctgcagtcttgagtgcggaggcttctttgttttgtttggggttttgttttgaagtgttttgcattaccagaacaagagttcccaaaactcgggaagttgaaaggtctctttaatgggcacggatgaaaataaactgacatggcaacaaattatatttggcaaatagacatcggaaagcagatattcaggcttcctgggcagggcatagtcctggcacttttcctgaatgtgaataatcaagcacagggcagatcctggaggagcacacttgctccctattgcttgatgaagcaaggccttctcttttacctgctgttgggctgagcaaacaaagcccaggtgagccaaaaaagaaaaagatggagttggcctcctgcttttcagatgtatccttattaaaataggaaaaaatatttttaaaatgtggttcatgcatagccacattagtccttctgattgattatgtgaggatccagctgggtatggaccaacatgtggtttgtaagggagtcaaattcttaaagtatatctagagttgtttgggtctctggaggttgtttttgttttgacctcagaatagttaagagatttgattcccttctagaaataaagctcctactctggggaaagtgaatttttggcagaaagttattgccatggaggctaatttccccagccttaattatacacacacatgaagagtagagggcagtgctggggagggtccaaaacataggtttccaaaaaagtcaaaagcagtgtttcagccgggcgtggtggctcacgcctgtaatcccagcactatggaaggccaaggtgggccgatcacgaggtcaggagatcgataccatcctggctaacacagtgaaatcgtgtctctactaaaaatacaaaaaattagccaggcatggtggcacatgcctgtagtcccaggtactcgggaggctgagacaggagaattgcttgaacccggggggtggaggttgcagtgagccaagatcatgccactgcagtccatcctaggggacagagcgagactccgtctcacaaaaaaaaaaaaaaaaaaaaaaaggcagtgcttctccgcttctcaggaatattgaccccagtcccctatccatcccgccaatcccagaagaaaagataattagaggaagtacaacaagggccaaacttacaacaagcacataaatactttgaggttgatgcaaaagtgtgtatagctgtgtggttcatgaaaggggtgacaggaaaagctgtaaccagacccagggacatgagccagttctacattttgcagaactgcttttttcacagaggcttttgaggggccccagaaagagaatggaagtaatggggccaagttcctgcactggagggcagggcctttcctcgagtgttttgttttaatgaagcagctggaagggttgcttatctccggctgatagatgtgtatttcagcatgacaggaaagaggaggctcattcataaacaggcctggccctctggggtttcccacattgaaggaggggatgctgcttacaagaagtttatgaagtttatgctctgacttttcaaagtaaatgcagtgttttttattggagagccctgatcgcttttccctacctagagccattttttgagggttgcactgaggccggttttgccgaagagaagactaactctagggccttttgcactgttaaatgcaaaccatgtgtgtgacttgaggtttccttcctctccaaagcactgcacatttggcacgatgaatggctttagctaaaatgcagtggggtgtgtaatgaaaagtgggatgcttaaagtgttaggagatactcacactgcaccccacagggaacctcagtggggaagagaggccattcgctggcaactgcagtccccatgtgcaaacagctaaaccccttccccaaaaggtttttccaatagcagctatcccccaccccggtttctcaggtaatttatctgtttggcacacaaggctctctctactgtagctaggacaaagtctatatttcactcctgtttttaacaagtgcattcagaacaaggctcccaaacttccagggttctcttaactacaattgaaaggtcacaccctccaaatcctacagtgtctttatgagagaagatggacagtgtttcctgaatacaggtgctggtcagttgccagctcacacagaccaagtggtggtgatttcatcaaaggttgtggaccctgaaatccagggactttgtcatcaactctcaggggtcttagccactagagctgcctgtcagtcagctgtcttctttttcccattcatgatgctttaaaaataaaacaacaaatagcaaaaccttattttagaaggtattccagccatctaggacctagtctagttgcttctgccctggttgagaaaaatatcagttaaaatggcaaatgcggaataaatgatcttttcaggaatgcacatacataatatgcgtctttctctgactctgccttttctttattaactgcaggggagacagcaggaaggcagcaagtccccacctccccgccagcctcggaaaacagcagtgctgcccacagcatcggcagcacgcagagcacgccttgctccagcagcagcacggcctagcccaacccagcccaacccggcccaacccagcccagcccagctcagctcagctactgccaagggcaggaccaatggctgagcctcgtgtccagactcagagggctggattttggttcccttgtaaagacagagtgaatttcagtataaagatcacccgttgtattcaccccacacccagggctagtataaacatgaccctgggcttctgtaccacactagaattcatgtgagaaagctaaaatggtggtcttctccaccagcccctcacaggcttgggggttttcaatgtgaaacacatgccagtttttaaaatgctgctttgtccaggtgagaacatccataatttggggccctgagttttacccagactcaaggagttggtaaagggttaatagccagatagtagaaccagtgaggagatgcggccaaagattctttatatctgaaccaagatgtaaaacaagaaatgctttgaggctttctaagcgatcctcctgtctaatttgcacctttgtctggatgcacacttctgaccttgctgccacaacctgtggggtctgatgtgtcccttgatgggtgctgccctcagggactgcaccctgacaagtgttaaggcaacattcctttcttgtgccctgggccaaaaccaatgctgatgaccttatcagcttcctgtttcttcccatacttgcatacaccactgcaaaatgtcttaatgcaaattttgtatttcttacaggcctacagaaattgaaaatgaccaaaatcaggaaccacagatttgtgcccattcctaatattttgttctgcaaattaatgtataatttgaggtgaaattcagttataaagtcaaggacgaatttgcacagtgatatatttctatgtgtatgcaagtacaagtatataatatgtcacctggcacattcattttctcagttgaagaagagaaaatttgaaaatgtccttatgcttttagagttgcaacttaagtatatttggtagggtgagtgtttccactcaaaatatgtcaacttaaaaaaaaataggccctttcataaaaaccaaactgtagcaagatgcaaatgcatggcaaatcctgtcggtctccagttggttatctgaatagtgtcaccaattccaccaagacagtgctgagattggaaaagggcactcatttggattgccttacttctcttgccttaaatatatcccatatatttaatatgtcaaaaagggcttgaggtgaatttcattaaatggaataatatgatgccactttgcagctaaaataagctcagtgatacctcct

SEQ ID NO: 36645 - DNA, 8668 bp, Homo sapiens
aaatgtactcagcaccctgctaaggaggctggagaccccatcacggccatggcaatcccgaaggaggagctgtttcaaggttggttatgaacatgtaaccccagagccccgctgctgtagcctggactgggacccccttctgccccctccctagctgtcctgttctggcctccagcacccacaaaccaccacccccaacttaacttctcaggaagccttggagctggagggagaggcctggctgcacccccagctgggactgcccagaggcgcttgtccctgcccatgaaagcctcccttgtcacagctgaaaccttccctctgcctcaggggcccctggaatgtggctgcggggcggggtctgggcccacacaggtggggcaggtgactgtcaggtctcaggcctgagtgtcaggaatgaagcctgcctttgtgtgtgcacagtgcagggtggggctggactggggacacttttctgtctcagcctggagacctgggataggagggagaggggagtggggaagttgaggggagtgcctttacatcctgctggtcatcgtggccacttcagtctgttgagcatttcctgtgagtcatcttgctccaactgagagtcaggctgagctggagttatttccattttcctgattggtagactaaggctcagagagaggaggcggcattacccaaagccgcacagctggtaaatgggaaaagaggggtttaaaggtaagtctctgggctccaggacacaccccctctccctggcatttccctggggaacaggagaggtgtgggagggttctaaggttgttggagacttcattctccttgtgccctcaaatgctcactatggccctgaggggagtctgtgttaatggcctaagtttaaatcaggaaccaggctcagagaggctgagtctctttccactgggctgcactgcctcattctaaggagaaaaggccagctccacagatggccccatctggctgcagtgggcaaaggtcagaaactggcacagcatcctgggcaggctgcctggggcagggcccggggctacagcctgggctggggccagacagagctttatcttcgcaaggccatcccacctggtgctaatgaggaggctccgggccccacccagatctggagctcacagtagcggtttggactgaaaccagggatttgtgcgtggggcagtgaggggggcagctgccgcccctggcctgggcctgagagtatagagaaagccacctcgaggggctgctggaggagagtcaggtgcagaaggggatctggctggggtccagcccttcctcaccctggggtgaaaggcgagtaattgttcttgagttaattgctggggccacaatgtctgcagaggcttttaatgagctctggatgatctgagtttgattatttttctttcggaggaaaagacaataccctcccacccatgagacaataccacactgtctgtgcccagcattggaggccaggctcactgcgaagatggatgagaaggaacccacccccagccttgctggctggcagttccccttgccagcccagctcagatgcaggaatttggggtctgcaggaaggactctttccctgtgccctgtttggttgagggtgtgaggacctgtttgagtcctggctttgccccttaccagtggtgccacctggcacaagttgcttcacctctccaagtttcaatttcattctttctgaatcttgggtgggggtcaccctctgttgtgaggatgagaggaggtgatggatgcaaaagtgctttgtaaatcacaaagtgcagggtagaagtaaaggattatgctattatagcaaaataagaacctaagaacaacctgcgttgccccataggagctggctatggaaggtcgatgccgttgagcctaagaacatgctcaggctcacagggcatgttctgatgcccaacgacaaagcccctcctggtgagggcactcaggcgcaggtgccggtcatgcaccctggcccctgcatgtctggcacctgggtggggatccaggagggggcaggatgggggctcttgggccacagggcttccctggaagtgagagttgagagcgccccttgccacagggaaacagagacttaaaaaggtaaatgtccacagtcttaccatggtaattggtagggtcaggatttgaacccaggcctcacagtcttaccatgataattgataaagccaggattcaaacccgggcctgagggactccagagccctgtccacttcaccatgctgcaacctgggctaggaatcctcctcctgagtttctgtaagccctggggccaggtccagagggctgagccacacctccaagtggcactgcccacaggtatcaggtgtccctggaaaggtgtccctgagctggtggcagagaaaagggctctcctgagtgttcaactccccgtctgtgtgaagcaatgccttggtcttcaagatctccggtgtcttccagcctgcctgccagtctcccttctcttcccttccacagcattcaggcacatagagccttctgcagcggcccgtccccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtgtcgggatcatcagtcatccccttgtcagtcccaagcctgctgggcttttgtgagggtgccaggaacacaggctggaggatggcaggaggggagtagaggtgggaggaggggagtccatctgcagcaccaggtaaggggatggatgctggctcctctggtcacctcagctggaacactactcaaggtccctggctcctgtcctccacctgcccccaggggccctgcattcccatccccagggcctccactctccctgagccctgcagtctctcactcactcactcactcactcattcactcactcactcactcacagggttttgagttggataacacagcataatgatcggccagtggactcccaaactaagaacacggagctgtcctcttggggagaggctcagggctcggggaagtgaagtccagctgagggcacagttggcctgagctgctctcagtacaggcagaggccttggtagctgtgctgtgatgagagttcgctccctgctgctctcttctggcatggagagatgaacctgtaatccaagtgttaaaaccgtgccctggggaaaaacactattaattctgaatcatctcttttgttgcattaaaaaaaaatagaagagaaaaacttcacatgacccactcaaggtgtgcaggcagctgtgtttgtcaggaaggcagaaggagttggctttgctttaggggaggagacgaggtcccacaacaccctctgaagggtatataaggagccccagcgtgcagcctggcctggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaaggtgagtcctcggatgtcaaagagaggggagcaggtggctggtaccctgtacacagctctaatgtcagtgttactgctgactcaaggaaatcctttcctgcccaggcaatgactgtctggtatgtaatctcagcaaatttggaatgcacctgctgtccaggtgcagaggccagtgcacatcttctcaacttggtggtgctgggggagggagagaggggtcttgggaatctggttaggaccaacaggggcacaggtgggggcaattataaagagccagaggcagtagctcacacctgtaatcccagtgctttggggggccaaggtgataggattgctcgtgtccaggatttagaggctgcagtgagctatgactgtgccactgcactccggcctaggtgacagagtggaacctgtatctaattaaataaaaataattaaaaaaaaagagcaactcgccctccctacctcatgcaccctgcaggcttctgcataaagtattcctttacctcttttgcaagaatgggattggagtgtggcctcatgagttccagatgctagaacctcttgtcttttcctataaagaggtcttttgtgccaaaagtactgttgggtcttaggagacctgggaactcattacacattctgccacccactcactcaccattttactccctaagactgggttcctcattcgtaaaatgccttcttaactgccctccaggttgctactggctggaatgttctgtagatccatggctgtgtccaaggtgtgcaggaggcagtgaccatgagttgtccacagtggggctggtggagtgtctctgagagagctattgtcagagctggctgcaccccactgccccactctcctgggcaaccaattcccacaggcaatactgcctccttggtctttcgtgccctggagataaggaaggcagctcctcaggtgtctcaaggaggctggatgggacaaaacaagaaatggacactgaaagtgaggctggactttgcccaccccagaagccgtacagatttttgttggtggtgtcagaggggtgattgtcagtgaggggtgattttcaatgaggggctggccttgggtgcagagcagagagcagcaggggagagagaggagtcctctagacaccgactctgtctcctgcagatcatggccaccaccatcgacaactcccgggtcatcctggagatcgacaatgccaggctggctgcggacgacttcaggctcaagtgcgctcccccgtctctctcctcttcctgcattgcccactttacttggccttctcctggctctgactcaggcagccaagacccctcccacttccttctttggcctccctctcctcaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggtgagagctggcccccatcacccctgaacccgagagaggtggggaacctcttcccaaaactcacttaaattgcccagagggaaagacagtggctccaggaagccctcccagattttcacgagattaagtcagtgggaggcagagtggggctgttggtacttcctcatagttggcctggggcttagtggttcagaaacacacctaccccacaaaaccaggtgtcctcatggagaggaaggggcagtgtctggtagcccaggcccacagccagcccaggtggcccgtatgaatggttgacttcctgattggctttgtgagctcacatcagggccctacagtctcggggtcctcccttggtaggacctagagcagcagagaactccttagagctgaggggtccatgtgaccaaacctcttcatgtgcaatggggaacagcggttggggtgtgttacgggcagagccaggattggcatgtgtgacgccagactctcaggtctctcttctgctctccgtctctaagtgggtccctcccatcctgcaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaaggtgggccttatatcctgccctgcccttcctgccccaggtccctgagtctccgaggaggccccggggctcacttctgttgtgcatgacctacagactgaggagctgaacaaagaggtggcctccaacacagaaatgatccagaccagcaagacggagatcacagacctgagacgcacgatgcaggagctggagatcgagctgcagtcccagctcagcatggtacggccactcgcgccccatcccagcctctcgggtggtagaagctcccactcttcctggctatttaagccttggagttctcaagccccctcaagaggtggttccctgaactccattcagtgccccctccctgcttgccctcagtggcttcctttctagcctgatgtgtctatgcatctgtcactcccccagaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagtaggcgcctgggcacaggggaaggagtgatgagggctgcttgtggctagggtgcagggtcatcctaagggaatggcagggtgtccctaagcagccttgagggactgtgaaaagagaactgagcaaggagggaggatctggactcctcactctggtccttggctgttacctgggacaggtcacttcctctctctggatccgtgtttcttctgtaaatgatagaggctgggctagtggtagttaagatctagtgctcattccattctctgcatgagatagatgggtattcttgtagttcagaatcttgaccagctcagtggctcatgcctgtaatcccagcactttgggagtccaaggcgggtggatcacttgaggtcaggagttcgagaccagcatggccaatatggtgaaaccccgtctctactaaaaatacaaaaattagctgggcgtggtggcgggtgcctgtaatcccagctactcgggaggctgaggcacaagaatcacttgaacccgggaggcggaggtttcagtgggctgagatcgtgccactgcactccagcctgggcgacagagtgagattccgtctcaaaaaacaaaacaaaacaaaacaaaatctgtctacttggggatagcaggcctggatgggctagcaggatgtcccacccctagaggagtcagatgtgtgggtggtggtggtgtagggtctgaagaacactgcatagctatctacatgagcttcccttacggacacttgagcttgtgccctttgcttaaatcagcttccctctttctttcaggatggctggcattgccatcagggaaggtaggaaggctttactcttctggtgtggggtggggaggggagatgttgaagccaccacccccttcggaatagggaggaaggagaaagagcccaaacatcccattaggtgggaacattcccattcattagatgcctcttccccagtgggaacttctgtcagccccaggtgagattgcagctggtgatttattgagaaacttccaggttgagtaggcttcattcagggcatgtctctcccccaggccccatcttcatacacttccgctaagatgcccacaattcatcccccttcatgtgcagcttgaaaaaccctgacattgttgctccctgccgggcatacctgccattgccactgcccatctctgtgatgaggaattcaacaccagatctctggcagctcttgagggattggccagtggccattctcaggggtgctgtctagttttcccagagccccgccaaggtcctggccaccgtggcagagcggggaggttcccccactctaaagcctactccttctctctctagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaat

SEQ ID NO: 36646 - DNA, 83353 bp, Homo sapiens
gcgcccggttgcagcgtggacgccggatgagttgcttttaggcttgctggcccgcggggctgtccaggcacgcgaggcccctcaggtacgccctctcttccctgcaggatccggccctcaaagacgagggtcacgcacgcgttacaaccccgaaacagtagcacaagatttaatttttaaaagagcgtgtttcttcggggcttgccgttcgttcgtttccagcctcaggaatttatggtcgcctttttgaatgaggtagtgtttgaaatgagtaaaatctttttaaaatgatatacatagtataaattgatatagctgtgactttatgtataggcaatacgtatttttatatgtcttaatttattaccttcaatggctgcgagatacttattttattgatgtaccgtaatttacttcagtcaccatgaatatttagattgttttcagttatttgcctggagaaacaattattcggtgaatgtcattgtatacacattttgtacatttgcatgagtatacctgtggagtctatgttaataggatataactaaattgaggaaacgtttgagacggtcccactttcaggttacatttgacttaatagattatgaagacctgagaataaaaggagaaacagaaatggatttagaggagaatgaaaagggggaacagaaataggcttataggtaggatccacatgacttgatgattaattggttgtgtgtatcttctgagtagtgtcaggggtgactcaaaaatgtcatgcctaagtaatgggaagaatattggaaccactaatacagtagtttaaaagggaagcaattctggaaggaattatgaaattttaaacaaaacatggttttagtgtgcgtttctaaaatatattgaggcaaaataatatgaagtaatgtgaataatatgtagttaatatcagggagggtggtctcgaaattgctgaacgggaagttgaggttaaggtgacctgaaggagttgtggagcagcgaagagtcaagggcctggattataataagagggaagcaaaggggatggcatccctctgcacaacaaggttgttgtgcaaggttaacctgctctgtccctgccctgtggttgctggatgctgttgtgcatggacagctctccagtggattcgatgggccatagcaatcctgtgatttatgcatggaggctgcttctcctcagcagctgccatagcccggtcgctggtacatgattcttcctgaatagtcaatgctgttatactgagtgtttatgcttgacgtaataatgcagtgattcttaatctttggggaaagtagagactccctaaaaaacacagtaaaagctgaatgagctggccaggcatagtggctcatgcctgtaatcccagccctttgggagcccagggcaagaggatcgctttagcctaggagttgaagaccagccagggcaacatggcaaaaccctgtctctacaaaccaccccctccccaccaaaaaaaaaaaaaaaaaaagctgagtgtggtggtgcacacctgtagtcctagctacttggcgggctaaactgggaggaacacctgaacccagggaggtcaaggctgcagtgagccatgattgtgccactgcactccagcctaggtgacagagtgagccactgtctcaaaaaaaaaaaaaaaaaaggaatgatcctcttctcagaaagcttaaatcttattttctcaaaaataaaaattcagatagatattcctgaataattgttagaacagtgcaagagtggtgatgttcagactttgatgtgaatgctcatcccctagggatcttgttaaaatgcaggttctgactcgtaggtgcgaggtgaggctggtaagtctgcatctctaataagctcccatagatgtgggccatagtaggaccagccttgaagagattagaatgtgttggtatctaaaggtctgttagtcttcagataacaatcccataagtttcagttggcctctgataaggtacacaatgaacctaaataaatcagtaaatgcacaaacacttattttggtccttgaaaggctagaggttataataagagttgaagatctaaaatgccttaaaccttctgtttaataccttttaatggcatactgtgatcagaaatagctatttcagttagttaaacagcccaactgttcttgtcctgttttttcttaaattaaactcagaggcactcacacatctgaaaaattaatgagggtaaaagaaaatgaaagatactacttgtcacagacttttttttaaatgataacttgaatcaataacttgattagactatgatgcttttgatgctttcaaaactgtttgaggtatgtaggtgtcttttcctgtagagttgattaccctggtctgttgtggttcttgagtacttaagattttttatcttctctgttgttcccttattagcaattttatccccttctgatctgatactgacttggaaagctcgtcacccaccttgttagaattgttaagtaaatataaatagactttgagaaggaaaggtctcaagggtggctcactagatacttaagtcatagattgatcaagtatctctgcatgaggttattagcaaaacatttaaaaagacactttaagacttctctcattagggactaaaccagaaaggtatagggctcatccttcataaaaatcatgaataagcaataaaaagggtaaaatggaaaactggaatctatatttgaatgtgagattctcatctttttagctttaagattttttaagttttaccagttttcctcaaagagaagatgaagttacttcaagagaactgatttctgtcatgtgagtgtaggtaagaaaattcttaactactttgagatatttttcttcagattattaatgagttttttgcaccactagatagaatttccaagattttcctgcttacttttggaaacattgtctctaccattactgaatattaaataatagccatgtacccctccctcacaccatatacgaaaataaaattatttgtggcctaaatgtaagcgaaaaatctataaccttgtttaggtaatggtttattgatgacaccaaaagctcaagcagcaaaaccaaaaattgacaaattgggcatcattaaaatgaaaaatctttgtgcttcaaaaaatgccatcaagaaaataaaaagacggcccacagaacaggagaaattttttataaatcatatatctgataaaggatttgtatccaggatgtatacataacccttaaaacccaaccacaaaaagagcccaattagaaaataggcaaaggataaatatctatccaacgtggatacgcaaatggccaataagcatgtggaaagatgctcagcatcattagtccttagggaaatgcaaatcaaaaccacaagatactacttaacatctcctagaatgactgtaattcaaagatggacaataagatgtgttgggtaagatctgaagaaattagaatcctcattcactgctgagggaatgtaaaatagtacagtcactttggaaaaattttggcattttctcaaaaagttaaatacagaattatcatgtgacccagaaattctacttctagctacaaacccaagagaaatgaaaacatagatccacacaaaattttgtatgtgaatgttcatagcagcgttattcgtaataaccaaaaagtggaaacaatacaggtatccaagaaatgatgaatggataaacaaaatgtggcatattcatgaaatggaatactattcagctatcaaaagtaatgaagtatgaatacatattacatcatggatgagccttgaaaacatgctagagaaaggaaaccagatgcaataggccacatatagatgattcctataaattttcccatttatatgaaatgtccagaataggtaaatctgcagggacagaaagaagataaatcgttgccactggctatggagaagaaagaatggggagtgactgctaatggttttggggtgttttggtggggaggggaggttgaaaacgttttgaaattaggtattactagttatactaccttgtaaatatactaaaaagccactgaattgtacactttttacattacactatgtaaattgtacatcaataaagctgtaattttttaaaagtatggatagtgtcatgtacacccatgttaataatatggtactctgttattcctagatttctcttttgacagtaataaatttgatttcttttgcagcaacaaaatgcttcaacaagttccagaaaacataaattttcctgctgaagaagagaaaatcttggagttttggactgaatttaattgttttcaggaatgcttaaagcaatcaaaacataaaccaaagtatgtgaattttttaggttaagttcccttaagaatagtcatttcttagactgaattccattaaagcagatactttttttttttttttttttttgagatggagtctcgcactgtcatccaggctggagggcagtggtgcaatctctgctcactgctacctctgcctcccggatgcaagtgattctcctgcctcagcctcccgagtagctgggattacaggtgcccgccatcacaccagctaattcttgtgttttagtagagacggggtttcaccatgttgcccaggctggtctcggactcctgacctcaagtgatccacccacctcggcctctcaaagtgctgggattacaagtgtgagccatcacgcgcggcctaaagcagatactctttattaatctttctattcccagaatcccccagctccctatgtagtgggtactcagtagtagatatacattgaatgaatgagttctcaattattggggtaaattttgtttctttaaaaggtcatctgagtaaaatttatgtgtcatcctccgtgtcaccctctttccacctttattttcatcaccaccctcgtttaggcacttatacctaagtaccccatagaaggctactatagtactacctgcctttagtcctcattcacctaaaagactagtcctttaatcagtgttttcattatatgtctcctctggtcaaaaactatgagataggggtttattgccctattttactgatgagataactcaagatcaggataaataatttgccttatgtcatggaactaataaatgaaaaatggataatcaaatggaggtctctgtagctctaccacaattgtagcctttctgaaggcaggaccaccagtaaatatcaaatcaattatgtctgtcggtttcctgatcttgctgcttttctccttgaagactccactatgacaagagctatctatagaaaaatgccttaaattttggctgtttttaaatggcttgatatatttttattacctgttagatttaccttctatgatggtcctccttttgcaactggactgcctcactatggacatatacttgcgggtacaattaaagatatagttacaagatatgctcaccagagtgggtttcatgttgacagaagatttggatgggattgccatggcttacctgtggtatgtttgagtatccagctttataattttctgattttttttataagcattagattttgtcatataatatgttcaagtatgatgaacgttgactgtcagaccttctagttcatttctataatatttgtagtttgatttgttttgttttctagagttgcatagttgcagttgttttcatagggcagcgtggtaacagtcttatcacaaattttcaggaatatgaaattgataagacactgggaatcagaggaccagaggatgtggccaaaatggggattacagagtataacaatcagtgccgagcaattgtgatgagatattctgctgagtggaaggtatgttgggtttttttcagtagaatgaacagcaaatgtagttactaaatgggcattgaaatggtttatggtcccttgtgctttttttattaatttattttttgtagaaaaagtgttagcttccaccttcaaccctattacttaaacggttagcttaaactgaaccatctctcttctgacttctgtgtgcttaattggtctaactttcttgcatgatcaccaatagggaaaaattctaataagtataacatgatatataggccttttctttttttctcaaatacttttttcaatttttttaacttttcattttgaaataatttgacttattaaacaattgaaaaagtagtatgatgggttcccctatatccttcatccatctttcccagctgctaacatcttcggtaaccataatattaatagaattttcaaaagcagttgccccattaatttttatttctgaccaatcacatattgcatttggttgtcatgtctttttagtcttcttaagtatggaacatttatttagtcctttgtatttcatggccttctcacttttgaagattgcagaacagctattttctataatgtctctcaatgtgtgaggtttcctgatttaatttaggttatgcatttttggtgacaatgccacagaagtgatgctatgcccttctcaatgcattatatcaggtggcatgtgttgcggctatgtcacattgatggtgataactttgttcacttggttaaagtgctgtcagctttctgctttgtaaagttgtagtttttcctttgtaattaataagtatcttgtggggagattctttccaaatattcttttttttgtcatacattcacttattaattttaacatccatggatggtttttgccagtaataattatgcctgtgatatttgccaagtggtggttttggtagacttttataagtgaatatttatacttgtaaataacattttgtgcatgtaggatgaatgccgagaaaactggttcttaaccttacataatatgttgttggcagtatagatttacttgtaccattgattattctgttttcccaaaattttcatttgtgatgacaacagaaataaacacacattgatgtacaattataaatatcattgtctaatactgttctaatattaatattttaaagtctactgttagcagacttggccgatggattgactttgacaatgactataaaactctgtatccacaattcatggaatcagtctggtaggtttatttaaaattgtaaatatggtaaatattctattctgttgtattgataattggaaaaatgcactagcatgaatcagtttatttttgagtccatcgttatttctctgaaaatctttgggaacaggtttgtttttgaatgtagaacttttatttttatttttttgagactgagtctcgctcagttgcccaggctggagggcagtggcacagtcttggcccactgcaacctccgcctctcaggttcaagcgattctcttgcttcagcctcccaagtagctgggattacaggcgcccgccaccatgcttggctaatttttgtctttttagtagagatggggtttcaccttgttggccagggtggtctcgaacttctgacctaggtgatccatccaccttgatctctcaaagtgctacgattacagacgtgagccactgcgcccagcctgccagttgcttttcttaacattatgtgttaaatatcattcgatatcagtagatattagcattttaatgtctgcctgatgtcttactatattgatctgttataatttaccagccagtctcccaatgaaagacattgttttttcacttatttggcagacagaaactctaaaaagaaaatggcataaatgtttgcattttcagaaatagaattttgttctgtaattgtgaaactccatctcttaccaggtgggtcttcaaacaactctatgataaaggccttgtttatagaggtgtgaaagtcatgcccttctctacggcatgtaacactccactttccaacttcgagtcacaccagaattataaggtacgtgaaatgtagagacattattcagcattgagttttgtaggtggaagctgagtagttatgatcacagtaggtattcccaagtagacccagtgtggaatgttgcccacgacatccaccactttgaccacttcttactgagtgctggaaatattgccagttagtatactaaggctctgttaagatgagggattttttttccacattggatttatgatgtgtcttaatgtgataggttttgcttgttttgaccatatttttgtgcctctctgttgggttaacaagtccagctttgacatacttcctgtagtcatcgtttcttaagggttgagtaattttatgccttatctgggacctcatgatatcatttatttgttaacggtatttggaaaaaaattaatttgagatgccaaatggtattatttttcctctgatgagatagaatcagttgttgttgttgctatgattgaggtgtttagacatgtttgatgtttacagagtgtattgttataccatatctagacagatattatatactagtaagtcttctgaaatgtgaaccatctcttctcgtgtgtatactgagttgttttcagttttgagagtttatctgaccctctgtttttaaaggatgttgacttgtttggaattcttgtttcatggcctaggtttgaaaattacattagtaaaatttgcctttcaaagcacgttttatttatagaatgctttcacatatcctgtttgattgatctttgtaaatccttgtaaggcaggtatgatgatttctattatctccttaccacctctctgtgctcatgtttgtatttttttagtaaaatattttaagcacttaacaatgtagagaatgatatggtaaacacaaggtttccaaggcttacctttgtcaaatcttaatatattgctatatttggtttttgtttgtttgtttgtttgagtcagagtcttgctctgtcgcccaggctagagtgcagtggcgcgatcttggctccctgcaacctccacctacccgattcaagcagttctttgcctcagcctctggagtagctgggtttacaggtgcccaccaccacgcatttttagtagagacagggtttcaccattttggccaggctggtcttgaactcctgaccttgcgatccacccaccttggcctcccaaagtgttggaattacagttgtgagccattgcgcccggcctgtttggttgttttttaaaacacttgaatgtggacagtttcagggacatgcaaaagtaaacagaatggtataattaatttctgtaggcccattaaggcccccagcaccaatgactggctaatcttgcctcattcatacacatattctttcccactttccttccaattctgaaacaaattccagatatcatattatttcatcaagaaataatccagtatagatctttcataaataatctttatcttctttaaacattgccatgttagcattcgttgtcacaccttaaaaagtcatcagcagttacctttttgttgttgttgttgtttttgagataggatctcgctatgtcacccaggctagagtgcagtggcacgatctcggctaaccacagccttgacctcccgggctcaagtgatctcccctttcagccccctgagtagctgggactacaggaacataccaccatacctggctaatttatgtgtttctataggagtggtttcaccatgttgcctgggctggtcttgaactcttgggctcaagcagtccacccgccttggcctcccaaagtgctgggattacaggtgtcagccactgcacctagccacctttaatagtttttattttaatattctcaaattatgtaattcctgaacatcatcagttcatatttctaatggtttaatcatttcccaaggggttatattttatttttatttatttatttttttaaatcaggatctaccaagacttaaacacatggtgactgttgtcttttaggtcttgtacacgtttcagttggttatataacaagtagtggaattatcgagtcagagtatactttgttttaatttttatttttttgagacggagtctcactctgatgcccaggctgaagtacagtggtgtgatcttggctcattgcaccctcctcccaggttcaagcaattctcctgcctcagcctcccgagtagctgggattacgggtgcccgccagcatgcccagctaagttttgtatttttagtagagacagggtttcgccatgttggccaggctggtcttgaactccttacctcagttgatccacctgcctcagcctcccaaagtgcgggtatttttacaggcgtgagccaccacgcccaggtgagtcacagagtatacttaatttttagttctaatactgaggttgggaaactttcctctgcaaattaaatattttaggcttttcaggcaaagtgttctcaattttgtcaccattcttaactcacccactgtatgaaacaagtgatgagccagatttggcccaggggccatggtttgctgacctctattctacgcggtctgtatattgattgttaaccaagggtttttaaaatttttttgacttgaccaagcacagtggctcacacctgaaatcctcgcacttttggaggccgacctgggcaacatgacaaaaccccatctctactaaaattacaaaaattagctgggcgtggtggcgtgaacctttagttccaactactccacaggctgaagtaagagaatgacatgagcccaggaagttgaggttgcagtgagccgaaagtgtgctactgcactccagcctgggtgacagagttagactctgtctcaaaaaaaaaaaatatatatatatatatatatatgtgtgtgtatgtatatatgtaagtatacatatatatgtattggcttaaaacttttatttatttatttttagagaagggatttcagtctgtcacctaggctggaatgcaatggtgcaaacacagctcactgcagccttgacctcctgggttcaagtgatcctccagcctcaccctcctgagcagctgagaccacagatgtgcatcaccatgcccagaaaatttttttatctttgtagagatgggatctcaccatattgccccagctggtctcaaactccagagcttgtgcgatcctcctgccttggcctcccaaagtgccaggattataggcatgagccaccgtgctaaaaaattttaattttttacaaaaattagctgggcatggtggtgcacacctgtagtcccagctattcaggaaaccgaggcaggagaatgcttgaacctgggaggtgggggttgcagtgagctgagatcacgtcactgcactccagcttgggtgacagagtgagattccatctcaaaaaaaaaagaaaagaaaaaaattaattttgatgtagtttcaaactcacagaaaagcggagagttctttatatccttcaactagattccctaaatgttaaccttttaccacatttgctttatccttctctctttttatgggagtggggcacagtaccctttgagagtaagttgcaggaattatggcccttttcctctaaaaactatatatttcctaaaatcagtaacattgtttgaaataactggagttagaaaattaacattgatgctgtattacctcatgtgtagatcttattgggttctgcttgtcccagcagtgtcctttatagttaacaagaaaaaaagaaggaaagaaaaacaaaaaagacctacattgtgtgcttcatgcagtggtatgtctccagccttctttaatcttaaagagctctttagtctctttatgcctcataatactgacatatttgaggaggtacaggccaatagtagtgtctcttatttcaagtttgtctgatgttttacatgtgactaatggctctcgtgtcactttatttaaattgcagttggtttttgttggggattgattttttttttcctaccttagagctatttatttttaaatccttgatatttttgtgttgaaacatttccgtaaagttggagacaatcttgttcttatttaatgagctgaatttatatgggtctgttacaatttcaagtatgtgttgcttcagtaggatctttttggtattttgggcaaaaagataaccatattccagaacagttatctttttgatctaactcttgatggacttacaaaatagataatcataatactgaaacctccatcatatgttcctacttagacattactttaaaaagttaccagaggccaggcatggtgactcacgcctgtaatcccagcactttgggaggctgaggtgggaggatcacctgcggtcaggagtttgagaccagcctaaccaacatggaataaccccatctctactaaaaatacaaaaattagccacgtgtggtgacacgcacctataatcccagctactcgggaggctgaggcacaagaatcacttgaacccaggaggcaggggctgcagtgagccaagattgtaccacagcactccagcctagtgacacagtgagactccatctaaaaaaaaaaaaaaaaaagtcaccaggtgtcaaaagacattatttttgagactactaaggtgatgattaaaacattttttaaagtatttaaaaatttttttacttggaatttcttgctattttctgtttgtaagtctggtaagtggtttcttcggtttaccctgaagatttattttattcctctttaggagtagttcctttttcttaggtgtctgttattgtggatttctaaaacaatactttacctcaatttatttcaggatgttcaagatccttcagtatttgtaactttccctttggaagaagatgaaactgtatctttagttgcttggacaaccactccctggactctacctagtaaccttgctgtgtgtgttaatccagaaatgcaatatgtgaaaattaaaggtaagtgggaggctggttacttatgattaatatggataagataattttatattttggaaaatatgaaagcttacctttctttttgcatgaagaatagaattatttgaaaacaatctgacttaattagaaaaataactttaaacatttgttttcatttctaattgaaaactaacaaaacaattaaaatagtacagagatataaaaagtagaacataaaattttcttataatttccagtttatagtacatttttccacaccatgcccctgtgacagatgaagaatctaagattcagcgatgtggcatcacgtcgttactagcaattgataccagaacttgagaactttttgcctttcaaatgtcccctggtagagagttaccagtctcaacgagggcctttccgagatttaaaaagaagattggtactttgtgaacaaatataccttcaggtttggtagttttgtggcggtaaaagaaaaagagaaaaactcattgccatgaaaaaagctatggcacagctgctgtggaaggcagtgacatttcttcaaaaagctgaatgagatgacactatggcccagcaatttcacttctgagtgttttccccaaagaattgaaagcagtcttgaacagttacttgtacacccgtgttcataggagcattattcacagtagtcaaaagatagaagcaacccaagtgtctatcattggataaatgaataaaccaaatagggtatttacgtacagtggaatattattcagcctaaaaaagaaaggaaattctgatacaggctatgccttgaatgaacctggaggacattatgctaattaaaatgagccagtcaccaaaagacagatactacatgattctatttatatgaggtatcgagaagtgaacttcagagagcaaagactagtagaatggtggttgacagaggctgggagggaagggggagttattgtttaatgagtacagagtttcagtataggaaaatgaaaaggtttagggtattgataatggtaatgattacacaacattgtagatgtatttaattctgtgtaagaatggttaccatgatttttaaaaatagttgtattaaaacagtcaacttgattgaacaatagcttgtgttggcaagggaaaaatattgagaaaggaatggggaaagattgggtgccagaaaaaaggtacggagggagttttttatttgttctttcctgggagcaaataggactaagagttgacctactggaaagctgttggccacaaagaggcctggctcaggtgtctgcagctgcttctctggagcaaggacagtcccatctgcacaatttccctatgtcactggtgggtcactagccattctgtggtgagcttgacaatctcagcagccacctgactgagatctcaaaacacatcacccatctacctgtgtataactcttgtgcttggcagactttgtatctgagctttatcagaaactgtggtccccacttacaatgaagttcctgtgaggtcagagctagggagtggcagccttattcatagcagtttttcaataaattggaaaggcttttacaatgacccatagatactcatttttcttatagtgaactaaatatatgacataggctctagtaaatctcagatgtgtaatatcatagcttatgatgagagtttaaattggcctagattttcagtatcaaagttttaactgttcatacatttgctccagcttttcttttcctaggatgccccaggtatcctccagaaacacttacaataagggtacacagatgcatcaaggacattcatcatgccagtgttcatagtagtgaaaatttgaaagcaatttaagtgtctgtcaacttgttagaaataattcgtacctctataaaatagcgtcccatagagctctttaaaaggatgagaaaagtctgtatgtgctaatacatggaagtatgttgacagtatattaagtgaaaagctacaaaatcagatagaatattacctcaattagaaaaataaaaagaacttacacatttacctatatgtttgtttgtatatacatagaaaaatatccggatccatagacacccaaatgagaatgtctgagagggggtgatatgtggcacttaatttgtgagctactttgtcaatgttatttttaaacattgacatgtttaccttatgaaggaaaaaataaagatttacttaaaatggatatctgagcgataaataataactaccaactgcctaagtgcatttgatgtttttgtcattttcatgtttgggaagcagtataccatagtgttctttgcagtatttctctgtgagtactgggtacagtagaggcacatggtacaggagctcctcaggacaaaagtatgcttgatgcatgtctttggaatcagccaagttcagaatataacccaagtccatgtttttcctttttctcgtagatgttgccagaggacgattactcattttaatggaagccagattgtcagccctctataaattggagagtgactatgagatccttgaaaggtgaatattcaaatagttgctctgtgtttgtgtgcatgtgtctgtatgtgtgtctttagttttaaaaagaaataaactttgttatccaaaagcttgcattattcaaatttagttttaagtactaatactatactaagtactttgcagtcacacattacagcatgaatggctagggctaagaagccagtaaaccagaggggagtggtagcttgatgtggctgcagcctcatatttgattttaatctaattgtgagtttgcctttctccttttctagatttcctggtgcctatcttaaaggcaagaagtacaggcccctgtttgactatttcctgaaggtaagcttagggaccgctactgtgggcgctctccacaatctgattatttgatagctggggtgttgtgagaagtggaattgacattacttttatgagtgtacctgaatccagaaagtctgctttagtaccaacaaaattaaattgtttgtgtagctttcttgtcttagaggatttttttttttttttttaaaaacagggtttcctctgtcccccaggctggagtgcagtggcacaatcacagctcactgcaacctcgacctcttgggctcaagtgattcccctgccccatcccgagtagctgggactactggcacacagcaccacaccgggctaagtttttagttttttgtagagacagaatctcgctatgctgcccaggctggtcttgaactcctggaattgcaagcatgagccactgcacctggctgggattttttgttgttgttgtttttgagatggagtgcaaatatcgtgcaatagcgcgatcttggctgactgcaacctctgccccccaggttcaagcaattctcctgcctcagcctcccgagcagctgggattacaggcatgctgtaatttttgtactttttagtagagatggggtttcaccatcttggccaggctggttttgaactcctgaccttgtgagccaccgtgcctggccaagctgggattttttatttgaatatttttctcaaattgtatgaggaatcattttacatttgattggatttttaggtgtatatttttattgcatgtagtctacatatcacccagggtatttattgaggtttttgtttgtttgtttgttttgacaaagttaagatagtaatcacagtaaaacatcatgtggaaaggtaaacacaattttatttcaaggaggttaatgaggcaggtgttttaaatctaggcaccacgacagagctcatacatttagcaccttagtttcttcagagtcataaagttgttttatgtggttttattttctgacagtggagaatccacagctacagttgcaaaccctgctgtccccactcccacactctctcaccgaaagaatagtgtcaaagaggaatttctccgtccttatttaaaggtcttgaaatgagataatgagcagacctggccttatgtggaaataataatcaactggacatatcacttacgtcccatcccagaaaaaaatgttcgctgaaccctcagttgtttctgttccgtgtggggagagtctggttgattaaggagacctctgtggtttgggccctatccatggtgtgtctgttacctgccttttcacttttgtgcctcttgagtgttttcccacatttctcgttgcctacttgatagccttcttcctcctcccacgttgctgcccagtggatttccatatgttctgccctcatcccattcctccctacaggcgttagttatttaccagcaattaggacgtgccctccccagtcggtatgtggcagagctgcttcctgaccacatcctcccacattactttagacatatcctttattcagtcaaactggctcttccctttcctgcttccctgcctttctttaattaagttttcctactgtcttaaaagtctttatttttttcttatgttgatatctgctgagttaactcacccttcaggtctgaactcagatgtcctctgaaagttttctgaaatgcatctttggtttctcccttggaaaaatgtcattacttcattccattctcctatcatatagcttaacatactttgttttatgttgtattttttttattatctgaaatctcttccactggatcagtgactctcacctttctgaatcacaaaacctattgagaacccaaaaactcaaccccctgaaagaatgcacatggatacactagacaggaactttaggttaagtagaggtctgtctggaatatgcacttggtaggtattaagttgaataacacctactcattaaataagcttcttaaactacctgaaaccttcggtgactttaggcaagtactataaatcgtttgacccaggacggaatcatctgatgttcactgaaatatacctgttgtgaaatatcgagggaagctgagtcagcggacactgcctatggagcagcactgctgctcctggtggttggtatctactgacctgggtggaagcagcccagccatggcctgggtaggcccaaagtagaccctgagagacaagatgcagtgactttgtctatactgcttctaagtatagaacatgtaactaagtatacatgtaattctaaggacccatgtattctgtctttctgtttaaactatcgaagttttagcacctatcatactataacttctaaaatgtttcaaggtgatttaggttacaacaattaaaattttatggttatttttcaagtttagttttaagttccaaagaaaccgagtgctgtgatgtaattgaaaataacattgtatttgcaaccagaagacctgttccatgtcctggcttcatcattgctggttgtgtgatttggataagactaagtttaatctttgttctgagcttgctcatctgtgaaatgcaaatacagccagaatatttttaagacatgggactactaatagcttgttcacagaattataggagttaaatgtgaaaatcacttgtgaaagtactttttaccaatgcaaaaaggaaggacatcaaagggccagtttggcagaaacaagggtttgtggaaagaaatgtaaaaagatgaaagtagagtaggtctgttagcattatatgtattaacatgatgatattgctgttgcaaagaaaatgaaattgaacacatttcccctgagtattaaggtggtggagtacctgtaagtagaacttactactcgtggctcccacctgttcctttcaagatttgcctttatgactgaataacttgagctgagttgaaaggagaaagagaagcaaaacatatgcagtgattgaaaatgtaccaggaagtgaacaatttagggagcatgctttctgagactgtatcctaaactgcatagggacaaaaagttgggggagggagaactaatgaaaaacacgtttgtaaccaaggaaattagaaatttttatctgccattctccagataattatttcgtttataagtggtaactttttatttatgggaaaaatgtattgaattagcatgtttcttcccagcctgcattattctttcttttctatttctgaaaataattttaccggttaaaagcattttcaggttcttaggaaaaactgttacaaagttaacgttgtaacacagtaatgtttcatccctgaagcctgctgtcctttctttccagtgtaaagagaatggcgctttcactgtgcttgttgacaactatgtgaaggaagaagaaggcacaggggttgtccaccaagctccttacttcggtgctgtgagtagcataagtctggcaaatgtatttgagtatgtcggtagccacttttcatagatgcggagtcctgtgtctcatcatgttgggttaccaggttggcctcttttctggctcactgcctgcaagatggcttgtaaaatttgcatctgcaattccctttcatcctaagctgatttctggaaagagtgggccaaatccagtaaactctttttggtgtgcagttccgtgagttttgacaggcatctagagacgtgcaggtgcctcagccaccaagatacagaccattcccatcacctctgctgtgttcttaattaaatgttcagaagggggaatctgacctctcccctcaaaacagtactctacagttaattttatattttgactagaataatttttctaaaaacacattcctttttatgtaatttgtgtatgaataaaaacagaataacataaaggcacatgctttacagtaaaccacctctcaccttaaatcatggcactgccactaacgggcagttcctgggtaagttgcctggcctatctggacttcttttgcctcctctgtagcatggtgtagcatggtgtagcacctacatacacattcctctaggcttgatcgttttgtcagtgagagggattggaaatgtgactttgttctaaaaggcagtggcagtagtctgccctcatctgccattttgctttcatgcttaatctctgggattttttacttttatagatgtagagggtacgggtgcaatttttttacattgatatgttgtatagtagtaaaatctgggcttttagtgtaaccatcacttgaatttttattatggaaatcttgaaacatacacagaagaaaatatgataatagattctttttttcacatcatccagctgcattaactctcaatgttttggcaatctctcgttttcttcctctgtacagtagcacacttttttattttggctggaggatttaaaagcaaatcctcatcctcatgtctttcgtgtctaagtaattctagctgcatctctgactgataaggacttttattttcagtataaatatccaataaagtcagcaattccttaataatcacctaatacctggtccattttgatggaaggaagcattcttgataatactacttaagagttttaggaactagtcaaatattgttcataatcattttagggtcaattaactggtatggttaccccactcttagtagataataaaaaggtaacttcttggttttgaattgtagtgtaggggtttttttttttttttttgagatgggagtctcgctctgtcacccaggctggagtgcagtggcaggatctcggctcactgcaatctccgtctcctgggttcaagcgattctcctgcctcagcctcctgaggttttcttttttaaatgtgggtgtttgtcattaactctagagttatatctcatatatctattctcaatgctgtgcatgttaatgttatagaagattcattctttaaactatagcttttaacaccatttggtaaatttttttttttttttttttttttgttttgttttgtttgagacagagtctccctctgttgcccaggctgtagtgcaatggtgcaatcttggctcacggcaacctctgcctcccaggttcaagcgattctcctgcctcagcctgccaagtagctgggattataggcacctgccaccatgcctggcttattttttgtaaatttagtagagacagggtttcaccatgttggccaggctggtctcaaacttctgacctcaggtgatctgaccgccttggcctcccaaagtgctggggttacaggcgtgagccactgcacccggccttggtaaacattttctgagaggccttccgttgcacttgtcttcaccaggcaagggtagtgtttgatcttcgcagagtctgtgcacttgtgcgtcatcctgttgaacatcactggttctggatgcattcaggaatgctgctcttagcttaatgcactgggtaaagttacttgctccacactcagtggttcaaattgctgcacttaggggcttttcctgtctacccacatgacaccacaccagtcagcctcagcacagggagaggtgaacacagatccaggtggaagcatgtcagctttccagcttgtcttggagtcaacccagagtgtggtttcaccaacataaggcaatctctttaattttatatttaggcatcataacacagtgatgaagactatagactctggagccaggctgtttggttttgaatcctagcattgctgcttcatagctgagttacttcttggtacctcgactttcctatctgtaaaataggaaatttttggtttttcagatgtgtgtgctgctgttataaatcaaatttgatttagttttaaaacattcctgtgtggctgctctgcttatggagtagccattctttattgctttactttcttaattcctttcacttaaaaaattgatgtatgtcatctatcttctcatttagtggatactctgctacatatggaggtctgggaaataatatttgagaagactagactgggtgacctaacccctgtccaactgtgagggtctgattctccgaatggtcttgagttaccttcagtttacaggacaaagttgatgaaatgtatatgttacaatatagaacaattatcttgggaatctattacctcatgctcacacccatacatagactgttttattcttccctctcttttgccttttctcaggaggactatcgggtctgtatggactttaacattattcggaaagactcactccctgtttgccctgtggatgcttcaggctgcttcacaacggaggtgacagatttcgcaggacagtatgtgaaggtctgtaatccatatagcatagaagggtgactgttacttctgattagtctctaccatcatttataattgtattgtaattcttctaggaagttgtttttatttggttttgtcatcgcatgaaatccgtaaagacagatgttatcagttacgttcagagggtctcatatctttagaggatgcatgctgaaatttcatggggaaagatcagaaaaactccagttcatgcctcatgaagcacctttgtgaccttggggttgtcatttcagatcgaaaaactttatgaccttaaatgttgtggaatgtacttgaaaattacttaaagttagtgactaaaaataataaataatatttgttatttgtgccttttattcataacaaggtatcagattctagtaatatattgttcctaagtattatagtatgttttaatggctaaattttaattttttttaataggatgctgacaaaagtatcatcaggactttgaaggaacaaggccgacttctggttgccaccaccttcactcacagctaccctttttgctggaggtcagaagaaacaaagactgtgttgtagctagagcttccagtctgtgcttacacttactatatgtgcccattccatcttatttgtggtgttcatctcacttgtatcctttagagttggtttgggaagccaccttcttacttcatttttaggagagttgggttttttgtttgtttttttgttgttgttttgagatagggtctcactctgacgcccaggctggaatgcagtggtgcaatcacagctcactgcaccctccacctccccggcttaagcaatcctcccacctcagcttctggagtagctggaactatgtaggtggtgccatcacacccggctgatttttgcatttcttatagaaatgaggtttcgccatgttgtccaggctggtctcaaactactgggctcaaataatcctcccaccttgtcctcccaaagtgctgagattacaggcatgagccacagcgcctggtctaggagagttttatgaatggctaaaaatgttgctttcctaaggaactgtgagagaaaaatagacctgtacaaatctgttttgtattgtggccacattttttttaggatgagaagcatctctaaaattttgtaatagagtttattgaaaaatttaatatgattttaacctttaatataagaccatgctgtaaaagtatgggtgaaaatgaaatgttcagttgcatcgtgtttggtttccacattgcctcttctgtgttgaagttgaagttgacattgtttcttagataattgtcactagcagaactatttttttctactcttgttcttgtattagtttttgcctttcttactattgtggaaagatatgaccaattttgaagtcttagatgtttttatctataataaaaatgaatattagcagaaggccaagtaagtgatgatgctgtcaataagacatgaaaagtcagtcttaccgtagtgcctactagtctcagcctgagcagctatgtgtgtgtttctgcttccccagatcagacactcctctaatttacaaagcagtgcccagctggtttgtgcgagtggagaacatggtggaccagctcctaaggaacaatgacctgtgctactggtgagcagtaagatgtgtttcttcatagtgtcttttgtcatgtggttagtaagtatggtttacacttcccccaagttataattttaataacccatcttttattgggtattgtaatagctatcttttcttctgtgtgtttaggagcacaaaataattcaaataatgttacagaacagaagtaacatccttcttgtgataaagtatgtaagggagtatttttctttttaaactcattggaaatgataaaccaccatttattcgatttagggaatgaaatgaccttggaaaaatatggctgtactgccagagtttgctagccttcaataatagtcattttcagagtaaacattattttcagatatacctgcaaaagccatttgtacttactcttgttggtcctgcagtggatgatgtaccctgtgcttggctgtatggataagctccaagcacagaagcctttgctttccatagctgatatgtgtcctgcaggtgatagcccaagaagtatcatttcagcctctgggtacaaaatgaaacaaggcttgaacctgtgtatttcagatgaatgtttttcactacaagtttgaaaagtaatcaccactcttaacttctcacaaggacccaactagactctagaaaactgtatctgagtttaggagaatggggagaatctcagggcagcaaaggaaatagttataaactgtagctttctaatatttcttagcagagtggtcctgatttctcaaaagacagcttttcatttttagagctagtaagctaattagttcccctaatgtgtaagatactagatatagaatattagtaagatagcctcgagggggtgcaggcatataaactgatctttgaagtacagggcagtaactgcagtgcccaagagaagaaggggaggtctggtagcctaccctgactcagccttgtgcttgaaaaggatttctgcaaagctgaacctcaaggaataaagagtactgggagtgggagggatgcaagaggatggatgcagaagggagggaagctgcgtgtcagagggcaggcaggctgcgtgtcagagggcaggcatgggcaaagccagttaagtgagaaggattctagggaacttgcctcattgccagagcctgaaattcaagaccaaggatgaccagagaggtgactatagagagggctgctagagcagctaccaatcccctggcctgttggcctttgcttaatgagttcagaaaaactgctatggtgaggataatgtgaagactagagttgtatgggatgaggctggctaaagctaaggtgactggttagaggtatgtggcagctgtactccagttgaagaggaggacatgggaggcctgtgtgctgtggggtaatctattggatgtaggtcattgatggcagcacaaactgttgtgtgtgctatgctgtccatttagaagacattctctttgcagtgagcgccacgtttccagagtgtttggtccacaaagcgttatacaaaggctcctgtgggtattatttacatgttgaatttttccatatttttatgtgattggttatgtgatctgtttattgcagggtcccagagttggtacgagaaaaacgatttggaaattggctgaaagatgcacgtgactggacaatttccagaaacagatactggggcacccccatcccactgtgggtcagcgatgactttgaggaggtgaggcatggcagtatttccttgtgttgatttttgctaaagcattttgttcatgaaatctgaatgtggtttaaaagaatagggtgtttttttctttgcccctttcttatttcatcttttttcctctttattcctttctagaatcatgacataagataatctgtttctggggtttttaactttttttccttgaattaaatacaatttataaaactttcctctgtaaaaataaaaggatacagttttctcagggaaatacacactttaaatgttttttttgtgtgtttccccgatgtcttttcttccccctacattaaggtatactattagcttatggttaaactgactttatagatgatgaaaaaagaaaacttgaaaagaaatttaccaaagcattacagacctttaacttctaaaatcaaatgaataagaggatgtgtgtagatatatagatgtatgtggatatactatgtcctcacttaatgtcatacagaggttcttgataactgactttaggccgggtgtgatggctcccacatgtaatcgcagcacttagggaggccaaggcaggaggatcgcttgagaccagatatttgagaccagcctaggcaacataatgaggttccatctctacaaaaatgtttgttaaattagacaggcatggtggtgcacgccacttagttccagctactgggacctctcaatgacatcaggcgaggacttactatacagatagatctgtgtgtttggccttctgtccaaagctgacagcattgttgcagtgatgagcggcagcaccctggggaccttggtgaatctcccatagggacctgaaaggcaacagtgaagtagctgaatcagaagacttttcaggactgaacaggaagggcagagaaagaggccaccagtgttcactaggatcagaagctccctgggtgagaacgcacagcagttcctactggtgtggcccttgtcagatgatccctccattctgagtgccccagctagccccatctctcagctctttacctggatataatcctagcatcctgtggctttgtctgattgctttaatcgggtccaagcataatatagtcatgcaccacataatgtcattcagtcaatgacagaccgcatatacgacagtggtcccacaagattatgataccatatggttactgtgccttttctgtgttttgtaatgtttagaaactcaaatacttcctgttttagtctgtttagtgtagctacaaaggaatacctgaggctggataatttataaagaaaagtagtttatttggcttatgattctgcatgactggaaagttgaagactagacatctgcatgtggggaggacctcaggctacatccacttatgatggaaggctggacaggagccagagtatgcagaaatcacatggcaagagaagaaacgggcggtggggtgggggcaggctcttttcaacagtcagctctcacaggagctaatagagagagaactaactcactgcagaaggagagcattggtctcttcacgagggatccaccctgtgacccagatgcctcccatcgggctccatctgtcaatactgccacactggggattaaatttcaacttgagatttgctggggacaaaccatatgaaaactagagcatttaccattgtgttacagttgcctgcagaattcagtacagccacatgctgtacaggtttgtagcttagaagtaataggctccaccatatagcctagctgtgttttaggccatcccatctaggtctgtgatgtttgcctaaggaaatcaccctaacaatgcatttctcagaatgtattcccaccattaagcactgtatgactataatttagctctagctttttcttgggaagattctagattaatgagccagattcaggtgccaggaggaaactaaaatgccttagagaaataatctaagatgtttcacttatgccagttactttgacaatttgcacataataaacccttaatatccattgagagtatggctatgaatgtttaagattctctctaggtagggactccctctgatactggggtggaaacagaggagcagtggcaaccctggcctcttcagagactaagagtaggctgtgtctttcatgagagagaagccacattagcaaatactatccttcggcccagattggtgtgttaatgtgcctttaaatcatcagtctcaggctgggtggctcacgcctgtaatcgcagcactttgggaggctgagggtggctgatagctcgagtccaagagtttgagaccagcctgggcagcatggcgaaaccctgtctttactaaaaatacaaaaaattagctgggtgaggtggtgcctgcctgtagccccaggtacttgggaggcttaggtgagaggatcacctgagcccaggaagctgaggctgcagtgagctgtgattgtgccactgcactccagcctgggcaatggtagtgagaccctatctcaaaaaaaaaggaaaaagaaaatcatcagtctctcaaagtaaacatgcatgctatataaattaactcagtatgctctgtttggctctaaggagctcctgctattgaactttgtttttgacaggtggtatgcattgggtcagtggcggaacttgaagaactgtcaggagcaaagatctcagatctccacagagagaggtcagtttctaaatgttcgattcacttcagttttacgattctcctattaagacctggtctctagcagattacagagccacacatggaagtgactagcttgctgaattactttgctgatgactcatgtcatattgcagtattgtggcctctgtccttgtgaaatgtgaggtgaatggtgcataacctttcagatggaggattcatggtgctctctgaaagcctttgagaattgctgatatttctgtttgcaaatgtgtataatatcttgtcagggttttgtgtttcctattagcaattaaactgcaagttctgttatgcttacagttaatagaaatgactacttttctgtttgttagtgttgaccacctgaccattccttcacgctgtgggaagggatccttgcaccgcatctctgaagtgtttgactgttggtttgagagtggcagcatgccctatgctcaggttcattacccgtttgaaaacaagagggagtttgaggatgcttttcctgcagatttcattgccgagggcatcgaccaaaccagaggatggtatgcctccttgttctttcatcacgtgttttattgattttattttatttagggagtattttactaagtcactgccatttatctactgggtgatggagagattgtggcaaataagacaggctacattcctgccctctcccctccaccaccaagcacggacattaaagtgccttttgagtaggactctcccactacaatagggctgtagttttacaatttcaatgatctcactggcattttggaatatatgtgttacactggatgttaaaatgataaaaaaagttatgtgttcttagcttacgtcagatcatttactcaaatgtttgagtatttgcataaaagacagtagtttgggtgctagaaatttgagggatagttggtaatgtgctcagatattgaggctagccttataaatcaacattctaaaaaaatccagatttttaaaaaatatacatatgagagaggatttgggcattgatttttatctggtgccttatgtaaaacagttccttaattggaagaaggtgaattactttctttccatggattggctttgctggcccaggctttatttacttttttttttttttttgagacagaatcttgcactctgctgcccaggctggagtgcaggggtgtgatctcggctcactgcacccttcgcctcctgggttcaagcaattcttctgcctcaccctcctaagtagctgggtctacaggcatgcaccaccatgcccagctaatttttgtagttttagtagagactgggtttcaccatgttggccaggctggtctcgaactcctgacctcaagtgacccacccgtctcagcctcccaaagtgctgggattacaggcgtgagccattgcgcccagcccaggttttaattatacattcacagtaatgtttctgcaggggtgtgttaaaggaattgttggtgtcattttctctctttgacagctttgggtaatcattgaattcaagtcttcatgttctggaatgtgctgtcttcagattccagtcctttttgtctataggaacagctacccagcacaaattctgtttttagaaaggggtagatgccttaccaatgagcttgttcctttgaggagtagcaaagtctgttagctggtaacagtcctcatgtggatcccgtgtccttggtgcctgcctccttctccattcctgaggcctgggctacctctcctgggcaccagggctcctcccaactctcctttagaagtgggagggatatctggatcagtgtttatgttaactatggggtctggtctcctcagctcatgtcccttgatgttctcagagtgcaggactaggtaagagaggcaggaaagcatcacccccaggacagtggtcagggatatgagttcatttgggaaacaagctaggtagcacataaatgaggtacataacattttacagaataaaagcattttctagtctgccttatcacttttgggtgagagtgcattttgcatcttttgtcatcaaattgtcttttccatatgatcttgtgccaaattcaaaacccatccttcatcttcagctaggtgcttctgggtggtcctgagaggccacccagtgctgccatgtggctctccacacagacttcctgggagctctggtaacagagaaatggtcagtaaatcattccagacgtttatttcaatgcttctttcaaatcttagacagtaatttgattggtctccagtaaccaggattaagaatcattgctttaagtgattctcaagaagtgtgacttatcaaaaatagaaattcaatgaataaatacagtttctttcttatgcttggacttcatttctatttttattgaactgtttggggttttttttcaggttttataccctgctggtgctggccacggccctctttggacaaccgcctttcaagaacgtaattgtgaatgggcttgtcctggcaaggtaggtcaactttgttgtagtgacgggtggaactttgtctccactgtttcttaagaaggagtgcgtgagagcggtcaactttgttgtagtgacaggtggagctttgtctccactgtttctcaagaaggagtgtgtgacagctaagcctgatggaggaggaggaaggggaggactttcagattgtgctactgctagtaacataatgctactagtgatattactagtaataaaatagcatttactaaacttagcactttatgaaatacttttgcttatagatcttatttaatctgtacatcagtcctttcatgtagattttgttgtcctttttttaacacacgaggaagctgtgggttctagagaccacaggtgcccaggatcaaagctagtgacagccacactgggcttgaccgaggtactctgccaccagatcccattcttcccctcatctgaaacttcctcccaatgggcattatttcccacattttgctattataaggaagtctcatttttcctttactttattacctctagtcattaagaataaaaataaacataaatgaaaattttaaaatgaaatattttaaaatagaatttgtgctgagtacccacacagaaatcctactttatatgctgtgtgaggaggaagaggatgtcacctaacattttgtgcatccttattttttgccaggccccactgtgtgcattttcacattttaactcatttaatccccagaaccatttgagatgggtcctataatccctttgtgacctttgaggaatctgagggacaggaaaaagtgacttgccaaaggacacacagcaaatgagtggtaaatgcaaattttgaacccaggcagtctgcctctgtagtatgtgtactactttttttttttttttaattgaaaattttattgagggctgggtgctatggctcatgcttgtaatcccagccatttgggaggccatggtgggcggatctcctgaggtcaggagttggagaccagcctggccaacttgataaaacccccgtctctactaaaaatacaaaattagtgggtgcagtggcacacacctgtaaccccagctacctgggaggctgaggcacaagaatcgcttgaacctgggaggcagaggttggagtgagccaagatcatgccactgcactccagcctgggtaatagagtgaggctccatctcaaaaaaaaaaagggggaaattgtattgagatcattgtagatttgcatgcaattgtgaaaaataatagagatcccttaaattctttgcccagtttcccccagtggtcacattttgcaaaactacagtatatatcacaaccaggatattgatatagcccactaatcgtattcagatttctctagttttacatatacttatttgcttatacgcatttacctgtatacggctatcgtgtgtaggatcctgtatccagcagcacagtcaggttactgaatgaattcaacatcaaaggctcccttcctgcattgccttcccctcctgccttcccactgtcatccccaatccctggcaaccactggttttttctccatctctgtaattttgtcgtttccagaatgttatataaatagaattatacagtaactaacttgggggaattggctttttttttcttttttttgagacagagtctcactctatcacccaggctggagtgtagtggcgtgatctcggctcactgcagcctccacctcctgggctcaagcgattctcccatctcagcctcccgagtagctgggaccacaggcatgaaccaccacacccagctaatattttgtatttttggtagagacagggtttcaccatgttgacaggctggtctcgagctcctgagctcaggcgatccacctgcctcggcctcccaaagtgctagtattacaggcatgagccaccgcacccagctggctttttttaaatccacataattccattgagattttagatgactgcacctaccaatagttccttcctttccatggataaatagcattctgtattatgggtatgccatggtttgtttgatcatccacctcttgaaggacatctgggttgcttctaacatttggcaattgtgaataaagctgttgtgaacaattgataataggtttttatgataatgtaagttttcatttctttgggatatattctgacacatctttcttcttcagtctaccctgaagcttcctcatggacttagtatgatattcaaaaagaagtttgcaaatattaacaaaatatcttaccattgtaccttaacactgtttgtttcttttttgagacagagtcttgctctgctgcccaggctagagtgtagtggcgcgatcttggctcacttcaatctctgcctctcaggttcaggcaattctcctgcctcagcctccccagtagtggggattacaagtgtgcgcccccacgcccagctaatttttgtatttttagtagaaacaggtttcaccattttggccaggctggtcttgaactcctgacctcaggtgatctgcctgcctcagcctcccaaagtgctgggattacaggagtgagccaccgcgcccggcctattagcactaacttctatctaagttactccttcccatttcattttgtatattcctgtttgcaaatgatttgtatccttaaaacaagatcatctgtgatattgacttacttaattggcatctcccttttgttttacaagtgatggccaaaaaatgagcaaacggaaaaagaattatccagatccagtttccatcatccagaagtatggtgctgatgccctcaggtacaaaccagtgctttgccttgtgtgtatctattgtttttttatgtaagcatctcctatactattaatcagtattcttagatttggtttatagttaggtttttagcaacatatctctgttatttggatgttatgttggtatggttgttgattttaaacccccaaaatagttttctaaataataaaggcatttttaaacctagaggtctgtttgaggaagaggacctgtgttgggtgttgttgagctgtccaagtcctccccaggctagatgctgattgcctctgccttacttcctttctaggttccctgtcttgttggtattagaattctctttcatcatttgttttaattttgtacttacagagccatgtgagatatatctatgctagaggtgataaaaaaactcatattgaaaagcttttggagaaatttgagccactgcttgaggtagctgtaatcatgaaaccacacagtgttcaagttgaaagggacctagagatcttgttcagcatccctgtgtcctaggcatgagaccagtgcccaggcctgtgactcagcaccttcacacagtacctctgttgaccaggagccattagtggggctctcccccaattctccactgtctcttagactcacccttggcactgctgcccatttgggctgtgtaattctttgtggtggtagttctttgtaggatgtttagcagcatccctaacctctgcccaccagatgtcaagactctgctctgtgaaggctcttccttgtgagtccctctctctgcaagcagcagatgcaggtcgtgtccgtgggaaggacacagtggctcttgacgaggaccaggccagcctttctcttagtgctggtgtaccccattggtcctgcagtgagagtggcataagatgcatttctgtgctatacagtgccatattttggtgtcagattatatacgtcttttataatttgctaagtctcttatagaaagtgagagtgagttttgtgagttttaaattgaccactcaaagagtattcataattacccccttttgtagaaaataggactgattttcatcttgctctctcaatatgtcgagtagtaataattggtttactgtctaagtaccttttctgtctaatttttctccctcttccagattatatctgattaactcccctgtggtgagagcagaaaacctccgctttaaagaagagggtgtgcgggacgtccttaaggatgtactgctcccatggtacaatgcctatcgcttcttaatccagaacgttctgaggctccagaaggtatgggctgtagggggctgcacatgtacctgccgtgtctccacagcgctcccttcaccaagctgtgaggtggagctctgtgtgagactttagggctgctgttctctgctgcctgatgctggggtaacttagagccatggggaggccatacatgcaggtgcggaaggtatctagggtccgggctatgccaagaccatgggccctagcctgcaaaagagttatgtcatatagttgtttagtcgccagttgttgtttttgtttttgaggtggagtctcagtcttgtcacccagactggattgcaatagcacgatctcggctcactgtaacctctgcctcctgggttgaggcactgcctcagcctccccagtagctgggattacaggcacccaccaccatgcctggctaattgttttatatttttagtggagacttggtttcatcatgttggtcaggctgatcttgaactccagacctcaggtgatccgcccttcttggcctcccaaaagtgctgggattacaggcatgagccacggcacccagcttcgtcagccagttcttggtaccaggaacaccatgttgagtgagacacccctccccttatggaaccaatggagtgggaattgggagatacagtaaagagtcagcaacttttagagagagcacccagtgaaggcggagtcacaggcaagctagggctggccacttgagatgggtggtcagagaaggcccctcagtggggtggcatttgggctaatctgagagtgacagcagttctcgatggagttttcagtgggttgttagggtcacatataatagttgtgatgtatgtggaagtgtacttcaatggcagttacctccacgcccaggagttactttctcacctgagaagcccttgctctagagccaccttccatgccccacaactgaccattgtcagcgtccatcaccttcattgaacatgttcctgtatgggctttcaagacctgatttggggtcagagttccgatactgcacatctgatctccagcaccttacaagtaaaattgcttgtaagtaaataactgttgaatgaaaatgagatattattcctgcttgagcagatgaaaaagctggttggaaaaatgaactcttgttatcccactccagcaggcaggtcaattacttctgctccccttgggctctggttgttctgctaatgaggacacatcatgttcacctgaggctctcagagtagcctttccccaggaattgagaagggcagtcatcttccccaggctcccagcattcctcctctctgcagcctgccacctgtcctgcatgtggttctctgccaagtagggcaaacagtccttgggcaggtgcactctgcaggtctccactggtgtgggactcaggaatacaggcggggtcaaagctccccacagccagggcccatctgaatataccagcaagacacagactccatgatcagggccttaaacacagaggaagagtcacattatcactgccccgctagcctggttgtggtgctgccagagaaacaaagcaggacatgagttctgtttgtagagcaaggacttaagatcaaggaggattttgcaaagcaaaaagagtgggatagaactttctgggtaaaatgaacagccttagcatggaaattatttcccagtactcattttcagtttgtggacaatcattcaatcctagacagttctactgtccttccttcctgaggtttaaagtaactaaaccctacacttttctgacaagattttagaatatctttcaattcataattactctttggtgcagagaagtaatgttttcctaaactctcttcagtttactcaaaaacataataaattaattgaggacttaatgtgccacgttggtgcttatcttgaaaatattgctgaaaatcagaaattcacattgccagtagggtctgggattttttctttttgtttttgtttaagtgatttaagaagtttatttcctcatagtaactttcttcccaagtgtgccagtgtttcattaattgttccttcctaggaggaagaaatagaatttctctacaatgagaacacggttagagaaagccccaacattacagaccggtggatcctgtccttcatgcagtctctcattggcttctttgagactgaaatggcaggtgagtctctcttggtctgtcctcccaggaataaggactattctctttgtaactgcccttttgatatttaatagtggaaatattgagagatacagaaaattaaataattgtttccttttacctctcatatagttttgttaaggcttgttaattgtcgtgatatctttgtttcaagaccctggggacttctggcctggtgtggtggctcacgcctgtaatccccagcattttgggagaccaaggcaggcaggtcaccttaggtcaggagttcgagaccagcctggccaacatggcgaaaccctgtctctactaaaaatatatttaaaaaaaaaaaaaaagttagctggccatggaggcgggcgcctgtaatcccagctattcaggagactgaggcaggagaattgcttgaacctgggaggcggaggctgcagtaagttgagattgcaccactgcctgggcaataagagcgaaactccatcttaaaaaaaaaaaaaaagccctggggaattctgtctttagggggtgtcctcgtggtctcaatgctccacagaagagctttagagctggatagccatgggttcagagcccaactctaccacttgttcccaatccagagagttgcctgaagtctgaccgtcaatttccttttttttttttatgggtacatagtagatgtatatatttatggggtacaggagatatttttatataggcatacagtgtgtaatagtcatatcagggtaaatgggatatccatcacctcaagcatttatcatatctttgtgttgcaaacatctcggttataccctttttcttgtttttaaatgtacaagaaattattgttgactgaaatcaccccattgtgccatcagatgccactcttattcagcctatcttgaccttcagtttctttatctgcagaatgcccagtagtgtttgtaaggcttaagtagagacgatttacataaagtagctggcagatgataggtactcaataaataatacttgttattaatgcatttataacttatttttagttctattttcattactaaatagtccccttcttttccagaaaaattagaaaagtcagaagagcaataatgaaatggacattttgctgttatttctattaactaacaacagtgagttcgttgggtaattttacagagattcaaaaagtacattatgttggcttccttaaggtttgagataatcacaactgtaggtccaggtgagaaatctgggacacctcagacagtcagttaaagtgggtggacagaggccctgggtcacagtgagggcaaaagagggcaaggcaaatccaccctcacagggctctgcggttcctgctgctgttgggcaggagcagcggccgccacagacctgggattcaccattagcctagatacgggcacatgctgctccctggagtaggcgctgctgccccatttagcacagaaggactgctacaggatttgtccaccttgttaaacatgtagaaggatcacgacagtccagctgttgctcagatagacacagatgaagatggaagtgagtgtgaggctgagtgctgccctggcgagggcagcactgggagcccagcacactccccagacatgctcacacctgtgtctgcttttccctcctgagtgatacaagtgggtgggaaacgtggggattgttgcccggacccccttcaatatttgggcaccagctgccatgacctcctgtgaagctgggtctggagatgcgcattctggctggagcctggtctgcctggaaactggagatcggcagccacgttttgtgggccgtgtttaagtcccggttctgccggcctgtcagcttcatgtcctccactccctcaggagcactgtgggtatgagaggacctgcctcacagggtggtggtggcctgggtagtggctgctgctgctgcccctgtgtgttgtatgtttatccattgtatgtggagttctatttgggttcatttactccctcagagttgaaaccagaacatagaaaacctgagcttcctggaaggtaaaaagtgccgtgaaccctagaaatcatttagacaggtctcagttactgaaatcacatgtctaagaaagtgtgaccagctaacgactctggcctggggctcagcccactgacatctgagttctggtctttgtgaaaagcagcagagagcagctctgccggttgcaacttctcgtctcttagcttagaccagaagcctcattaacagtccctggactcttttcattattataaattgtatttgtttctaagtatcggtcttattctttttgttttttgtgtttgtttttatgtaacaaagagtattaattaaatgggaggtgaatgagaatccttaaaataagccttgcctcagacaattggctaaacaccctttctttcctacttgatctctgagtttctcagggaactcttcaaatcctcctaattcctcaagaccttcactacctctgatgctgtttttactcgactgttttaatgtttagaaggccagttctattttattcatagcctgtgccagagtttcttaactgcagcactatgggcagtttgggccaggtcatcctctgtggtggggctgtgctgtgctttataactgagcagcatctctgggtctacccattagattccagtagcaccgtgctaccctccaagttgtgacaagcaaaatgtttctccaaacgttgacaaatgtttcccatgggataaaattgcttttgtttgagaatcactggcctatgctgtgcctcttagcatctgaattgtgctttttgtcttttagttgaagtacagtgtaatacaatggaaagaagttgggcattgttgatgctgtcaaattgcacagctccgtgtaaatggcacttcctacagttgtgtagtgggcagtcttggactttgatccacacatactggagtttttggcttttctcactgaccaatgggaattcgcatgtggctcacatggtgatttttttgtgtgcacccctaaacactctgactgccatgtagcacatcctcaacaaacagtcattatgtgattgattcattttggttcttttctccttagtaagtggaggcacttggatggaaggagctgccccttctttgttgtatccaaccctctccccaccccagatgcctggtaacccacttgctgcctgattgacttgtcttacttttagcttataggctttatactgtggtgcctcgcctggtcaagtttgtagatattctgaccaattggtatgttagaatgaaccgcagaagattaaaggtaagtgcagactgctgttgggaaaagcaaaaagtgtatgaagtttgaaagtagaagaaatatgagaatagccagaagggagaggaacattttcagttgctctccgtttttgaagctttgtttttcttttccttttacattgcattttaactatatttgtcatttgagggatagggatctataagttctaaaagtcattttgcattattttcacaacacaattatgtacatgtcatattggagggagaatgtcaaggcacaaacaggactacactgagcagacctcttaaaattcaaaataaaatcatgcaaatattttataaaaatactggtagatatggcattaatattgagaggggtacttccttctaccacaagggagtcagatattatttactgtggacagaactcctctgtagctgttgggggtttaggatgagcagagcataggtcctggtctcaggacttaagccaggtacataaataacaatgatgcttaatagagagagcgaggtctctttactgcaggcccaatgaaggctcccactacccattagtcatgtctttttttttttttttttttttttttttttttttgagaaggagtttcactcttgtcacccaggctggagtgcagtggcatgatcttggctcactacaacctttgcctcccaggttcaagcagttctccctcaacctccccagtagctgggattacaagtgtgcaccaccacgcctggccaatttttgtatttttggcagagacagggtttcaccacgttggccaggctggtctcaaactcctgacctcaggtgatccactggcctcagcctctcaaagcagtggtgttacaggtgtgaaccaccgtgcctggccagtcatgtcttaaaaggcattaataataaaagcctgcaacacaactgtaatttcatttttgtgcagatgtatctcacacacacgtatctagaaggacatatgctaagatgcttacagtagttgtctctggataaattaattatgattgtaggaaaaacaaagataatgaaaaaatttcaatgaattggtattttttttaatacacattatatacttttttaacataaatcttatttaaaggtactttaaagtttttggttagcaactgtttttgtctgttgtgggtagatccattctaccttcagccttcgggtcctacagttaggctctacttccctgtcagctcgcctcaggtggggatagtcagtgggacagcaggtgcacatcctggccaggcctcctgcactgccctgaagggccaccctggtggcactgaccgtggatggcctgtggtcgtggccctttctcctttctctgtctcatgtcttgtctgtatgctgcatgttctttgaagattgcctctttttaataaacttatttttttaatgataaacacttatttaacagtttaatgtttatgtttcctttttactcattagggtgaaaatgggatggaggattgtgtcatggccctagaaaccttgtttagtgttctgctttctctttgcagacttatggtaagatgattggcttctttctagtaccctttggcctatgggctgccttcagcacctacttgctgcagcatcctccatttatatccattctgtattattctgccaaaaatagatatagaagttttataacaccttatagctctagttccttatcagaaatcttgttagcttatacatgttaagtaaggactaagaaatactagattctttcttacagtctctggcagtacaatatatgtcagggcccttggctctagaatgaggatctacagttcaaagtaagacatacctcatcttaatgtggattgccataattgtgagtaatgggggaggttcttcagctaatacctgtctgagtaaatatatatatatcacaaaaaatactttaacttagcattgagaggaaaacgtgcaagtaattgtttgatatatgttcttatcagttcagatattagttaaataatataaaagtggaacggctccaactttaattctttttatcctgtttcctttactccatatgttataaggctcctatttattccttaaccgaaggaaaatctgctttgtacaaggtgctgtgcctggtgctctccatgcctgatctcatcacctccatcctgtgaagcagggggtattttccccagtttacagatgaggtttctgaggtgtgggacagtcagtcttctgtgcatattgacttggctgatacatcattaggtgctcctgtttctattttagacatccttcagaattctagaggtgctttgggtttttctatctacagtcctgcagctatgcttcagggatatgaggccatttctcattcacagggcatgttttgtaacctcatgctcattttggtgcctattactgtgtcattctctaacatgtttagttgtttctcagtataaatgagatcagttgttgatgactgcatataactgacatgatgtcctgtgtcttcatacaggctccctacacaccttttctcactgaattgatgtaccagaatctaaaggtgctgattgaccctgtttctgttcaggacaaggacacactcagcattcactacctcatgctgccccgtgttcggtaggactcaaatagaaataagcctcacctgtgccaaggaggggagagttgctcaagcatgtggggaagaggagggatttccctgctccagctccatctgtgccttgcctcccgccccagctgacatgaactcctcaggctgcaggatggggcccactttggtacacggtagcaaggatgcttggtgtggaacccctttgtagagctgtggcaggtggggtgtgggcatgccccatgggggctccttggggagatgccgggtgctgagtggtaggcactgcgctgcccttccccagtgcttcaccaggagggcctagccacacttctctagcctgaccctcttcctcgcttatgcatgcctagtgccttcaattttctcctcttaaatctaaactctttcatattcctacctctaccactcagagaagaattgattgacaagaaaacagagagtgcagtatctcagatgcagtctgtgattgaacttggaagagtgatcagagaccgaaaaactattcccataaaggtttgaaattttacttctattttacatggcacagacctaaattaattaagtgtttggaatgcttttttaatatagagagcttccaccaatggcctttttccttttctgcagtgagggtgtgaatgacttagtactagtccagcctgactagagcttgagattcaaataaacatttaatattccatttttctgcagttttagaggactggctgctgagtgaactttcccctcccttttcctcctagtatcctttgaaagaaattgtggttatccatcaagatccagaagctcttaaagatatcaagtctttggagaagtatatcattgaggtaaggtagatgatttgtctgtttttggtacagatagacttagaacattattttgatgaataatcctcaaagtacatattgactctataatttatttttattagtatagtcataacaaatgtaataatccatattttacactgtgcttggaatcaacataaatttgttgtaattcttttaaaaatatttcaagatcaatgaatttctttacctatcatctatcatcttcattcacttccctgaagttctgttcttttctgtcctgtcctttccttttccttttcccttactttacttttctttcttttctttcgacagagtctctcactctgtcatccaggctagagtgcagtagtgccttaccacaacctccacctcctgggttcaagcgattctcctgtctcagcctcccgagtagctgggattacaggcacccgccaccatgcccagctaacttttgtatttttagtagagaatggggtttcatcatgttggccaggttggtctcaaactcctgacctcaagtgatctgcccgccttggcctcccaaagtgctgggattacaggcatgagccactgtgcctggccttctgaagtactttttgataactaccaaagaaactttgttcctccaaattatgcaagtgacaagtaccctcgcatgtaaaaagtcgaagcaatagcatagggagcctctctccaccccatttctccctggagtctcacttcctggctgcttcataatttatttaattactgtcccgttgtttgacatttaggtttctgattacaaacaaaagctttgtgtgtacatatatgcatatatcagtgtatggatattggatagattccagaagtggagttttggggtcaaagtttatagtgtcagttgtcttcctaaacatttttattccatgatattttaaaacatctttattccatgatgttttaaaaacgcatatgttttacctcatcttctttgtgatgatagaaaacaaatattttttaaaatttcattgtttattcttttcacaggtgatatttaaaatcattattatagaaaatgttaatttctatatttggttttcagttgcttgaaagttgcagagaaatattagaaaccaaaagttagattttaaattctgacattagtacctgtggctatgcataaaatagaaattttttttttttttttttttttttttgtgacagggtctcgctctgtcacccaggctggagtgcagtgatgtgatcttggctcactacagcctccatctcctgggctcgggcaatcctcccacctcagcctcccaagtggcggagattaggcatagtagtacaggcttttgtagagatggggttttgccatgttgcccgggctggtctctaactcctgagctcaagtgatcctcccacctcgatctcccgaagtgctaagattacaagtttgcgccaccacacccagctgaaaaattttgaaattaactacttcacttaaaatgagattaattaatgtagctaaatataatggcaaaactaaacattccgtattatttgcttcaagctgttctcattttcccatccgctactgtgccatcaccatccctgccgcatcagtaatcctcagtagcatgactgaagcatgaagtgttctgtttaactgatcttctgcttagttaatagttaaccttgtggtactctgcaattgcttgcacaaaggttacctctgagggatgaggtttatatttctgggtctggagtcctttttctgttatgctcaactgtcttgatagatcttcataacaagcattttcttcttaccatacaaatcactggtttttaagcatatttatagaatggtacaactatcaccatagttttagaacattttcctcgtcccagaaagaaagccagtattcattaacattcacaaaccattttcccctcaatatctgaccatttcctggcatccacgaacctatttgctatctctggatttgccttctctggacatttcatataagtggaatcatacaatttgtaatctttatgtctggcgtgtttcacctagcataatgtttcacattaatttatgttgtagcacatatgagtgcttcagtccttcatattgccaaatactctattgcatgtgtatgctgcattttgtttatccattcacagttgatggacacttgaagtgttcttgctttctggcagttaggaataatgctgctgtggacctacatttttgtgtgaacatatgttttcatttctcatttttgtttcctcttgtgcattaactgtaggaactcaatgttcgaaaagttacactgtctacagataaaaacaagtatggcattcggctaagggcagaaccagatcacatggtcctggggaagcgtctgaagggagcctttaaggcagtgatgacgtccatcaagcagttgagcagtgaggagctggagcagttccagaagactggtaggtgtctacacagacaagggcaccatttatgtcctgagtctgagggatactttttaggctactgtttgacttttaatatcacatcctttcctttcctgtcctgtcgtgtcccgtcgtgtcctgtcctttcctttcctttccttactctcttctcttttctctcttctctcttctcttttcttgacagaatctcgctctgtcatccatcctggagcacagtggcgcgatcttggctcactgcaacctctgcctcccaggttcaagtgattctcctgcctcagcctcccaagtagctgggattacaggcacgtagtaccatgcctggctaatttttgtatttttggtagaaacagggtttcaccatgttggccaggctggtctctaactcctgacctcaggtgatccacccgccttcggtcccccaaattgctgggattacaggtgtgtgccactgcaccggtccatccttttcttaagtaaaactttttttcctgttgataaaaatgtttattataaataattcttacagtttagaaagaaaatagctgggcacagaggctcacatctgtaatcccagcggctcacatctgtaatcccagcattttgggaggcccagttggatagatcacttgagatcactacaggcacatactaccacacttagccagatgtggtggtatgtgcctgccatcccagttactctggaggctgaggtgggaggatccctggagcctagggtgattttgtccttactttcatggtgcttgctgacattgaagatttgggaaaataattatggttttgataagtgttataaagggaaggtgtagggtaacataaaaacatgtgggggtacctaaccaaatgatgggattaggaaagggaaatcagccccatcttgctacccctatacagagcatttcagggtgcccagaaatttgcagctctgccatgattagaatcatacatggtctgagtgtggctgtctgacatcctgtaactatcctggggcacaagctgtttattgttacggcttcctctgaagttgaaaatcataagctaggagatgtcttgagaagagagatttgaggattcataaatcagatgggggaactgtccctaagattctccaaatatttagatagaattaataaaacataagacatcagcagctaaacctcaagttattactaattactaatcaactcaaaatattaaaataacaaagtgttacgagccttcaagccacaaatctaaattgttcgccagatagccaaagcatcaaaaattcctgagatggctgggggtggtgactcatgcctgtaatcccagcactttgggaggccgaggcgggcagatcacgaaatcaggagattgagactgtcctggctaacacggtgaaaccccgtctctgctaaaaacacacacacacacacaaaattagccaggtgtggtggcaggcgcctgtagttccagctactcaggagactgaggccggggaatggcgtgaacccaggaggcagagcttgcagtgagccgagatcctgccactgcactgcagcctgggtgacaaagcaagactctgtctcaaaaaaaaaaaaaaaattcctgggctaaaccttatttgaaattgaaagcctagtttctgagcgtactgttctgcactgatggaaaacaagatcatcttcagaacacagagacaaagtaaacataaaaatgacacccgggtgctcagagcccaagaaggtcatcatcagtgacaacagtgggcctccctatcagcgggggtgttaacatcagcagctgttcacatttctgcctcccctgaacaggcatgatgctcagtactacacactgcccgtctcattttagcctcaccacaccttgctcagcaggtagcagaacaccatgtcatacaaccagcaaatagtggacctaagttcactttctctttaaagactgtattttcttcatgacatcctgctgctctgtgtttatggtgagcatttgttgcctcttggtgccttcccttagctttgtcatgtctttggacctgagagtttatataaaacagtagatactggtgatgacttaactgtcttcaaggtagcatagtgtaatctaaagaaagtttgtcatgtcttggctacaaccatgacatgagtcagagggaaatgatctcttgaagcctctgtggctttgttattgtgaaattttaatcaagaaggggcataatacacgggtagtggggcagcttgaagaggaggggaagctgattaacagtgtagctgcttctccatagggaccattgttgtggaaggccatgaattgcacgatgaagacatccgcctcatgtacacctttgatcaggccacaggtgggactgcgcaatttgaagcacactcagatgctcaggtatttttctgtttcctagaacatttctttaccaagagatgagagcataagaggagaaagtatttgcctgtgcctttcctgataatgttgacagcttgtctcagggtaaaataaaccagttacttggtttagattggctttattaaactaatatattattatgcccttaacatatgcatttgtttagtgaatacataagtaagcattttgtgatttctacatgtcagtcattgtcccaagtgtggggttgcacaaaaatgaacccttcaaggaatgagtcagtcaaggacacctgaaattaagccagttcttagtattctacctgataagttatctggtagaaataagtacacagagggctcctatccaaaaataggtgtagggtgaaaagtggtcagggaacactcttttcaagagaatatacaaactgttttagattccaggatcaatattttttgccatattggagaagagactatctctttgcagtcctgaccagacatccccagtcagcatagttgtaagatctcgcatgtgggtttggggatattgcaggggtccctctgtgcttagcataccatgtgcaggggaaggtagagcagcacctccatgaaaggaaggtcgacctcctcagtcctttacccaggcgcttaagttagatgtgtacagaactctacgtgggaagacagtggcaaggagtcggaggtatcgtagctgggaaagaaggcagggaggaggtttctaaacactgacagtgggcagttcttcctcattacagcagatgttaggggcctgaaaagttgtccaccttacaaaagtgtcatgtgatgcttctgagtttcttgacatggcttacatgttgtagtggccctgcactgactggaattttgagtttatcatgcatttcactacctctgatgcctttatgaagtgagtcatttcttaacttctctgtttactcaaaggtaaatgagatgatgcctaatgtacaagtcttttgtagagtatattttactctgcaacatgctgtgtaacagaagcgatagtgtcattattgctacatcataatcagcaaccttcagaatagatgagatagaaacattaaccttagcaaaaatatggcagtttaagtcacagaaagttttgtggtccattgtagaatttgtcttgagtcgttctgacaaacctgaagatcacaggggtcatggtataggaaagtcacttggagttgactgcgctgaggccgttgatccacttgttgtggcctgaaaagctgtgctgctccaagggcttcatgattattgatcttacttattagaagagttgatattacttcttagatggccaaaaagcagagtcatgtgagggactctgataagaggtggtcccagggcatctcctgtgagcagcaccctacaaaaaaacaagaaacaaaaacctgcacacctttctccagagacagaggactagctgattatgaagaagtacctgaatgataaactagattaattttattgcttttgctcatttgtgtgaaaaaatagtgctgcattatagactctccagatttaaataacattttgctgagttgggaagaagtgtttctccttatttgattgtcatggtgtgcactgttcattcccacaggctttggtcctcttagatgtcactcctgaccagtcaatggtagatgaaggaatggctcgggaagtcatcaatcgcatacagaaacttcgcaaaaaggttagtttgtcagttaagaataagctactgttttggctttttgtttgttttggttgtttggagaagataggagaggcaggtaatataaaccatagtgatcaatgcataacaatcactaatccatagtccatttggaatgtattctgcagaaaagtcactcctcttcctctccccacgtgttcactcccaagtcgtagctttcagccagcctgtgccttttcccatccttttttttagctccgttgggcttctacagaatatcccctgtgactggagcagaaggtaatcagagctgatagtgtctttgcagaagggcagaggtgcagtcagcatagacaggcttctagcttaggggagattcccggatttggacagagttgggtagtttttccttattagagagctgaggaatatgcagggagctcatcctggagcgcagaggggctgcaaagcccctgctagtgagagaatcaggaatttcttgccctgtagagggcagtgacagctaacatacatctttcttcccagacggttcaaggtctgaggaggctgttccagcagatgagtgggtgcttgtgacctctgaatcagttcagagctttgtaagtgggttctaagtaatttcttggtttcaacattcatgaggtactgattgttctaggaaaagaaacatgccctatcccccaaagagtggtgaaaaagacacaaagttaatcatgtactgagtgcagttagtcttacggatcacccagcagggagggaagggtgactgcccttctgtgatgattcagcatgggatctgtagcccttgttcaacagtaccttccttcagttctgattaatagaatgtacttcccttttaaatttttctgtgtgtgttttcagtgcaatctggttccaactgatgaaatcacagtgtactataaagcaaagtctgaaggaacatatctgaatagtgttattgaaagccacacagagttcatatttaccaccataaaggctcccttgaaaccatatccagtttctccatcggataaagtccttattcaagaaaaaacacaggtgagtcctgagttccactgaactactactaaagggtttcagattaggtttgactttgtgtactcacgtgttgatattctgtcccacagtagagatcggcacagcactctgtcttgaagtattgctctggacagtagtgggtagagtcagagagtggaagctcagaaaagatggagcagggagggaagatggaactgttttcacaacagttctcttgaggaaggtagccaggagggtacatgagctttgcccggaaataaaatggcctgttttttctaaaactagaaaaggcagtgtgtggattctggtaattatcattaaaagtaaatagcaattggcttgaaaaacatttaactcttctggtagtgggttctccataaaagtacagtacaaaaaaagaaagattacaatagcatttctgttgttacatctaggaattttagatatacttatgaaagtatgatattaaggtagggaagatattggcttataacttagaagtagatcatttagactgggcacagtggctcacacctgtaatcccagcactttgggaggccaaggcgagcagatcgcttgaggtcaagagtgcgagaccagcctgggctggtgaaaccccatctctactaaaaatacgaaaattagctgggcatggtggtacacgcctgtaatcccagctactcgggaggctgaggcagaagaatcgcttgaacacaggaggtggaggttgcagtgagccgagattgcatcactgcactcgatcctgggcgacagagcaagaccctgtctcaaaaaaaaaaagttgatcatttaaaatatacctcagtcacttgcttaatcatttgctccggtctcattctatgagacaagtaggacaagacaaggaggggctgatgatggctgtttattttttcagtgaggcgagttgcagtgtagtttcattttgtattttgcatattgtgtaattatttgactttttttaagtgagcatatatttttaagaaaccaggataagaagagaagaaaaatgggatataaattgtagcttttgatactttgagtaatgagattgaatatgttatcaattgtgtacagctcttgttgttactgagaagtcactgtgttacacgatggtgtggcacattgcagtcaggtgccacagttactcagtcatacgttctcatgtgctcagttgaagggatctgaactggaaattacactcaccagaggatcttcccttcctggtcctgcttgtgcatatgtcaatcttaacatttgtgcaaatggcagtgaacaaggtaagagtaaattccatgatttgtgtgacttttttttagttatacttatggatgtgaaaaaacaaccaaaaaaacttatggatgtttttaagagaattggaataattatttaatcatgtttaatagataactttttcttcttgtcatcaaaatgaattcactaggcgagatgcagtggatcattcctgaaatctaccacttttggaagccaaggtgagaggattgcttgaggccaagagttcaagactaaccttgccaacataataagatcctgcctcaattaaaaaaaaaaaaagggccaggcatggtagctcacacctgtaatcccagcactttggaaggcggaggctggtggattacttgaggtcaggagttcaagacctgataaacatggtgaaaccctgtctctactaaaaataccaaaattagccaggcatggtggcaggtacctataatcccagctactcaggaggctgaggcatgagaatttcttgaacccgggaggtggaggttgcagtgagctgagattgcaccattgcactccagcctgggtgacaaagcaagactgtctcaccaaaaaaaaaaagaaaagaaaaatgaatccactaaagtaaatgattggacttatgcttgtggaagcatgaagcagatacagttttccctattcctcctgctaaatacatctaaacaccctggatattacatgtaaaaacaagcataagaagactctcaaagatgtaaggaagaaagcagaccacctaaggaccttgtaaccaagtgacctaaaagtagtaagttcagggttttcttttctgcctcgtatacccaaagttggaactgaagaagctggcaacctggaaatgtcaagtacagaccaaagaaagcctcaacaaaaattctgctcccttgacaaaggatcaagagatgggcagcctagcaagacagaaaattttgaaacagtaactgctctactctagccagacaccatagaaaaaactatggccccaccaccacccacattagcaaaggccaagtggggagcctggacttcacccttgccaagctgaagacccctcccctgtcacaggggtatcagagaagacaaagtaggaagctgggactttcatcctagtggggggcagtaatgagcccctctgcccggtggcatcagtggaggccacatggaaagcctagatttccatcccttctgggcagtaacaaggcatccctcccatttacaaatgcatggcagcagtgaggccacacaccacgagcaactcctctgtagtgtcagttaaggtatgcgtgaaacccaaacaggataaacccaaaagaatccacatctacatatatcataatcaaacttttgaaaaccaaagacaaaaaaagtcttgtgtgcagtgaaaaagatataacacctaacttacaggggaagaacaaatgatattggatttttcatcaggaactacagaggccagaaaatgaaaaggcagcatttttcaagtgctgaaagataagtattgtctaccaagaattccatatcaatcagaaatacccttcaggatgatgggaaaataaagacattctcaagtgaaagaaaactaaaagaatccgttcccagcagaccagtcctaaaagagtagctaaaggatgttcttaccacagaaaggaaataatgaaagagggaatccagaaacatcaggaaggaaaaaagaaaaatggaaaatcaaaatggagggtaattcaatagactttcattactctcatgggtccagcaagcactatatcattgttcgatgtggttctctgtgtatatacactaaggcctcaacatcatcagtgagttcttgggtcctgcaactttaagtgaagtgatgtactgtgtgccatgggaacttaactcctgtggtaaagttggtttattatatagtacatcattctgcttgaagtcacagtttccaagaacctaccagcaacattaaggatttactgaacaagaaataatagttaagacaattacaaaggagcgaggtttctacatttgtcacaaaccggtaaaatattgacaccagtggaccttaggaagttatgtttatgttaggtactacttggagttaccactaagaaaagactataccacaggatacatataaaaccctagaaaaataaaaaatggaactctaaaatatgttttaagtaactgtattagtccatttttcattgctataaaggaatacctgaggctggctagtttataaagaaggtttatttggctcacagctctgcaggctgtatgagaagcacggcacaagcatctgcttctgttgagggcctcaagaagcttttactctgctttacagaagatgaagtgggagcaagtgtatcacatgatgaagagagggagcaagatagaagccaggctcttttaaataaccagctatcgcatgaacgaacagagtgagaactcactcattactgcaacaagggtaccaagccattcatgagggatcggcaccagtgacccaaacacctcccactaagccccactttcccacattgaggatcacatttcaacatgagagttggaggagacaaatatccaaactatatcagtaacccacaagaagctaggagagaaaatcagaacaaatatgccaggcacagtggctcacgcctgtaatcccaacactggaaggccaaggcaggcggatcacctgaggtcaagagttcaagaccagcctggccaacataatgaaaccccacctctactaaaaatacaaaaattagccaggcttggtggcgggcgcctatagtcccagctactcaggaggctgagacaggagaatcgcttgaacccgggaggcggaggttgcagtgagccaagatcacgctcctatactctatactgggtgacagagcgagactctgtctcaaaaaaacaagcagaacaaatgaaagattggcatattgttaaaaacacattagccaagtatatgctgtctataacaaacttctaatataatgatacaggtgagttgaaagtaaaagggtagaaaaatatatactatgcaaacattaatcaaaagaagcaggaatggtcatgtttgtattagatgaaacagacttcagagcaaagaaaattaccaggggcattaaataatgatagaagtgtcagtacacaaagaaaacagtgatcctaaatttatatgcgtctaacaaaagagttacaaaatacatgaaataaaaagatacagacattaaaggagaaatagacaaatctacaactatagttggagacttcaaagtacctttttcagtaatcaatagaccagttagaacacctcagccaaaaatagcagaatataaattatttttgagctctcacagaactttgctgagatacattataacctgggccataaaacaaacctcaaccaattaatacagttgaaaccagagtgtgctctctgaccacagtagaatcaaactattaattagtaatataataatgaaaatctccacactcttaaaaataaacaacatgcttttaaattatccatgattagggaagaagtctcaagagggaaagaaacatagaactgagtgtaaaggaaaatacgacatcaaaatatgtggaatgtggctaaagcagtcctgagacggaaatctgttgcactaaaaactgaaagaaagatggtttcaagtcataacctaaggtctaaactcaagaaactagataggaaaaaaaggcagaataaatgcaaagtaagaagaaggaaaaacataaaaataagagatcagtgcaattgaaaacaaaaacgatagagaaaattaatgatacagaaatctggttcttacccaaaaattcagcaaaattaataaacctctagtgagactaataaagaaaaagaagacacagttgcatatcaggaataaaaagaattattgatacagattgccaaaatcaaaaacgcaaatactatgaataaatctccatatgtaagtttgacaacttggatgcttgtcgcccaggctggacagtgcagtgatgccaactcagctcactgcaacctccacctcctgggttcaagtgattctcatgcctcagcctcccgagtagctgggattccaggtgtgccacaccacgcctgatgaatttttgtatttttttgtagagacggggtttcaccctgttggccagtctggtctcaaactcctggcctcaagtggtctggccttctttggcctcccaaaatgctgggattacaggtttgagccactgttcctggcctgaagtgaaccctgtttctaaaaaacacaaactactacaactcacacaatatcaaacagataattttaatggccctataattattaaggagatgaatttgtaatttaaaatctctgaactaatctccaggcccagtttcactggagaattcttaccagaattaacaccagttgtacacagactcttccagaaaatagaagaggaaggaacatttcactcattttatgtggttattaacctgctaccaaaaccagataaagacagtattaacaaaaaagataggctgggcacggtggcttatgcctgtaatctcagcactttgggaggccaaggcgggtgggtcacctgaggtcaggagttggagaccagcctggccaacatggtgaaacaccatctctactaaaaatacaaaaattagccaagcctggtggcgggcgcctgtaatctcagcctactcgggaggctgaggcaggagaattgctgtaacctgggaggcagaggttgcagtgagctgagatcgtgccattgcactccagcccaggccgacaacagcgagactctgtctcaaaaaagaaaaaaaaaagatagaaaacagatattccacatgaatataaatgtaaaattcttcccaataaattattaaatagaattcagctatgtatacaaagaattatgcaccatcaccaagtgggatttattccagggatgcaaggctgattcaatatttaaaaatcaatctagtccaggcgaggtgggtcacgcctgtaatcccagcactttgggaggctgaggcgggtggatcacaaggtcaggagttcaagaccagcctgaccaacatggtgaaaccctgtctctactaaaaatacaaaaattagccgggcatggtggcgcgtgcctgtaatcccagctactcaggagagtaggattattgaggcaggagaattgcttgaacctgggaggcagaggttgcagtgagccaagatcgcaccactgtgctccagcctgggcgacagagggagactccatctcaaaaaaaaaaaaaaaaaaaaaatcaatgtaattatcgtattgtcagactaaaagattacatgagtatagcagttgattcataaaaagcatttgatcaaattcaacacccattcatgatgaaaatcctcacaaaaataggaagagatgagacctttgtggactggataatgagcattttgcaaaaatcctacagctaccattatacctaatggggaaagcctgaattctttctacctaaaatcaggaacaaggcaatcacaactcatattcgacattgtactggaagttctagccagtggaccacggcatgacgaggaaataaaagtcatgcagataaagaaaggaataaagctgactctatagaaaatcataaggaacatacatacaaacacctgaaaaaataagccaggcttggtggctcacgcctgtaatcccactttgggagctaaggcaggcagatcacctgaggtcaggagttcaagaccagcccggccaacatggtgaaaccctgtcgaaaaaatataaagaattaggtgtgatggcggtcacctgtactcccagctactcaggaggctgaggcaggagaatcacttgaacctgggaagcggaggttgcagtgagccgagatcgcgccattgtactgtagtttgggcaacaagaacgaactccatctcaaaaaaaaaaaaaaagctcatattgcctggttttaagatgtggcctgggatcaccatattgatcttcccatgccagctgctcccatgatggttgtgtgtttatttagacctgtgatgatgtctcagacagtacatggttccctgaactgctttgcaacttcagtgatgttgtatggcattgagctggtccatcactgccaacatcctggctgtctcaggttaccctgtagaaggaatcggatggtcagtggtgtgcatcagtaatgtaaacaagaacagtgttcttgtacagagggccagcagcatgagcagtgataagacaggtagggcctattttcccatctaccaactccaggactggccattcctgggtcagttgaccagacacctggaaagaagagctctcaactccaagattattttcttagtaatagctttaaatgcagccacagcttggtcgtctgccttaatatgatttgatatgttttgcaatttactgtcctgctgaaagcattcatattatgagggaaaaaaccatacaaatcatcgctaaatctgttatttttaaatgtttggcctttttctataccctttggattcaagcattaattgggtttccaaagtaattgaatagaaatcatattgcttataaaaaagaaaaaaacttttgagtcacaggatgtaagataaacatacaaaaatgaattttatttcataatagcaatctatactagcaatgaacaagtgggcaatgaaattaaaaatgtggtatcatttacagtcacttaaaaaaagatgctaggtcaggcgtggtggttcacgcatgtattcccagcattttgggaggcttaggcaggaggattactttagcctgggagttcgagaccagcctcggcaacaaagtgagaccccgtctctacaagaaataaaaaactaggcaagtgtggtggtgttcgcctttagtcccagctacttgggaggctgaggttggaggattgcttgagcctgggagatggaggctgcagtgagccatgatcatgccactatactccagcctgggccacacagtgagaccttgtctccaaaaaaatattcagatgtaaacctaataaaacatgttgggacttgtatactgaaaacttcaaaatagtgatgaaaaaaatcagacaaaatctaagtaagtggagagacgtgtatggattagaagattcaatatagtaaaaatgtatcttctatcctgctgtggtttgagtgtgtcctccaaaactcaggttaaaatgtcattgccattgtgacagcatcatgaattagttaattacttcacaagagttatgataattcttacccagtccaatggtgtgatcttaacatcagaaacctgtacttgtcagagtcctttccattgcatctcctcaaagatgaaacactttagattcactgttgcttacaatagttttcaggaaagtgccagagtaaaacaattaactatcgttggatgacaagactttaaatggccatggttaaatatctaatgagagttcattatactaatgttgcaattgacaaggaagtttagttatttctgtggtatacagcattttaaggtaactagaattatgactgataacattagaccaggctatcagatttctaagaatttcacacaatttctggaacacattatttgtacaagttaaagaaggttaaacaacatttcttatttgacagcgcttcccatgcagatctaacgtagtcaaataagtctaacttgtttactgtttctcttcataatgaaagaaaattctcttgagatatttcagggggcctctgaaagctcccaaagttagcttgaggtcagaaagacttaagtttagagtttgattttgggaagctagtaaaaaatatcaaaggcttaaaacacttgattaataggattgcaggtcactgaagctacagtcactcatttaaccagagtgataattaaaaatatcaaaggcaaatatagaaagtcacaaagttataaaaagacctgagcagttttaatagagaggactctgtttctctgttttcttttctgtagagacagtgtctcactacactgcccagtctggtcttgaactcctggactcaagcaatcctcctacctcagcctcccaaagtgctggtattattaaggcttattaatttgataatttataaataaattcattcagaacttacccaggttgaccacacataaaattccttttccaagattcctcttccacaaacctactacaactttctcatacccttctgttttggattaaattcttcctcttactgtgaaacaagtcattctactataaggcaaaagttagtctttttctcttaacgaacacacatccttcatacttcatagcttcaccttaccaaaaccatgtcttttcctcacatacagaatcatttctcttattctagttataactgtcacatcagcattctatagattggcaaatctatgaatcaaatttgtagaaacatatgcttccttgtagtataatttatgttccactattaatgcttcagtattttatttggaaaatatctacatatccaatgaatattcatcatttaaattaacaaaacccctaggctgtaaattaccagtggggagctatttttgagtagacataacacaaacaaagctagctatcattaagttatttctctgttagctacttttacagcatgtgcatgttcggcagtcttcacaaaaacaagaatcctaaaaagtttaatagatgagattttttgtttttttgctgcactcgaaaaacgtgaagtaatggatactggcacccacttgcacattgttcataggttgaactcatagttgtataattataaatatgtagtggaggtaacataaacttatttgataataaatcctggtaggatttaaaagttgtatatctgcattatatattcttacccaagtcacatgaacttgaaaagcatgtgtgttggtttctatattgctgagagaatacttaatttatgtgaaatgcttatttttctttaaatcaattaaatagaaatcttttatgaattaatttttgaccataccatctggaggtagaaaaacatctcatggctgggtgcggtggctcacgcctgtaatcctagcccttttggaggccgatgcaggcagatcacctgaggtcaggagttcaagaccagcctgactaacatggagaaactccatctctactaaaaaaaaaaaaaaaacaaatacaaaattagctgggcatggtggcacatgtctgtaatcccagctactcgagaggctgaagtaggagaatcacttgaacccgggaagtggaggttgctgtgagccaagatcatgccattgcactccagcctgggcaacaagagcaaaactccgtctcaaaaaaaaaaaaaaaagaaaaaaataacacatatacgtaacatacctacatgcacaggcatgtataagcatacagataagcagatttcttagctttcatttgaaaactgtagccatgtgctaggtactataatataaaacacactagtttatgaaacaatagctggatcaaaagtatattcccagcagatggaataaattaaggttacttacttaggtggccaaagtgctctactagtatttttggaaaagtcttaagatttttcatttaaacattaaacaaagagttttaaagccttgacacaaaacactgtccttaaaagggaaaagtgatatattgaactaaatgaaaatttaggttttgctttgaacatcctataaaaggatgaaagacaagctacagactgggagaaaatctttataaaacaacatatttgacaaaagacatatctagaatacgtaaagatcttttaaatctcaacagtaaagaaaaatccagttagaaaatggggtagagatatgaacagacatttaccaaagggaatatacaaatgacagaaatgtccatgacaacatttaacgtcattagccgttaggaaaattcaagttgaaatcacattgaggtcttaatacacagctatcacaatgactaaaattgcaagtagtgacagcaccaaatgctgtatctcatacattgctggtgagaatatagaatggtatgatcactctggaaaatagttcggcagtatcagaaaactaaatatgtgctttctataatgactcgcagttgcactcctaggtgtttatcccagagaactgaaaactatgttcaccaccacatgaatgtatatagtacttatattcataatagcaccaaactatagatgacccagatattcttcagcagataaatggctaagcaaactggggtacatatcatagaacattacacagtaataaaaaggaacaactatcagcacagtaacttattttaatccttagaaattgatgccaactgaggccaggcacagttgctcatgcctgtaatcccagcactttgggaagccgaggcaggcagatcacctgaggtcaggagtttgagaccagcctggccaacatggtgaaaccccgtctctactgaaaaaatacaaaaattagccaggcgtggttgtgggtgcttgtaatcccagctacttgggaggttgaaacaggagaatctcttgaatccaggaggcagaggttgcggtgagccgaaatcgcactactgcattctagcctgagcgacaaagctaaactccatctcaaaaaaaaaaagaaaagaaaagaaattgttgccaaataaaaaaagtcccaaaaggttccatactgtatgattgcattcacataacatgttttaaatgataagattatagaaatggagactgtttgccagggattaaggagggaatgggcctgggagggaattgggtatggatattaaaaggcaacacgaggattctcatggtggcagaactactctgtatcttaatgatggtgatgggtacaggattttacacgagtgataaaattgcatagaactaaacatacccacgtgtacacatgccccagtgagtaaaagtaaaactgaggcaatctgaataggatcagtggattgcatcagtgtcaatatgctggttgtggtatacactgtagttttgtaaaatgtcaccattaggggaaactgggtaaggggcctgtggtatctcactacgtgcatttggctctacaattaactcaaaatgttcaaatatattaataaagtaaatatccgtacatgaatctaaggtgcagaataaatcaacatcaggggtcagatagtatttttaaccatcgtgacctgtgggaatatacatatggcacaaaatgaaaaatgacaatcataaataagaatcatgaatacaaaggtttaaatctagaaaaagacaagaacagattgcctggtagagttctatgcctggaccatagctaccaaggattgccaaaacacatgccaaggatggagatgtgtgtgtgtgtgtgtgtgtgtgtgtgtgtagtgtatatattgcatatacactatatatgtatatatatgtatatatatccatccttggtatgcttttatatgtatataataagctatatatacacatatatatagtgtatagttgggggaaaaggaaaaatattagggcttgaacccctttgtatcccttttcctccaaatgtaacattttctttttagttttatttgtctgattgaggtgttatttttgtggctttttaggtggagtattgctcctggaaaatccaaaaggtgacaataggttggaccttttaaagctgaagagtgttgtcactagcatttttggtgtgaaaaatacagagctggctgtcttccatgatgaaacaggtatgtggaaagtgagaggagcctacgtcctttgactcaagatggattggtgaaggtcttaatttgctgtcagttgtactatacaacttttgcatttttcctaactctcttgagtcagggcccaactcttcagcagtgcctgcctgcagtgtctattcatgcctcctcattgtgtcatgtgactgaaaaccctgggcttaatggatctaatctttccctctcacctgttagctagctggtggacttcaggcttcagagtcctctgttgtgaggttgtttttgtttttgagacagggtctcactctgtcacccatgctggagtacagtgatgcagtcatggctcactgcaccctcggcctcctgggctcaagtaatcctcctgccttgacctcccaagtaactgggactacaggcatgccaccaccatgcttggctaattttatttaatttttttggagagaccaagtcagtatattgcccagtctggtcttgaacccagggccttaagcagtccccctgccttggcctcccaaagtgccgagattccaggtgtgagctaccacacccaaccgtgagttttaactttattaaacacaatgcctggatctcactaagtctggattctcaataaagcaaacctgaaaaatttttaaagaattatagatgcattctcccgctgttacgtattgaattgtgacctctgaaaaaaaaaagattatgtcctaaccccttgtatctctaaatgtgacctgtggaaataggattatcgcagatgtaactagttaggatgaggtcatactggagtagcgtgggcccctaatccagtatgactgttgtcattataagaaggtggccatcgggctggtctccagctcctaaccgccagtgatccgccagccttggcctcctgaggtgccgggattgcagacggagtctcgttcactcagtgctcaatggtgcccaggctggagtgcagtggcgtgatctcagctcgctacaacctccatctcccagccgcctgccttggcctcccaaagtgccgagattgcagcctctgcccggccgccaccccgtctgggaagtgaggagcatctctgcctggctgccaatcgtctgggatgtgaggagcccctctgcctggctgcccagtctggaaagtgaggagcgtctctgcccggccgccatcccatctaggaagtgaggagcgcctcttcccggccgccatcccatctaggaagtgaggagcgtctctgcccggccgcccatcgtctgagatgtggggagcgcctctgccctgctgcctcgtccaggatgtgaggagcgtctctgcccggccgccccgtctgagaagtgaggagaccctctgcctggcaaccgccccgtctgagaagtgaggagcccctccgcccggcagccgccccgtctgagaagtgaggagcccctccgcctggccagccgccccgtccgggaggtgaggggcgcctctgcccggctgcccctactgggaagtgaggagcctctctgcctggccagccgccccgtccgggagggaggtgggggggtcagccccccgcccggccagccgccctgtccgggaggtgaggggcgcctctgcccggccgcccctactgggaagtgaggagcacctctgcccggccaccaccccgtctgggaggtgtacccaacagctcattgagaacgggccatgatgacaatggcggttttgtggaatagaaaggggggaaaggtggggaaaagattgagaaatcggatggttgccgtgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggcggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaaaaaaaaaaaagaaggtggccatgtgaagacatagaaacacacggagaaaatgccatgtggtgacaaaggcagagattggagttacacacagctgcaagccaagaaacaaccaagattgccgggagcctccagaagctaggaagaggcaaaaaagaattcgcctacaggtttcagagggagcacatctgccaacactttaattttggacttctgacctccagaactttgagacagtacatttcttttatttttattccctagccccctgcagtttatgggactttactatggcagcctcagaaaactaatactcattttatgaatctgaatgctcattttcagaaacttttaaataacttaaaagaagaaatgcaaatggccaactaaggaacaactggtgcatcttaatggtaatcaggaacttgcaagatagtaccacagtgaggtactattaactgccaccagattggcaaaaactagaagaatctggcagactcaaatgttgtcagggatattgcataatgggaactctcattcactgctggattatgaattgttggaaccactggaaaactgtttgctattgtatccattaaaggttggataggagaagcaaaagcaatgtgggagaaaccaagtaaaattctacaagaaggtagcaagttagaggtctgagaaaaatctctaaccaggttccaccaaggtggtggataagtcagtggaaagctggatctctgcctaaagtcacggtaggatgagaagtagaaacgagcaaaaacaggctagagtgcacatctatctgacctcatcccacactgacaggtgccttgcagaagaaactgctggtacacttttccagagagttgcacacattcctggcctggaagttggaagagcagaggcaggagcgtgggctgctcactgtcccacttaacccaacaagttggcagattcacagcaacctgagaaagccaagggcacgggccccatgttagcctgtttagcataatgactgttactaaacttctaccttctaaatcctgtgtagatttgtctgtgatcaagccattacccagaaccaggtcagacagagaacctgggaaatagttttagcttagctgcattgacacaggatgaaaccaccatagttcaccccattgtgatcttgacatctatacatggctctttaaatcatatgtaacttccaaataaagaccctagtagattaaaaaaaaaaaaaaaatcacacttttaactctttcttgtactgcttcaaagatgctaacttcattacccaaaacgagatagaaagttaccttatccttctttgggtgatgttgatttctcttctagctgagccatacatccctcttttgctgttctttaacttcactgaggtataaggttaacccgttaaaatatttcatgttatatggtaaggaaataagagagtggaaaaataagaattggctaatatatattaatacataatgccacacttcatttgctgaaaaatgagttctctggtcaagcgatgctatgtggaatgctgtgttggtaaataagacattctctacctccatggatggtgggtttgccagaagcattataggtgacagtggcaaatccttgtccaaaaggagtgtgtgttccagtaagaccaaagcactgccttttcccataatggaaacagtgcagtacaaccaagctgccatcaggagtctggcttgtctttcctggcaataacactgtatcgaaagctcaagtaatggttcccgctgttggtaggtgggatacgcagtagcagctgtagcaaaatcagccttagggagtggaagtaatgttgtggagcccgtggttattcttcctcccagtctgggtggcccctttgttcatcaatccattgggcaagggcaggagtggctggcggcagaatagaacatgtccactgattattattatttattttttattttttattttttgagacagggtctcactcgatcactcaggctggagtgcagtggctcaatcatagttcagtgtaacctcaaacttctgggctcaagcaatcctcccacctcagcctccaaagtaactaggagtacagacacatgccaccatgcctggctaattcttttcttttttgtagagaggaggtcttgctgtattgcccaggctcagtctcctggcctcaagcagtcctcccctttctgcctcccagagtgataggattacaggtgtgagccactgtgcccagcctcacccatttttagatcctcattcatagtctgcccatttgtagagatctgtccacatacctcttgccctaacttccttgtcaccagttttctaattctgttctttgagtccctggctgttctcgtttagtccagctattggccagtgtccatgaatcagtgtagatctactcctagctatttctgctgagcaaaatgaccagccggctgcactgaaagaagctgtgcccattgggaggatttccacccatcactattcttcagggctacccagagtcagaacagggccgttaagactgtaattgtctactttggatgatacagcgtattgtgcagtaaagccctacacagcaagccctaaaatgttttctttctctgccagccagtcctggaagacttcctacaaggccacacctgtggttgagagaagagaccatgtgggcctaggctgagcatgagcatctagccactggtgcagcagtttccttgttccctgagccagtgccccagcctagtctcatacctaccatttccactcaatatttggaggctgccctgtgggcctgtcctatatcacaaccattaccagtcatctgcctgcgcatgcatccccaagcaacgtttaatgttctctaaatgaaattacactgcatatgttctgtgtatcatgctttttttcacatctgctcctgagtcaaataacatcttctgactgtaattagcactttttaatgtaagtttttcatggtgaagcttgagattctgatataggaggaaattttaagaggagctgtattatacagagaaaatactaaaatagagaaaacaattagccctatatttcagattatgaatattatgatgtttgttttgcaacattgagatttcctaccattacatgtcattaaaggctggttttatagaaaaggcaatgtctcttgataaacagaaattaagtggaaagcattatcgtaaaaagatacatgatagttaaataggaaaaattgaatgacttcagttttgaatttgttcgttaaccctgaaagaattgttgttgttatttttagaaatacaaaaccaaactgacttactgagtcttagtggaaaaacactttgtgtgactgcaggatcggctccctctctgatcaacagttctagtactcttctttgtcagtatatcaacctacagctcctgaatgcaaagccacaaggtatgtgcctccccacagcaggcagactgtggggtgctgggcattgaagttgtctttaatattcaaatatgtgtgtatttctagtcggcttcaaagtattgctttaaagtgtgggctctcacgcaactttggggagcaaccacaggcttttcttttggtgtgttatagagaccctcatccatctggcatggttaggaaatgaaaaaattggttaggtaaaaattacaactaaattgtttgagtgccaaaacattttaatctcaaattttactttcttttctgaggaaaaatgttctgaaaacttctatacctccatgccttaatcaacagactagattgatagtgatttttttcctgatattttaggatcctcattgtgcacatttgtactgaagtcttcgggctcctcacttcactgtgtactgagtatctgctccccaagctgctgggcttttatataagttttttttttttctttttccccttccccttcacctctatgaaatgttgagagctgtttctgcatggactgcatcttcagcggtcacactcacgctcctggacgcactgctggcctcagcactgcctgttagagctgtccgcagtggccacctcttttggagctagagggtgaactctcgagatttaatccagtttgttctgtcttccacagagtgtttaatggggacagtgggcactctcctgcttgaaaacccacttgggcagaatggactcacccaccaaggtcttctgtatgaagcagccaaggtgtttggccttcggagcaggaagctaaagctgtttctgaatgagacccaaacgcagggtaaggagattgtggaccgtaagttttttatttttgttgaaagtagattttgatgccattaaccatttgtagcatatacatgtaagatagtactattgttatcctgttttgttattctttccccagaaatttaccataatataattttcttttctttttttttttttttttttttttttgagactgagtctcactttgtctcccaggctggagtgcagtggcacgatcttggcttactgcaacctccgcctcctgggttcaggcctggggcttcaacccaggaacaaggattctcctgcctcagacttccgagtagctgggactacgggcgcctgccaccatggctggctcatttttggattttagtagagacggggtttcaccatgttggccaggctggtctcaaactcctgacctcaggtgatccgcccacctcggcctcccaaagtgctgggattacaggcgtgagccgtgatgcccggtcaataatataattttttaatagcaattaaaagtataattactttttgctaaatctaaaaactacattggtatgttattaaaaatacatgcttctaggtaaatcagcatatttgctgaccctaaaattgttctttcccccaaaagtcaaaattatcacagggttgtaaaatagcctgacattacagccttacagctgacattatacctccctttacagtttataaaacatgcttacctgcattttttccttgagacacgtaacactgtgaagagctagatcatcagttgacatattccacattctattatctagaaaatagaaattaaggatggcgacctgcacttacttgctggtgtcaggcagcttattttctcctcctcccgttctcccacttagcactattcacttctgagatttcagcttctgtggctgctctgtcaacttctctgttgacatcctcaccctaccctctgagtttcgttctgtaatcctgctacacatcagacatgttcactttaatattgctgccactgcaatcacttccccagacagcttccctttgtgggatctgtttttttctatttatacccattcttgacatctcaattcaagacttttaccatcccatccttttatttgtaacacctgatagcctgggatttattgggctttctgtgtcagtatttgtgtctttcggcacttgtggaaaattgccagacattatcttgtccaacttacctcttattcattctctctggtattctctccttctgacaccttgtttagacatattttagatggactttctcactctatcctacctcttattctcttttcctattttccctccttttgtccttatatactacattctggataattttggcttttttatcttacccttgttcctctgcaggtaaggtgctgcttttctctgcttccttgaagattttccctttgtcttttactttctgcagtttatgatttccctaggtgtacattttttggtataaggcagtgtttatttctgttacagtgttttggtttttttgttttgttttgttttgtttttgagacttggtcttgttctgtcacgcaggctgcagtgcagtggctcaatcacagctcactgcagcctcaaactcctgggatccagcgatcctcccacctcagcctccctagctaggactacaggcacgcgccaccatgcccagctaattttaaaatttttttgtagggacagggtcttgctataaggtcaaggctggtcttgaactcctgccttcaagtgatcctcccaccttggcctcccaaagcattgggattacaagcaagaaccaccacaccctgcctaatttctaccattttcattctattcgtgttttttgtttgtttgtttgtttgtttgtttgttttgagacagagtttcactcttgttgcccaggctggagtgcagtggcacgatatcccagctcgttgcaacctccacctcctgggttcaagcgattctcctgcctcagcctcccgagtagctggaattacaggcatgtgccaccatgtgcagataatttttgtaattttattttattatttttttatgattattatttttattattattatactttaagttttagggtacatgtgcacattgtgcaggttagttacatatgtatacatgtgccatgctggtgcgctgcacccactaactcgtcatctagcattaggtatatctcccaatgctatccctccccctccccccaccccacaacagtccccagagtgtgatattccccttcctgtgtccatgtgatctcattgttcatttcccacctatgagtgagaatatgcagtgtttggttttttgttcttgcgatagtttactgagaatgatgatttccaatttcatccatgtccctacaaaggacatgaactcatcattttttatggctgcatagtattccatgttgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatgtacccagtaatgggatggctaggtcaaatggtatttccagttctagatccctgaggaatcgccacactgacttccacaatggttgaactagtttacagtcccaccaacagtgtaaaagtgttcctatttctccacatcctctccagcacctgttgtttcctgacttttgaatgattgccattctaactggtgtgagatggtatctcattgtggttttgatttgcatttctctgatggccagtgatgatgagcattttttcatgtgttttttggctgcatacatgtcttcttttgagaagtgtctgttcatgtcctttgcccactttttgatggggttgtttgttttttcttgtaaatttgtttgagttcattgtagattctggatattagccctttgtcagatgagtaggttgcgaaaattttctcccattctgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaatgtttaagtctttaatccatcttgatttttgtataaggtgtaaggaagggatccagtttcagctttctacatacggctagccagttttcccagcaccatttattaaatagggaatcctttccccattgcttgtttttctcaggtttgtcaaagatcagatagttgtagatacgtggcgttatttctgaggggctctgttctgttccattgatctatatctctattttggtaccagtaccatgctgttttggttactgtagccttgtagtatagtttgaagtcaggtagtgtgatgcctccagccttgttcttttggcttaggattgacttggcgttgcgggctcctttttggttccatatgaactttaaagtagttttttccaattctgtgaagaaaggcattggtagcttgatggggatggcattgaatctataaattaccttgggcagtatgaccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttccaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttactgatttgcgtatattgaaccagccttgcatcccagggatgaagcccacttgatcatggtggataagctttttaatgtgctgctggattcgttttgccagtattttattgaggatttttgcatcaatgttcatcaaggatattggtctaaaattctcttttttggttgtgtctctgcctggctttggtatcagaatgatgctggcctcataaaaggagttagggaggattccctctttttctgttgattggaatagtttcagaaggaatggtaccagttcctccttgtacctctggtagaattcggctgtgaatccatctggtcctggactctttttggttggtaagctattgattattgccacaatttcagagtctgttattggtctattcagagattcaacttcttcctggtttagtcttgggagaatgtatgtgtcgaggaatttatccatttcttctagattttctagtttatttgcgtagaggtgtttgtagtattctctgatggtagtttgtatttctgtgggatcggtggtgatatcccctttatcattttgtattgcgtctatttgattctgctctctttttttctttattagtcttgctagtggtctgtcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtctcagagattctggtatgttgtgtctttgttctcattggtttcaaagaacatctttatttctgccttcattttgttatgtacccattagtcattcaggagcaggttgttcagtttccatgtagttgagcggttttgagtgagattcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttaatttggggtggagagttctgtagatgtctactaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatccgagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctgtttattttgctcgttagttgatgtagtttcttcctagtctcgatggtctttacattttggcatgattttgcagcagctggtaccggttgttcctttccatgtttagcgcttccttcaggagctcttttagggcaggcctggtggtgacaaaatctctcagcatttgcttgtctgtaaagtattttatttctccttctcttatgaagcttagtttggctggatatgaaattctgggttgaaaattcttttctttaagaatgttgaatattggcccccactctcttctggcttgtagggtttctgccgagagatctgctgttagtctgatgggcttccctttgtgggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgcctcgctagataggggaagttctcctggataatatcctgcagagtgttttccaacttggttccattctccccatcactttcaggtacaccagtcagacgtagatttggtcttttcacatagtcccatatttcttggaggctttactcatttcgttttattcttttttctctaaacttcccttctcgcttcatttcattcatttcatcttccatcgctgatattctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgtatgtcctcccatagctcagagtaatttgatcgtctgaagccctcttctctcagctcgtcaaagtcattctccatccagctttgttccgttgctggtgaggaactgtgttcctttggaggaggagaggcactctgctttttagagtttccagtttttctgttctgttttttccccatctttgtggttttatctacttttggtctttgatgatggtgacgtacagatgggtttttggtgtggatgtcctttctgtttgttagttttccttctgacagacaggaccctcaactgcaagtctgttggaataccctgccgtgtgaggtatcagtgtgcccctgctggggggtgcctcccagataggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcatgcaggcctccttgagctgtggtgggctccacccaattcgagcttcccggctgctttgtttacctaagcaagcctgggcaatggcgggcgcccctcccccagccttgctgccgccttgcagtttgatctcagactgctatgctagcaatcagcgagactccgtgggcgtaggaccctccgagctaggtgcggggtataatctcgtggtgcgccgttttttaagcccatcggaaaagcgcagtattcgggtgggagtgacccaattttccaggtgccgtccgtcacccctttctttgactcggaaagggaactccctgaccccttgcacttcccaagtgaggcaatgcctcgccctgcttcggctcgcgcacggtgcgtgcacccactgacctgcgcccactgtctggcactccctagtgagatgaacccggtacctcagatggaaattcagaaatcactgtcttctgcatcgctcaccctgggagttgtagaccggagctgttcctatttggccatcttggctcctcccccaatttttgtaattttagtagagacagggtttcaccatgttggccaggctggtctcaaactcctgacctcaggtgatccacccacttgggcctcccaaagtgctgggattacgggggtgagccaccacacccagaccattctattctttgagtttccgtctttctgtttacattgcccgtctgctctgcttgttctgttatgtttctgttgaagcccagttttaagaagcatacgtctagttccttggagacactgacaacccagacacactttaaactcaatcattttggaccatagggagaatgttaagaaagctgtgactgggtctgcgtggtggctcactcgtgtaatcccagcactttgggaggctgaggtgggcagagttcaagaccagcatggccaatatggtgaaaccccatctctactaaaattagctggacatggtggcacatgcctgtaatcccagctacttgggaggctgaggcaggagaatctcttgaacctgggaggcagaggttgcagtgtgctgagattgcatcactgcactccagcctgggcgacaagagttaaactccatctcagaaaaaaaatctatggcattcccagtcatacacaaaggccaggagttgtgatggagacaggatctgtctatccctactccaaaacaaagctaagtgaggtgattttctctgtattggtttctgtggctgctgcaacaaatttccacaaatgggatggctcaagtcatctcacagctctggaggccagacactgaaattagggtgtcagaaaggccacagtctctctgaaggctctgtgggagaattccttatatacttcttctagcttatggtggcgccaggcatcccttgacttgtggccacatcacttcagtctctgactccgtggtcacattgcctccttctcttctgtttcctctttttccaaataaagtgaacattcacagctcctgggaatttagaacctgggcatatctttggaaggccattattaaccgattacattctcttcactttttctcttgtggtgaaggaacttactcaaattaacccttttgctatgggtttcttatttgaagttccagtttcttcagcagagatttgttggacttcccggtttgtatataccggaggcttttctttccctgctttcctagctctttagtgccaaaagcattaagccaccagaccccatgggagtcattatttttggcctctgtgtaattctcccgttttcttcctgtgcagcttttttttttaaatttagttgcatatcgtacttttaaattttctgtcatgatgttaaatactaaagctctatttcttcttgggttcctccttccctccctgggtttattttcagtgactctcctttgtcgttttccctctcatctcatcattgggcctcatcatccatctaagtcaccagtctgcagtctgtactcttcaccagagctatcttcatgaacattcctgccttgattttgttcccttgcttagagcccccaaagctccttattctcttatgcctcagaatcttcccttccacacaagatccttcctgctctgggccttccctgtcttgctaattctgtccatgagtctttcactctatcaaaggcttttttcactctccctcgaacacacttggctctttcattgtggtatggtagtaaagatcatctaataatgtagctttctattttgataagcttatataaaactttagagataattcttaactcttcttgtccctcaaatcctttggtcaccaagtactgttgtgcagtggagctgaagatgacatttatctctcacttgttcttgcaagcaaatgcagtggcatgattgaacctggtcaggggtagaaccatgtctgtatgaattatgtatttataatactacctgcaattcacagaaccattcttaacctgtgctgcctttctgtattctctttactctgtgacgttagttaggcaaaagtttagtgggtgagaacttttaaatgtttagtgatttatctaagattaccacaaagttggaactttttctaattcagtatctttccaatctagtatctatagcttcgttttcattatgccttttctctcagaattgtctttcataaagtatcaataacttggtaaattagaagagccacaaaatgttgaccattttagaaacccttagatgtcttcttgcttgctccactaaactctaaacatcatctccaggtcctgtaattatctattaaggaagtagctttgagagtattctcacatctaggattgctgctaggtaggacaagagctatttttaaaggaagctcatctgtttgctttaaattcagatctgactagaagcaaaatgctccacagtaggcagataactttaaattttctttttttttgtttttgagttgtatattcagtatatttcaatcaattgcatttgggttatatttttggatgctcagagttttcgtcattggccatattggatcctgtattctttaacatgatcctttgtctttggtaaattcttgctttctcacgtagcaacatgtcctaggcttattatgtacttttacttctccagacgtagaaaatagctgttcttcaaattatagagaatcatattttgaaaccacatatctgggatactgagttggcacagcctctaggctttttttgtagacataggaagtatctgtgtatgaggaaaaataaccatcttggcagtacccagagttagccaaactgtgaagtgatggcatagtcctccagaaggctccaggagtctgcccgatatctaactccacctgcaaggagtgaggattctactcagggaaagatccacacaagacccccatcactgctggcaccaactgcaagttccagggattttcctaaaccaccctcaggttcagtaacctgctaggaggactcagactcactaaaaggtattacactcatggtttgaattagggtagggaaaggatacacgttagaaccagcgagagtgagagagagagagagaccctggagtcatggataatgtttcttcctctcatcccttacatctgacaacacagagactatattaccaaccagggaagctcactcgagccttggtgtccagtttctgttgaggtttcattctgtaggcatgattgctgtctttctcaactgatataccatgtgacccaaagtccccatcctaaatcatatacttggtctttctgtcctggccagcactaccctgaattgtctcattagcaacaactgtcaggtttggtgaacatacccaccatgagaaacaaagattcctaccaggaaattccaaggatttagaggttcacctcaggagctgggacaaaaggcagaactcttaggataaggccaaattccttactacacaagcagttaacatttttttaaatattcacccccaataggtaaaatactgattttttttcaactttttctttccattctagaaattacagaagacatccccgtgaagactttgaatatgaagactgtgtatgtttctgtgttaccaacaacagcagacttctagcatgtacttatcaatgttgttcggtcagcccttccctaattacacctatcccctacacatacatgcacatagacacacacatgaacacactgaagatatttccttcaggtgtgtgtaaaatatgctgcttggattgaaattcaaatgggattgattagtcaagtaacttgagacctcacagtaatcttcacacttaaccttagacacctatgcagtcatgttgggagcaggttacaatgttacttcagcccacagtttatttctatacttgagttcttaagtacagaagatagaagtgatttaaatggcatagtatatatatcattttctggccttttaaaatttatttgagacctcttgatgaaatggacatattatatatttctgccacctggattttcctggataatttgatggaatattttaagtttcagtaaatcagaacaataaacaaactcagatat

SEQ ID NO: 36647 - DNA, 2677 bp, Homo sapiens
gatctaaaacgagaagagatctcggggtctcatactgcgccattcggctgcggtacatctcggcactctagctgcagccgggagaggccttgccgccaccgctgtcgcccaagcctccactgccgctgccacctcagcgccggcctctgcatccccagctccagctccgctctgcgccgctgctgccatcgccgctgccacctccgcagcccgggcctccgccgccgccactcaagcatccgtgagtcattttctgcccatctctggtcgcgcggtctccctggtagagtttgtaggcttgcaagatggcagaagcagattttaaaatggtctcggaacctgtcgcccatggggttgccgaagaggagatggctagctcgactagtgattctggggaagaatctgacagcagtagctctagcagcagcactagtgacagcagcagcagcagcagcactagtggcagcagcagcggcagcggcagcagcagcagcagcagcggcagcactagcagccgcagccgcttgtatagaaagaagagggtacctgagccttccagaagggcgcggcgggccccgttgggaacaaatttcgtggataggctgcctcaggcagttagaaatcgtgtgcaagcgcttagaaacattcaagatgaatgtgacaaggtagataccctgttcttaaaagcaattcatgatcttgaaagaaaatatgctgaactcaacaagcctctgtatgataggcggtttcaaatcatcaatgcagaatacgagcctacagaagaagaatgtgaatggaattcagaggatgaggagttcagcagtgatgaggaggtgcaggataacacccctagtgaaatgcctcccttagagggtgaggaagaagaaaaccctaaagaaaacccagaggtgaaagctgaagagaaggaagttcctaaagaaattcctgaggtgaaggatgaagaaaaggaagttcctaaagaaattcctgaggtaaaggctgaagaaaaagcagattctaaagactgtatggaggcaacccctgaagtaaaagaagatcctaaagaagtcccccaggtaaaggcagatgataaagaacagcctaaagcaacagaggctaaggcaagggctgcagtaagagagactcataaaagagttcctgaggaaaggcttcaggacagtgtagatcttaaaagagctaggaagggaaagcctaaaagagaagaccctaaaggcattcctgactattggctgattgttttaaagaatgttgacaagctcgggcctatgattcagaagtatgatgagcccattctgaagttcttgtcggatgttagcctgaagttctcaaaacctggccagcctgtaagttacacctttgaatttcattttctacccaacccatacttcagaaatgaggtgctggtgaagacatatataataaaggcaaaaccagatcacaatgatcccttcttttcttggggatgggaaattgaagattgcaaaggctgcaagatagactggagaagaggaaaagatgttactgtgacaactacccagagtcgcacaactgctactggagaaattgaaatccagccaagagtggttcctaatgcatcattcttcaacttctttagtcctcctgagattcctatgattgggaagctggaaccacgagaagatgctatcctggatgaggactttgaaattgggcagattttacatgataatgtcatcctgaaatcaatctattactatactggagaagtcaatggtacctactatcaatttggcaaacattatggaaacaagaaatacagaaaataagtcaatctgaaagatttttcaagaatcttaaaatctcaagaagtgaagcagattcatacagccttgaaaaaagtaaaaccctgacctgtaacctgaacactattattccttatagtcaagtttttgtggtttcttggtagtctatattttaaaaatagtcctaaaaagtgtctaagtgccagtttattctatctaggctgttgtagtataatattcttcaaaatatgtaagctgttgtcaattatctaaagcatgttagtttggtgctacacagtgttgatttttgtgatgtcctttggtcatgtttctgttagactgtagctgtgaaactgtcagaattgttaactgaaacaaatatttgcttgaaaaaaaaagttcatgaagtaccaatgcaagtgttttatttttttcttttttccagcccataagactaagggtttaaatctgcttgcactagctgtgccttcattagtttgctatagaaatccagtacttatagtaaataaaacagtgtattttgaagtttgactgcttgaaaaagattagcatacatctaatgtgaaaagaccacatttgattcaactgagaccttgtgtatgtgacatatagtggcctataaatttaatcataatgatgttattgtttaccactgaggtgttaatataacatagtatttttgaaaaagtttcttcatcttatattgtgtaattgtaaactaaagataccgtgttttctttgtattgtgttctaccttccctttcactgaaaatgatcacttcatttgatactgtttttcatgttcttgtattgcaacctaaaataaataaatattaaagtgtgttatactataa

SEQ ID NO: 36648 - DNA, 36371 bp, Homo sapiens
gcttctgctgggcagggccggctgttaatctcgcctggcggagcggacaccggggcgtggtgggggagatgggccttataggtggcgtccgctggtgagaaacaccttgcgcaggtaaaagggtggcggcgagagggagttcccacccgtggctttcttagagaaatgaagtcttaagtcttaaatagacaacaaggaggggccgatcggtgtcttttggacgcgtctggagcccctccctccgccaaaggaaaagccccttggatgagaggcaggcgcttcagagaagctaagaaaagcacctctccgcgcgccccacctcctccgcctcgcgctcctcctgagcagcgggcccagactgcgctccggccgcggccctcgccccgcggagccctcctaccccggcccgacgctcggcccgcgacctgccccgagccctctccatggaggcagcccgcccctccggctcctggaacggagccctctgccggctgctcctgctgaccctcgcggtgagtgtagccgcggccaccgctccggggaagggggcgatcgcctagggtgcagaggaaaactaggggaacggggataggtgggggtggcgggaaaagctggggtgaaggggcctctgggtggctagaaaatggagttggcgggggtgggggagggcagataggaagaggatcgcgacctgagagttgggatccccaagggaagggaaggtgtctccggtagatgtaatcagcgcactcaaggagaggcgggagcgggccgctttcgcccagccaaaatcgtggcccctgggtacgcgccggggagcagggtgcgccggggcgggagtgcgccggggtcggagtgcgccggggcgggagtgcgccggggcgggagtgcgccggggccgtccagctggcctctggcaccttccccgggaacgtgcggctccctgtgcctcgggaacgtgcggctccctgtgcctcgggaacgtgcggctccctgtgcctcagcgcctgcccaggccacggaaaggggaaccgctgggcggccgggacggagagcgagtgtccttgggtgaaaaagggaactgctcgcctttctgggaattgtttactctgagagaagggcggggggaagtggcgggtgggggaggggatcttgaccctttgctcctgaggactgtcgaccggcgagccctaggtgagcatttgtacagtttcagtggtttcttaacgtgcgaggcttcagttccctaaatcttcggaggaaggaagggtctttctgatttcttgtccccagaggcgactcgatttttctgctcaccacccgccccccgcgccaccgccccttgccccaggttctttctttctttaaagagcactacagcaatgaccctaccccttcccagagctgggagcctaagtggttggccttatttggggcgggacagcccctttcccaggcttgaccgatgggatctcgttggggagcctgaagacgcaaaaagccaatgccgggagcagcgtctggggaattggggatataaaaagtccgattggacttttcctggctccctggaagaggaaaaaaatcgacaggtgtggaaaagtgctccttgtcttaagcagaaggcgttgggcgccaatcaatcttgaaggacaaagggaggaacccggaaggctaattccttctgggagaagtgaactgggggctgaaatattcgtataatttccccttctcttccgctctcacttcgcagtagagttccacattttacaatcatgaattggtaattgttactgttattagaatgtctttctcgaggagctcaatggacttcaaacccttaactgaattctcagggcatattaataacatagaaagggccaagtacacagcagttaacattttacagatgaggaaaccaagaatggaataaataacggtcagaacatatgttgatgagtaagaaataaattttcattagactcctaataaaattgcaatttcttttaaaaccaccggccattctttaaaggaaaaggcatgcacagacgctggcaatgcgtggcattgctctgcatatacctgcagagagagctttctgtgtgttatctcagattctgtttaggaggaggtggggtatcactgaatacactgaaattgaatttccattccttgttcttccttagcttcggagtttgataggcggggagtggggtaggaagtatgctggccctgcctacactctcattctgctggtttttgctctgtgcacatctgtgcaaagccctgccaacctcacgtggctgttgtggttgtgagtctcaagtgtgagaaatgcgtaaatactaagtgtaagaaattattaagtaagaatgattgtagctgggcatggggtgcgcgcctgtggtccaagtcactggagagaggctaaggtgggaggattgcttgagcttgggaggtccaggctgcagtgagccctggtcatgccactgcatcccagccttggtgacagagcgaaatcctgtctcaaaaaggggggagaaatatctttggtaggagggtaggatcctttaccttccttccttcccatatacccaagtaatccttcaccattccacaaatcagcttttcctcacttcttaatgtttcttcagaccacacctggcttagccacttgaactctgtcttctgctaaccactaataaaccttctaagatcactggctctcctgtgctaaatccaaatgactcattctttatatggttccaccttgtagcttttgcccttattcttgacattcactcccccccgcctttttttttaatctttctgaccactcagggtctgactccctacctagcgtcttgtctttttcttctttttctgttgtctttttttggtttggtaaaaatgacataacatgagatctaccctcctaacacatttctaagtgtatcgtattgttaattataagcacaatgtcatatagcagatctctagaactttcagtttccataaccaaacttttatatccattaaacagcaaatccctgtttcccctaacctccgtcacctggcaaccaccattctattttctgcttctatgagtttgactactttttcctgcactcttaaatgctggtgtctcttggttttctgttctaggtcttgtcctttggaatctacactctttccctagggcattttatccacttttatagcttaaaatatcacacagttgccaacatatactaaattaatattactagttcagatgtcttcattgaacaatagtcctttgtatcactctactgactgtgatgtgtgacacagcatttattatcttcccaaacaatgttgtttttcttttagtgtcctgtatttcaatatatgtcagtaccatatgcctgttcctcaagtaggaagtctgaaagctgtttgttttttctttctcactgctccccttccttaatccatgaagttccatgaactctacattcaaagacagctcaggggtctattcacttgtacctgtcacttctgctattacaaataatgtcacaatgaataaatttgaatgtatgtcatttcatatgtgggcaggtgtatcagtaggacagattaccaataatgggattgacaaataaaagtgtaaattaggccaggtgcagtggctcatgcctgtaaatcccagcactttgggagcctgaggtgggaggatcacttgagctcaggagttcaagaccagactggggaacatggcaaaaccccttctctacaaaaaatacaaaaattagccaggcatggtggtgcatacctataatcccatctacttgggaggctgaggtgggaggatcacttgaacccgggaggtggaggtttcagtgaaccgagatcgcaccactgcactccggcctggacaacagagcaagactctgttagaaaaaaaaaagtgtctaattttgttagattttgttcttccctccataaacattgtatatggctagacagaaagctattttatgatagatatcacatgatcgaggatatatatattggtgtaaagataaattgaatctatgcttcattcagaacaccacagaaaattccagagatgaaagatttaaatgtaaaatatgtttccctacagataatagaagaaaacgtaataaattgttatataaatttggagcccacgaggcctagttatgacttagatttcgaaagccaatttattacaattgagaaaaacaattatataagagtacatatatacatacttcttcatggcgaaaaaacacctctaaccaaccaaaaacacaacaagcaaagtcaaaaggtgattgataaactggaaaaaatattcataggtcatatttaaaaggctaatctaatacataaagagctcttgtaagtcaagaagaaaaagtgcaacatggatgtaacagtatccataaagtagtaaaatggctcttaagttataaaaatatgtcaacctcactcataataaaatatgaataaaaaattacattaaaatgccatttcacacttggcagacacccaaaagttcaacaacgtgcgatgtaggcaagtatgtggttgactcataaattattggtgggtataataaaaagttacaacttttagggactttacgcagtcatatctaatgcaaatacaaattgttttgcctcttcttttccaattcctgtgggtcaaatatcattctattcatatgccagtaccatattgatttaattgttgagattttatatgatttgtaatatctgctagggttgatagcctttcattgctttttaaaaaataattttcctatcttaattttttattttttccttatagccttttaaatcagcttgtttagttccagagaaaattttatggaggtttttattggtatcaaaaaatttgtaatttaacttagtaagaatcgatatagatacgttgttgatttttgtctttctttttttgcaagtgtacttttctgccctgcagaaatgttttcaggtttccttcaaataggctttacatgtttcttgttaaatttactccttggcatttcaacttttaattgcttttgaaaatgatttctttttttttttttttgagactgagtctcgctctgtcgcccaggctggagtgcagtggcgtgatctctgctcactgcaagctctgcctctcgggttcacaccattctcctccctcagcctcccgagtagccgggactaccggtgcccgccaccacgcctggctaattttttttttttgtatttttagtagagacagggtttcaccgtgttagccaggatggtctctatctcctgacctcgtgatctgcccacctcggcctcccaaagtggaaatttcttgtattatctgactggttttgtttatgggtatgaagactaaccatattttcatggttatttctgcttccttacttaagtctcttcttgttttatagtaatgtaatggttgatttgcttgggttttccaggtaaacagtcatatcaaatgcagagattttttttacatcttcctatctaatatccttctcttgcaaatataccttcaatataatgtaaactacatatagtgaccttggagagcctgtcttgtttctgagtttaattggattgcttctagtgttttcccatttgtgttgtgttataatttataaagatcacattgcaaaagtacttatcaattcttattttttgagactaaaaaaaataagaatggttattgaatttggtcaagtgcctgtcagcatctatgatggtgatcacatgtcaagccttcgttaaattcatggcttgaagtttctggaccaagcaaaagatgtgagtgtggatcacagatccacgccagggccagtttacttgtggctcaaatttgtaatgaagatttagcatttgggtcccagattaatgtggagcggatcctcttagatcttaggtgggccctgtgctttgatttcattctccttctctccagaggccagcaaagcagagtcaaatctttgcagatcagaagttgttcctgagttcctcttatcactgtgtgttccagctttatcttcagttttggcctagcaattgcttgctattttgttagctctttgatgctttaggatgtttgaaaaatgttatccctgatttttaattagttttggcataggtttttcttaattacctagcttgttattattgaaaatgacagttttttccattctccacattggacagatctatcacattcaaatataaagctgcttatttaatttatttgctccaagtaaatctttggtttctcattctcgttaggaaaaaagatccatgtgctttgctaatgccgttcaaaatctggcccacacccacttctttgagcccatgttatacctctgcccccgctctggtacacacatcaaccattccagatttcttcttcaggtctgtgccatctctgggccttcacatatgccattcttctgtttgcagcatttaagctctgcctcctcttagcctgtctcacttgtagccgctcttcaggtgacctcacctggcttttagatatcactattacctctgctctcccatagctccctgtacttccctatcattacatttgtcttactttgttgaaattacaaatatgtcttaccttagattgaatgtttcatgaggatcatgtttactgctctgtgtgtggtacatgatacacattcagtaaatatttgttgaattcatgcatgaatggatggatgtccaagatactgttattcaaagaattgtcttaatccaaccatttttcatcttctccaacattattaccttagcccaagtaaccattaccccactcttagattcctgctgtagtctcccaatcagtctcttggtttccactcttgctcttctataacctattttccacataactagtagagtgattctgtataaatatcagtttacgccactccacagcttcttcatcaggctgttgcttctctttgcactcagaacaaaatctgcactccttaccatgaccttttagaccctacatcatttgccattgactgtccttttgttttcttctcctgtcactcttccctcgctgtgctctgctgctatgaccaccttgtttctgcaatacacaagtctccttccagggtctttactctggttcttgccctacctggaagactcttccctggttagaaaactggtttacttcctcacttcatttacgctcaggtattctcgttgtcaccctctctccctgctttatttttgtcgtgacatttatctctcgctgccttggcattatgtgacatttgtgcatttgtgtatttcttttgcttcttattatcatgtaatcttcgtgaggcaaggacttggctttgttcactgctctagccattgaatccgtttagcacctactaagcaaccagtaaatgttggttgaatgaataagtgaatgtattcttccaatcaccttgagctggaatcttcagaatcatctgattctactcctattctctcttggctatgcagccagtgaaaattcttcatatcatttaatttccagttcaaaactaatgtcttcattgtgtctatcccaacattccaaatgaaacacaacctctgccttatttgatccttcaaatgtaattaaaactggataatttaagtctttaatatatattaaaaataaacatttccatccaaattttgatgattttagtttatatttataaactttgtaagtaacagtgtaaatgctagttaactgtcttgcttttggtcaaagatgtttgtaaaactagaaaaaaagaatgtgaatctttgagaaacatccattgtaaagtttcagacagaacaaaattaaatttcagtgtgtttacgtatatgttgcattggacttggttcaccatgaatcactaaaccattgaaaatttttaagtaaattattttctaaaatgaacttaacttttatttatgagaagatacaccttcaaaataattttatatttcaaagttatgtgcctattgtgtggagtaacacataaatattctccaaatcacttcatggcaataagttaatgtttgtctttaaaagcatttactttttgtttaggatattattgatttgatatcatatctcataagcaattaaaaatgtactgaaacagtttgctgcctcagtaaatttggttttctctttcctatgtatatacctgtgctgccttcctgatagttttcagcactctcccacctaggctgttgttggatcgtcactgtacccactgagttaatcagtgaagttattacatacgttttacaatatagtaaacaaagctgaagagcatacataactctttgagtttacaagctttttgcaggaggaagctagaactcagtatattgttttattcttctccttgatatatttttgtcctgatttctttctccaatatgtttttattttatctccaatattttatttatgttttatttataataacataaatcacatataattataaatataaattcatgtatttatatttaattaaatattttaaaattaatatttagtgtagtcaatatgtaatataattaacatttatataagtattatatgcctttttatgtgtatatcattataaatttataatttatataaataatatacacattaaagttttctttttatgcataatatttatttgattttttttcattttttagatcttaatatttgccagtgatgcctgcaaaaatgtgacattacatgttccctccaaactagatgccgagaaacttgttggtagaggtaaggaagccctaaaatttgtaataaatcctgttttgctgtggtacatatacgccatggaatactacacagccataaaaaggaacgagatcttgtcccttggaagggatgtggatggagctggaagcaattattctcagcaaactaacacaggaatagaaaatcaaacactgcatgttctcacttataagtgggagctgagcaatgtgaacatgtaggcacagagtggggaacaacacaagtggggcttgttgggggttctgggagggcgagagcatcaggaaaaatagctaatgcatgctgagtttaatacctaggtgatgggttgataggtgcagcaaaccaacatggcatgtgtttacctatgtaacaaacctgcacatcctgcacatgtaccctgaaacttaaaataaaaacacacatacaaaataaatcctgatttgctgtggtattttaaaattagtgtaatttttagaatgataactctgttgggaccagtagataaaactaatgtagtatattatcatttgtaatatttgtggtgtcattctaatgaaaggaatattgttatttttggaaaacatgattatatgaagttgataaaaatatttcacttgagtaataattattaacatttactttagagaaaagataaagacatttaacatgcctctaaaaaattgagaaatagtactgaaactgttttttttagtttaaagatactgtttttggatttttattcttaaatatttcactctgtattgtatttttttatcaattaaattatttcacataattctgtaagaaaagatcaatccaatgatagcataaaatgtgatcactgtttagcaatagatgtaaagaatttagtaatattttcatttagcaaatgccaattttcatctgctagattctgtataacttcaggtgtatttaggtgttactctatagcttatttctgttgataaagaaaaaaattgttttggttttggtttaaagattcaaacactggagctcacatatgtttacttcagagcaaatgtctcttctttaagagaatgttaagtaggtattagaagtgatgtaagtatttaagcacaacttaattcaccatatagttttatgtgtcctttcaaaaatttacaagtgtcagtataatgaattttaagtttttggctctccccacgtgcatacattactgttaaaactatatcctatgttttactttaaaaatgattgctgtgcatattttctacagttaacctgaaagagtgctttacagctgcaaatctaattcattcaagtgatcctgacttccaaattttggaggatggttcagtctatacaacaaatactattctattgtcctcggagaagagaagttttaccatattactttccaacactgagaaccaagaaaagaagaaaatatttgtctttttggagcatcaaacaaaggtatacaaggctacataaatgaagaaatgatatcttttcttcagacgtaatcaacattaccagggaagatatgaaatcagaaaggatatggtatagtttggcttaaagacgaatgaaaaccatgaggcaacttcacagtgtttagaaggaaaagggctgtgtcacatggttcattcgggttgtcattccttttcatttgggacgtaaaaggagaaattgggataaggtacagcatgggaaagtgagattagacacaaagcagcattttttttttgagctttaccgtagaatggatttctaacaacaagttttgaaactctgtataaagaaaggaaagcttttttctcgcattcattttagcataatctgtggtcttaaaacatagataactattttaggaggaggtttggaccacatgcatgctattgtgttgtgacacccaagatcaaaataacttgtattcaaccattagccattcctcactgcagcagtttgagagttgtcaccgtgtttctctcctcattctgacacagatctctctgttggttccctggctctgcctagttgctggtgagtggaagttgcttgtgctaaatttagaagggcacatacacacttattttctttgcatatctctctcccatgtttttgcatggcaatggggcaacagtaatttttttttcagttttgcttctaggcttccagttccatctctctttcttccatatttccaccaaatcattttcccaagaggattgttgtgataacagttaggacagttacttcttcattatctttttgcagtgttgatgattagtttggttttcaagcactcccatggtctcacccctacccagctaatcctcctgagaggagaaagatgtgtcattgtttaatgtttgagaataaagtagtcattgactttattattttttcctgtcttatgaattgaggtcctaaagaaaagacatactaaagaaaaagttctaaggcgcgccaagagaagatgggctccaattccttgttcgatgctagaaaactccttgggtccttttccacttttccttcaacaggtaccgttttctttctttctgctgtgggagtctatagtttccatctcttaccattatgacactgagtatgaagttatttgtaatagttgtgtataaatatgtgagtgaatgagtatgtgtataatatgtttccatataagggtataaatatatctctttatacttgcatacacttttgttcagcttgcaaaggccaagcataaaactgtggcactcagacacatggttccttaatgaattgtcacatcagcaagggtatcgccaagcctaagaatagctagaaaacccaaaactctcttgcataataaaggagaaaattggatgaaagaccaaatgccacgaaggaggaagacacataggcccttctatctttctatttcttgttcttgaatctacatctgaaatcacactggatccacatttctttctctctctctctgtctctgtctctttttgtttctttttttttgtagcgatgagatctcactatgttgcttaggctggttttgaactcctaggctgaaatgatctcccatctcaacctcccaaaatgctgggattacaggcatgagccaagcatacctggctctttttctctgtcttgttttaactttcagtagaaaccccagcaagccttcttgccttcttccattactggtggctactacattcagtctatgactttggtttattttccctcagttcttgacatagcaagggagaatcctttttataccccaccaacaaatttaatacagctgagagaagagcatattaaagttgagaaattgttagaaaacagttgtgtcagttatcctgatataaagataggatgttactgagaggatgaacacagcttggaggaaatttgcttttcgaatcaaggatcagaatattacacattccaaaatattattccatttctattctcactcatatttttttttttactcagttcctataaggaagatgttggcaaagaacaaaaaactcattaaggaaattattgtccacatttttgccctgcagacagtacactttaaactcggttcttaaatgttatgttacatataataaaaactcagttttttaaaacattgacgacagaataattttccatgctcagaatactttgttttctaagacaggaagagtcttaagtgttttttccatgtatagacaccatctagcctgtcaaatattcctttagttattctggagaactaagatgcactacattattttactcatgccttgctcttgaaatttctcaattggactttcttattctattgctgttttaatttatatataataataaattaagggcaattatttaaactaataaaatggcaatgagatttcataaatatatagatgaaagctctgctgaaataaagatttgtctcatgtatataatatctactttctaggttcaatctgacacggcccaaaactataccatatactattccataagaggtcctggagttgaccaagaacctcggaatttattttatgtggagagagacactggaaacttgtattgtactcgtcctgtagatcgtgagcagtatgaatcttttgaggtaaagtctaaaatgtgtgtactgtattagcaatgatgatgcttggccattttgtctctcatttgcaattcacgtaaccttttctgctttctgagtttgtcaccaatgctctggctactccctaatagcacataattgacttgaaacaaaaaatattttcatagaataaataatattggattccattagattgttcctggtattatggttttactatttttttttcccccacaacagtaccactttgaagaacagtttttttttttttttttttgagacagcatctcactttgccacccaggctgaagtgcagtggcgtaatctcggctcactgcaatctctggctccggggttcaagtgatcctcccaccttagcctcctgagtagctgggatcacaggcacgcaccatgatacccagctaattttttgtatttttagtagagatggggtttcaccatgttggccaggctggtctcaagctcttgacctcaggtgatctgcccatgtcggcctcccaaagtgctgggattacaggactgagccaccgtgcccggccaagaacagttacttagttggcacaaaaagatctgtgaacctctttatagtatggagatatcataggaggtaaatgaagttcagtcattaagtaaacctcagtaccctggcaatgggagagcattagtttatggggagcaggtagggggtgtgacagtgcttacctaagcttactcagtcctttaatcatctggttaatttcctatgctggaaagtgagttaatatgaaagaatttaacctaatgctggtttgatttcccaacaggacttggtcattttgcttaagtcagttttaattattttatgtctattttggatgaattaattattcattagaagaccaaattaatcaaataagacaggcaagctttgaataaagtatttaggtttagaattgccatggcctggccttctgagtacctaggatgttctggcctttctatgatagctgttatgagaaaattggtattgaaattcatattataaaaacaaaaaaattaaactgtattccaccacagtttaccaccattcatttgtttcatttctgattcaccctttttaaattaaaaattctttgaaaagacttacccaaatgtaaccattgatatgcctaaagtcctcattagtagaaaataggataatatcccagttaactgtacctgggtaatcctacaggatcccaagttcagaaagatccagaaagttgtatttaaaatccatgcacctgaacctttcaaacaaagcaaaataaagaagtcttcaaggctgtttgggaaaataacagtaaaaattgttacactcatgaataacagtatagcaataatgaagaaactaaaattatctttcataaatttaaagagataaatttaaacatacaatgccatattgaatcatgaaattaggcacctctttggcattaaaattatatccatatcccagaacaataacaaatggtgagactcatactgtagttctgaacagtctccaagttaaagccaaaatgaatttgaagcatacctcattttaaaagattattttcacttttctccttattttactctcttcacagataattgcctttgcaacaactccagatgggtatactccagaacttccactgcccctaataatcaaaatagaggatgaaaatgataactacccaatttttacagaagaaacttatacttttacaatttttgaaaattgcagagtgggtgagtacctccttaaacaatatatggcaaattaactgtgtttcaattcatacatttagtttcactatgtccgttgagaagcagcgtatcccagcagcaagaataagggactctgggtggaattttactctgtgtttcactagctgtgtgatgcttggcaaatttcctaatcttggcaagcctaatttcttcatctgtaaaatgggttatcagtatgccagattgttatgaagatgaagtgaagctcaatacacagcgaatgccaagcacagtgcctgacaaataggagttaataaatgttatgctgtcatcctatggatggatggatgtaagagaacatagcccaaaaagaataagtctttcactaattggagatgtagtcttaaagatatgtacggatgttctctaggattaaatgtgattgccagtattctgggcacgattatgaaagtcactgagaataatacaaacattttctcagccctgtgaaaatggtctgttttaactaaaagtcagaatgcagttttggagaccttgtctagaaatgtctaagtgaaccatgcagttttagagaaaactgactcctatgatcaatctaagcacaagcttacaaacagagaaaagttatagaataatcagaattgtttagtctgaaaatacatggagggatagtatcaacatttataaaatcatacattaaatacaataaatatgaatatgatcacccaattcgaaaatgctagtatgccagaatatttgaaaggaagtgatactgtatggagaggtctgcaaatttataaaagccatgactttgccatgtaataatgtggtccagaacttttttgaggtgggtgaaaaggaatgaaataaagggaacatagaacatgtgaatgttttggagattaaaaaggacttttcttctctaggcactactgtgggacaagtgtgtgctactgacaaagatgagcctgacacgatgcacacacgcctgaagtactccatcattgggcaggtgccaccatcacccaccctattttctatgcatccaactacaggcgtgatcaccacaacatcatctcagctagacagagaggtaacataaacaataaaacctgattataacgtggctattcaatagtacctgtataactcctgtagatgtgtttttgaaaagtatgttgtgaatctcattttagaaacattattattttatgtatgttaatagagatcactaaataaccttggagtatgctggttttgaactgctaattcattcttttctgaattgtttgtttcatacaatcagatttcctgatataaacatatttacagtattaaaacaaaatgtcaaatatgaaaagtgaaccttttaaatatatgcagaaatttgttatcttttcaacaatctcatctacattctacctcttacatagatgaaaagacagtttatgtctctctaatctctggtttcccatttttaatcaactgctagaaatcttgatttggatgtctgacaggtacttatgatgtaataaatctaaaatttaacttgtcttcttttcttctaaacatattttccattctatgttttctagttaaaaagatatttatatattctttctctattaatcattttctattgtcaccttggagtcatggtctccaaattgtatttgatgtctcttggcccccctgaatcacatcacttcctaaagcatgtttttacctccaagattgttttaaatctatattctgtctctttctactgcaataccctagcttagtaattcattcacttagttattcaactattacctcctccctgaagcattattcatctaaattcttatagcagtttctgtgtccttatttactatatttataatccttaatcttaaaatatagtaatagatgtttatcaggtattttatttgattcttaagtcttaaatcttcagattaattttctcttccttcctctatccctcatggattagggtagaggttctcaaaagctttggtctcaagaccaatgcttgacattattacatattgttaaatattgttgaatactgttaacagtgttaaatattgttgaaaatcccaaagatcttttatttatctaggttatatttatctatgttacttgttaatgtttaaaactaaggaaagtttaaattatatattaatttaaatattaaaaataataaattaattacatgttaacagttaaaattcttataaaataacagtaaaaattgttacactttttcttctttttgtacttacaaaataagtacattttccaaaacagtacaatttagtgggaagaatgacattgttatgcatttttccaaatgtttttagtattttgcttaagacaggtggattctcatatctccttctgcatttagtctgttacaatatgtagttttagctgaagcatatataaaggcaatctgacatgatataaaattagaaaagagagtagtattttgatgataattacagatcactgtggatattattccttgatactacatgaatacttgataaggagtagcttgtttcctaaatgtttttggtaatgtggactctgaatcctcaacaatgaccttttgtactttattacgttaaaatccattgctctatcttacactttgagtgaccattttaccagtacatcattctatattgtgcattggtcatttggaaaatattggttcaccaagtaatgcagagcttccaaatattgacacattgcattaaataatatcaaaaagatcacctctttacttccattgatatcacattggttgataaaggttttccaagcttctcatttttgtttgaaatctccaatttatcattggcaacaaatagttgttttccctgaagtgacagattaactttatgttttacaaaatactttcataaaactatagtctgcatagccatagatgtctatgtgaaaatagcattctatggaaaaaaaaaaaaagcaaaaactcaacagcttgttcagctcctaaatcaaacaatcacagaagtgcttttctttgaatagattcttctgaaataatcagttgaaaacacttgtccagtgaaggtgtttatccagtggtgctctctagtaactttttgacctcaggattccggttttcttcagttgcctacaaccttttagtccctttaaacatcagaatttctcttccatctgaagatagcataagttaatacttagggtatcaaacttcatttccttgtttcattagccagttaattatttccaataaattttagttcactacaaacaaaatatgtattccttcttgaaagtacagtagcatgatgttttaaaatttttcagttgaaataaggccattatttttcaagtctacacatgtgattggttatgagggaggagtaaatctggaaaattatgtgtgttaaaagcaggaagatcaagagaaactttagttttattttagataatgcctaaggaaaagaaagtttcagagatgatggaattaagggaagaatctttgtaagagaagggtgaacattctaggtagaagatgaggatagattttaacatgctattttgtcttatgaaaagagataaattaggtaggaaaggtaagcatcaccatcttatagaagaagaaacctagacaaagtgaattttccaattgcccaagattgtgtctcttatttttggagttggaaatagaacccaagtctcctaatgctcagtccggaaagcattattactgtattgtttttaattctcccatatctcaatcacttatgataaatgaaagttataaggagaaacactttaaaatatttaaatgcttcagatgtttaaaaatattttttaaggtagtgatgagttttcaacaatatctgataaattgaaagccttaagagccagattctattttccacagaaagaaaaaaacctacatagccccagacctttatcttcatgtcagtttagatgatctcttaaatgtaacataaacccttaaaatctatattttttgcaggaagaaatttcattttattgttttgttaaaagactattttaagagtcattgctgtctatttttttgaacataagaatgtactttggctaggagataaaggttttgattaattaccaggcaattttaaatgcacttgtggcaaatagctcttctttttctgttgaataaagacaaaaccaattgaatctatattctgtaagttaatagcactataaatttgagaaactattcaattttcataaattgattaaaaattcctagtgtgattctcctgcctcgcttgaacccgggaggcagaggttgcagtgagccaagatcacaccactgcactccagcctgggcaacagagcgagacttcgtctcagaaaagaaaaagaaagaaaagaaaagaaaaattactagtgagagaaaattcttctaatacacgaatgctgtgaaatgtaataatgcacttcttaaattcttagtgcaaaaaaattatggagtgtaaagtaagatttcaattataatgttggtgctttcccccaataattaaattctttttttgttttcagttaattgacaagtaccagttgaaaataaaagtacaagacatggatggtcagtattttggtctacagacaacttcaacttgtatcattaacattgatgatgtaaatgaccacttgccaacatttactcgtacttctgtaagtgtatgatattaattaaagaaaaatgtatagaccagttttaattgtttaatatgcacatctctggcctggcgcagtggctcacgcctgtaatctcagcactttgggaggccgaggcgggcggatcacctgaggtcaggagtttgagaacagcctggccaacatggtgaaatcccgtctctacagaaaatacaaaaattagccgggcatggtgacaggcacctgtaatcccatctactcgggaagctgaggcaggagaatcgcctgaacgtggaaggcagaggttgcagtgaaggaaaagaaaaaaatgcacatccccatccacccctcatgatttcaaatgaagtgccccagtgacattaaaagttgtatagtgctagggtttcaaatcatgtaaacatagtactttggaaattagaagagtaggatttacttcacatcgtgttcaatttttgtgagagttactaacgaaattttttgtttgcttttattattttagtatgtgacatcagtggaagaaaatacagttgatgtggaaatcttacgagttactgttgaggataaggacttagtgaatactgctaactggagagctaattataccattttaaagggcaatgaaaatggcaattttaaaattgtaacagatgccaaaaccaatgaaggagttctttgtgtagttaaggtaagaataaattagaacattatttgtagtttataatatcatagaatagcatgctagaatttaatggaaagaaaggaattctgataaatgtagaataaaataggtatataagtaaatgcaaatgctctgttcttcatatacaatggaaagaatatattagtttttgataatcttttgtttaggtatttttttttttaaaaagtccatataatacaatatctattttgtaaccaatatctttaaatggttcaaaaactagcacagctttgatgcccctgggacagtgccagacttttcctagcccagtttttctgtgtttgggtcaaggagcctttatttacttactgaatttcccaaatcaagagttactcttggtcagccccatggagaggttattcataggtttgttcatcatattcagtatatattacatccttagcatccaggttcagaatgaaaatcctcagtgattcaacaatgcaaacacttctaaaacttctttctaatactatttcagcagccagagttagtgcataaagcaatctgagctcctttagccttggacaaatttatagacttatttctgctgcatctttaaccagaacatggttttacagtgggtctatgccgttttctttttgtatatattcacaaggaccatggattaaaaaatgatgaatccattttccttacaatgatgaaaatcagctgctgtttttatattattttctctattttaaaatagcagagaaatttcctttaaatcttgtctctttcttcacctaacccctcccctaatccttggtattctcagaaggaaatttgtgtgaagtccaagacctgaaaaaatttctgtcttctagggcatggtttcactaattctcattacaactacatatcaggcaagataaaataaaaccttttattaaatatgttcccgtctttaagacaggaactggaatggaagacacacataaaaaaagaaaatatgatgcccataagctttgtattttcttgtcttgctcctcttaaaagcattttaaaaaaatttacccatttttttctcttcctcataccaggtacaaataattttattcatcttaggagggtaagacaagctgtcctaaaatttattttgtagtaaataactattgtttatagtatgaatcccctaaaggagtatctcatgtattaatatccaagaaccctcattaaatactctctgaaatcttcatcaatacctgttatactacttatcttaaatttgcagttgaagaacaattttctgtccttttttttttccagctttacccaagtactgaatcagtgggagaactcctctgtctccaccaccactgggtttctgggtgtattagtctgttctcacattgttataaagaactacctgagactggatagtttataaacaaaagaggtttaactgactcgcagttccacaggctgtgtaggaggcatgactaggtaggcctcaggaaacttataatcatggcggaaggcaaaggggaagcaagcccatcttcacatggcaacaggagagacagagcaaagggggatgtgctacacacttttgaacaaccagatcttgtgagaactcactcactatcatgagcagtggggaaatccacccccatgatccaatcaccttccctcaggtccctcccccaacattgggaattacaatttgacatgagatgtgggtggcgacacagagccaaaccatatcactggatatatgtttcatattctcgtggttattcccaacatgacacttaacatatttccaaatttaacattatatatactcgttagcattgccaaatattaaatgagttcatctgatttttcaatacatttgctttcgtagcctttgaattatgaagaaaagcaacagatgatcttgcaaattggtgtagttaatgaagctccattttccagagaggctagtccaagatcagccatgagcacagcaacagttactgttaatgtagaagatcaggatgagggccctgagtgtaaccctccaatacagactgttcgcatgaaagaaaatgcagaagtgggaacaacaagcaatggatataaagcatatgacccagaaacaagaagtagcagtggcataaggtacttaccattctattttagttttaaaatatatagcttattttgttacgttattataatttagcatatgataaattttattattttaattcatcattaccaacaggtataagaaattaactgatccaacagggtgggtcaccattgatgaaaatacaggatcaatcaaagttttcagaagcctggatagagaggcagagaccatcaaaaatggcatatataatattacagtccttgcatcagaccaaggtaagaatttgtctttaagccagctacatacttccttggctacatacatcttcagtgtttaagccaacagtatacattttaaagctggatacatgcactctgttttcatatctcttgataatataaagtaagaggtttactataatttattaactcatgtctgctttctaatagccttctcagttttagatgtaattataaaataatttactcttagaaacacttgagaccataatttattaaagttaaaattattaaaaattgagaaaattattttagtaaaacttgtttcagctgggtgtggtggctcatgcctgtaatcccagcactttgggaggctaaggctggaggatcacttgaggtcatgagttcgagaccagcctggccaacatggtgaaatcccgtctctaccaaaaatattaaaaattagctgggtgtagtggcatgcacctgtaatccgagctactcgggaggctgaggcaggagaattgcttgaacccaggaggtggaggttgcagttagccaagatcgcgccactgcactctagcctgggcgacagagtaagactctgtctcaaaacaaaaacaaaaacaaaaacaaaacaaaaacaaaaacaaaacttgtttcagtttatctacttatttcgcttaaagtgttcactttgtaggaaagtgagaacatacttacatagtgcagtcctggaaaacatacttacacagtgcagtcctggaaaacagctctaactttttacaggaagctaacaatatacttgggggttagaattctgattaaagacattatataaaaataaatcatggtatatttatgatcatggtaaataaatagtatattataaaattagagagacaaacactatgaattcatataatcatataaaatgtaaaattatgttctgtgcattctataaaattgagagaaatatgagtatgatgattatttatgagacgcgtttggtgcataaaatataatttctataacatgaatttgaactttatgtctttgtaaaataaatatgctaaatataacaaacaaattattatactataacttgcaaaattagaatttagaagtgattttggaagatgatttatgtattccagttctctgtaaattaatgagaaatgactcagtttgttaaattgctgaagttgtaatcattattgatttgtctttaactaattaaagactgtcctttaaggcctcagattctcatgtctttttgccaagaaatacttgttggtcaaaggcaaatgaaaagaaaaaaaaaacatgaaactcaacggcacttggaaatagtttattgacagttgagataaaaattgctgtctgaaattagaaattttgcctataattttattctacattctcgtctgttgcagaggagtttaagtgattgagagatcaaatatttgttatggaattgagatggggcactgcttatcatcattgtgatatagaataaatgtgtaatgaggctgttcgcattcatttcttttgaagagggtgggagtcattgtgttactctgtgtgagagaactgtgaatcagtaattccacatgtgtttactttgtgaattgaatgaaatgagattatacaaaagtgtgtcattttttgaaaaacctttttctaaaatctatactggctaatttcatttgggttctccctgccactccctaatggaaacctctcctccctcatggatactgctgtcttgggctggtgctcacttcctgccttcctacatctccgcagcaattgcttcctctttttaaaactctctctcaaggcttctatgtctaaacttgcccacacattcctgcatgctttctggtcttaactgccttcccctctcctaaacatatatatttcttaagctttaaattcaatttatcttttcttcttaacttcttaatctaaattgtgtgggcagctttacccagaaatcacctctatctagttgagcttgagattaatgtttctattgtattattccagctgttagaatggggttacttgcaactattttaaaacatttgactgaagagcatcatgcacataaagcatgaaaccatggatagtgcacctcatgtgacttcatatttggaattagcctttgtccatgtagaattatattattactagaagatgagcattttatgctgacattccaatgaataaaacagtatgtataactcatcagcatatgaaaaacagctatgaaacacagtggattagatatctgaggtcttaaatgttcttctatgacagtattaatcacaatgtgcaaaaaaagattggagtttaatcagtgagcaactgtaaacatctactggaaggaaattgaagcatttatcccagttgtagaagagcaagcactatagagttcagtttttaaagatagcacaattaaccagattcaataggtaaggcatgtgctctcaattgtgtgtgtggactcaaagggaaacaaatgttcaagacaaccagcagtcccaattttcagagagagcaaggtaacaccacatagcatgagaacaggagaagttgagggacagaaattattctgctctaatgaatagaaacatatgccagatacatgaaatatatattatccacctgcttcctttttctaatgtaaatactctttttcaaagttgtccaaaaatggaaggtagttgcgttgtttcctgcttctcattgttttctctcctagctcttttttcttcttgctgaagtacatcctttactatatttttttcaattgtggaatgtgaattttaaactctctcagttttgttgttctgaaaaatattttaatattggcctcatacttaagtgacactttgacttggtttaaaattctgagtcaacagcttctttcccatggcactgtgcagctattaacccattatcttctggtatctcttcttgctgatgcttcttgttctgtcgattaacgattgtccttttgtagttaatatatttaggtagcttttatagtaccctaaattgagttctacagtgttagtacaatgtgtatgccgtggatttttttatatttgtctagttctgcagtcagaaaatactttcaatctgaaaagccatgtttttctttaattctggagtattctcagctattaatctctttaactattgcttctctgccattctgtctattctcttttttagaatccctggtaggtaaatgttgctgtttattttctactggaatttgagctgtaatttcattcttgtttaattggttacccctctttatgtctttgaagattctaaacatacctgtttcagagacgtcttggatagaatgaattaatcttttgactggtgcttttgttggttttccttcttagtgttaatcttgattatttgggaattttagtttgcaggcttatattaaatgagaggtgtttgctttgctttctgtttttgttttttccctctctcccactttgcccatattaactactagtcttgtagttgccttcacctgctctttctctgtggcccacggtttagaaccagttcttaacttggtggcctagtgctcctgacccatgatgacgctggctctatcacgagtctagttgctgtgctgcaggtgctctggctgaggttgtgacttcagggatgtgctcggagatcttcccgagcttggcagcttcatataagacacagccccaggcagtggatggcacagggtttttaaattctgttttccacctgtaatgtcaaaagccttctttttaaacagaaagaatgaatgatttagagacagaactcctgggtttgtgttcagtttcagacttcacaactgcattactaatctgtggcgtgggtccatggctgtttcatctttgaatcccccagattttccagtgcagtgctttatataaagtcgtcatcctgtaagtttctttctttcttttcttttcttttctttctttttttcgttttgagatggagtttcacttttgttgtccaggctggagtgcaatggtgtgatctccgctcactgcaacctccgcctcccgggttcaagcgattctcttgcctcaacctcccgagtagctgatattataggcatgtgccaccatgcctggctaattttgtatttttagtagagataggctttctccatgttggtcaggctggtctcgaactcctgacctcaggtgatctgcccacctcggcttcccaaagtgctgggattacaggcgtgagccactgtgccccgtctatcctgtaagtttctattgaatatacagatagatgaattacttaggctacaacccacagtgattatttcagttttcaagtaattttctactcctggagtcttctgccctttgaatattcccatgtactatttttgttacaatctttcaaatatgtaacttcagtttctttgctccaaaacctaagtgctacctatttatccaacaaactctaagctccctagtctggctttcaaagacccttagctcctgcttccatgtcagtttctacctgtctaccttccctgtcattgtctccagatcacgggtgtgtataacgtgcgtttccatctccttgaatttccttgtgcttttaaatataccagaagtgtcctcattcatactctcttccttcctcttctcacaaatcagccaaaacttgcctctaataataatttagcgaatgaataaacacatcttaatagcagtcattgtttgtacaacccatatgaaagtaatactatttttcttgtaacattccctgaggacatagcttgtgactgcttgtcattgtaacttctacattataggtgcttaataaatatttttcaatgtgttcagtgcatacttttgtggtgaaaactcaaaacatagaaaaactatttttattttcatttttctaggagggagaacatgtacggggacactgggcattatacttcaagacgtgaatgataacagcccattcatacctaaaaagacagtgatcatctgcaaacccaccatgtcatctgcggagattgttgcggttgatcctgatgagcctatccatggcccaccctttgactttagtctggagagttctacttcagaagtacagagaatgtggagactgaaagcaattaatggtatatatttttgaaaattgctttgtccttttcaacatcaggatgtctgcgatacttttttttttttgtatgaaataggagaaaattcaccatgtgggaaacaccaatgaaagtttctcagtttttgtgtgttgggagtaggtctctctagtgtgtctctaatcctatgccgagattcccttaggtgtgttgtgaattctccctcctactccaaacacacacacacacacacacacacacacacacacacacacacacacattttttctctttctctctttctctctcttagacttggtctaatgcagtcatttcctaacttgtgtacctctcactggcatagatttctttatagtttcctgggtcataagggagtcctcatttgttactggttggctctccagaaagcagaccctgaggcagggcatctcaagcagaatgatgactaaggaatttgcttgggatcagtagctttgaaaggaggagaagtaggattgggcaaaaagagaagtcaagctgcagcacaagccaaatgacaacctcagtgaaccccagggggagtctgagctaaatgggccttcagagtggtcctgaatcgatcccctattctctcttattgttccatcagtgtatgtgggctgcccatggcaaaaaggcacaatcccggaaggtgctgatggcctcccaagcagctgggatgcaagtccttctttgaaaagggatcagatatacaccacagtgtccaccacgttatctctcctctctgccactgtattgacttctgactatttcatgtctattgtattctccttgggattctcccctaactcggttccccatgtgtacttttgtctttagcccagaaggatctacagtgataagtatggcaaaaatgaaggcaacctgtctacattatcaccactgcctcattccctagttggcgcgtaactcttcagcatgttccccatctcctgctcacactgcctatggaccatgatgtcatggtctaccagctttcgtgactctagaaccactgaatgaggcttgctttttaaatgcccttgaatgtttttcagccccatgctttcagtgaatatccctcaatttcctgttatgacaaattagaaaagaaaggttatgagggaacgtaaagggagaacaggatggggaaaagaaagatgaagacttatagaaataagctaaactactatgtcttggatcctgctctgtgaactaacaagattttcagctttctaaacaatattctgttgtgtgtgcgtgtgtgtgtgtgtgtgtgtgtgtgtgtgtgcgtgtgtgtgtatcggggttatcagtttattttggggtggggaggaagaattaactttattcttagatttttttcttttctacttatttggtgtcatgatattaatttttaaatagtgttgatagaaagtggacatttttttttcccaatagtcttacttagcaaaataaaactttggcagctgtatgtttgtcaacatctttgttattttaaagatgtacttgtctgagtaatcacttataagcttgggaaacacccaagttttaagaagaatataccctaaagaggctttgaagtcagttaagcttagtgtcaaaaacgctggttcttccctgtttgttagttaagtaaatctgaccgtgctatttattgtctttgagcatcaatttactaaaatgggatttttgggggagtaaatgagataatgcatgtaatacaccatgacacattaggaattataagttttggttttgctagtctcattataattttttacaaaatagacttaacaggttaaccatggcttctcttaagatggacttaattcaatgtgtttttacccaagcattcaaatttgtatttagagcttcaaatactatgcagaaaatgagaatgtcatactgggcagctatgtgggagagggattattctatgggacctggtatctgcatttagagtagtagtatatctagtctccaaaaccaagattgtattggcttctaaattttttttagttttttattgtttttttcttcttctaaattcaagtcatacaggtaatgtactgttgtcgtaataaggtttgagagacgtgtgtctcacacatgagcataaaaaccctatcatcatgcttatgcaccataaaagccataaaagaatctgtatgggctttcggttctagatattttctagcctttatctaagaaaactacatcaaaactaagacacgtgcagttggtccctttgtcctttaggaccaggagatgcagctgcagctgtgtgactcatgacctgctaatgtagtcactgtcaggggtgttttaagttgtcagaattagtctctgacagtaagtcacaagtatttatgtttatttggcacaatttttgaaaatgaagtaaaggaaaacatccagaatttcagactattacttcgatgaagcatgtgtaaaagaaaatgtacactcactggtttaattaaatattttcaagatatggtaaaaactaatctattaacaagtctattagttgtgataggaaggatttgtttacacacaaataaaatatattattacaagagccaaaagactttgtttaagaggcagcatagacaaacttttatatgtaatatgtttgcaatgggtatagattagaactactctagccattcacatttagaatcttctagcagctatgccatcccatcaggaatatctgtttctaggaaaatataactatctgataatgagttatttatgttcagaagaaatcagtgacattgtataatgtttggttttatttatttatattttcagatacagcagcacgtctttcctatcagaatgatcctccatttggctcatatgtagtacctataacagtgagagatagacttggcatgtctagtgtcacttcattggatgttacactgtgtgactgcattaccgaaaatgactgcacacatcgtgtagatccaaggattggcggtggaggagtacaacttggaaagtgggccatccttgcaatattgttgggcatagcattgctcttttgtaagtcttaagtcctttcttgaattcaaataataccctttaaagtaactttcaagacactttttgttttttgagacagagcccaggctggagtgcagtagtgtgatctccgctcactgcagactctgcctctggattccagtgattcttatgcctcagcctcccgagtagctgggattacaggtgtgcgccacaatgcccagctaattttttctacttttagtagagatggatttcactgtgttggccaggccagtctctatctcctggcctcaagtgatccccccacctcggcctctcaaagtgctgggattacaggcgtgagtcaacacacctggcaactttcaagacacattctaagaatcagtgctatttcctatagctgatcatttgcatgtagctgtatttttatttaatatataaatatatttaatttacatattttaagtgcatttatgtatagttctagtgtcttagttattatagacataaaattcaatgtagaaacagaacatgtaacataattatagcatatctgtttaaaagtttaagtagatatgctatttaaacttttaaatagcatatctatttaaacttttctattgtatactgctttgacacaagcaatccaggaaagctgtcttcttttaatatacacttttaagtttatgatttatgtgtgtattaaccattgtacatttataacttcatattattttatgataaactcaagtatatttctttcttcctccaggcatcctgtttacgctggtctgtggggcttctgggacgtctaaacaaccaaaagtaattcctgatgatttagcccagcagaacctaattgtatcaaacacagaagctcctggagatgacaaagtggtaagtagtctggctttttaaataaatacaaaggatgaattcgcttataatgcgtattccttctaaaatgatcttttctcagaaaagttcttttggtatcaggcaatttaccatagaatgtcatgggtcccctgaaacagataaaatgactttgatttacatgatgatatatggtatttaaatttggccgtagtgtgttacttaatagtaaaaatgcttgagtatgtcattgttatttttacttcagatgattcatggtttcaactttaagccttgtcttttgtatatatttcaactgctgtttgtgctgtaaaaatgctgcttttaattattcacggtttaccaacatggttttacattttctggcaacaataaaatcactacaagccttgatcatcgtgggaagaactttaatagattctttctggctctaatatgggttaggaaacagcctgaggccaaatatatgaaatagcaatgctagcaagtggtcatttctccaactttgctttctagctcaatatgtggaaaaggaacaagtaaataccctataagaagtgtaattgatgactagggcaagaaagatttagaaaacaaaagcatgacagtatccaggaaggtaatgaaaaaataaaatttaaataatattagagtttccaaaaatgcaacataaataactagtggccaaagctttggtgttcttgttattttccctgcctagtttattcatatatatttagatggcaagggtttaatgttgcagttaagatttttatggcaattatagttttattctttttgatttagttgaagtataactgaattagatactaaatggaaatattgatcattacttctgtttctgctttagtcaggtaaaagggaattaatttaaactaagcagagtaagtatatgtgagacaacagtgtttattttgaggtgtgagatgtaggaaggattgaagaattagagttgtacagtattctaagaggctttttttttttttttttgagacaagatctggctctgttgccaaagctggagtgcagtggcacaatcacagctcactgcaagctccgtcttccaggttcaagcgattcctgtgccttagcctcccgagtagctgggattacaggtgcctactaccatgcccagctgatttttgtatttttagtagagacggagttccaccatgttggcgaggctggtcttgaattcctcatttcaagtgatctgcttgcctcggcctcccaaagtgctgggattatagacatgagccaccacaatgggcaggtattctaagagatttttaaagaaggaatatacatcaagcttcctaatttatctccaggtaccaaccacttgacagtttgcttgtgtggctactacgttaaattatggggtttccatagttgggtatgcaggattcacaaaatagatttagttcctgctctcagagagcttaccttctagcatacacacaaaaaaaggcattatccgcttgatgttgttctttttcataattttgtgttcctctctgtattatccctaatgcaaattgttttcatttcagtattctgcgaatggcttcacaacccaaactgtgggcgcttctgctcagggagtttgtggcaccgtgggatcaggaatcaaaaacggaggtcaggagaccatcgaaatggtgaaaggaggacaccagacctcggaatcctgccggggggctggccaccatcacaccctggactcctgcaggggaggacacacggaggtggacaactgcagatacacttactcggagtggcacagttttactcagccccgtcttggtgaagtgagttttcctaagtggcctacaaatctattttaattttctttaaactttataaataactaactggattctgactataattttcaattaattatgaatctactaattctactaattgaaagctattatttttcctcaattttaatttagttatgttcagatttaagtggttatttacttcccctcctatttttttaattgaaagaattactaaataatgtgtgatgagatttaaattactgtctcatggctttgtgctaatatttcccatctgacaacttgtaccttagaaaccaaaaatgtggtaccagcaagaccagcatgtactatcactatgtctatctgggaagaactgagcccatatcaatttgtcttcagtttaatggatgcatgtcactttcagctaaaattttgaaagggaaagtagtgactatgtaaaatgaacacctgtatacttgctgccacatgcgtgacttttagaaacatgctatactgaatttatagtgtgatgtatgaaacagaccaatcatgtgcattttttatgtataggaatccattagaggacacactctgattaaaaattaaacaatgaaaggtaaatcaaagcaattacttttatgttagtaaattttggtgtttaaaataataataataaaaacgttgtgtttttccccttggcagaaagtgtatctgtgtaatcaagatgaaaatcacaagcatgcccaagactatgtcctgacatataactatgaaggaagaggatcggtggctgggtctgtaggttgttgcagtgaacgacaagaagaagatgggcttgaatttttggataatttggagcccaaatttaggacactagcagaagcatgcatgaagagatgagtgtgttctaataagtctctgaaagccagtggctttatgacttttaaaaaaaattacaaaccaagaattttttaaagcagaagatgctatttgtgggggtttttctctcattatttggatggaatctctttggtcaaatgcacatttacagagagacactataaacaagtacacaaatttttcaatttttacatatttttaaattacttatcttctatccaaggaggtctacagagaaattaaagtctgccttatttgttacatttgggtataatgacaacagccaatttatagtgcaataaaatgtaattaattcaagtccttattatagactatttgaagcacaacctaatggaaaattgtagagaccttgctttaacattatctccagttaattaagtgttcatgtggtgcttggaaactgttgttttcctgaacatctaaagtgtgtagactgcattcttgctattattttattcttgtaatgtgaccttttcactgtgcaaagggagatttctagccaggcattgactattacaatttcattttggtggagtttagttttaggttttattgtatataaaatcctgcactgaatctgtgtctcctctgttacctacttttgccagtgaaatttaagttttaaaatactttcagaatgtatttttactactgcaagtttttggtctttaaaatgtcaagtagcatctctctctttctctctgtctctttctgtttctctctccagttttttttttttttttaatttccatatgggctaaagaatccaaatattttaaaaatctgtctctcttttcttctctcataaagtgaattattccttttttttgttttatgtaagtgtatatattcttagtttttcttgaaatcattgtaatgttaactttgttgtttcaaatatcttggtgattgcttcattatctcttcaacaaaaaaaacctttaattttgccattgaaactgtagaactatgccatgcttttattagaagcagtgctctgtgttaacaacaagaatggtgtaattagaattgggatgtggatatttactgtatgacaacacatttacagttctgtaatgcaaggatgcagtttaaaaatgtgaagtagtgatggtttttgaaataagctttaaaatatagggatcttgaaggctccctggggtaactattttataacttagataaaatggctagtcatatctgtgtgtttgtaaagttatttttttaatattttaagattacaattttaacaaatgtagaaatgagccaaactatttaaattttaaaacagtaaaacaaaatgaaacttaatagctcacaaaattccagtccatgtttcatgacttattttagtcaatgaattttctatttatactaaacatatggacattttaaatgtgtttctaatatttttgattatctataatgtgcctgtcttcaattcacaagattgggttataacaattatttgccagattaacactagggaattatttgataaccagcttatcttatcagtagttttattgctgatcaggcaaaaatagttttccaaagttatttttaataaagtatatacaaaattcttatatattactagtcatgataaagtaaattaagcagtttttaaaacttagtgtgagtttgttcatcacaggtctgatatgagtttaagggatttcgcactccctgaatcagagaagtaagaccccttccttagattcctgttatacattttttaaaatgtagagtttgttttggagacattttcagtgcattgttattgccatatttatataatatgactattctaaaggctgtgaggccatggggtattggttaagttgcttgcttttgctttgtccattttcatcattttaaaatgggggataataacagaacttgtttcctagggccattgtaagtcacttgaataaaaaatagttttgaagc

SEQ ID NO: 36649 - DNA, 58517 bp, Homo sapiens
gctgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacggtgagcgctgccgcggccccgctccgggaagggacgacgctccgggggtccccctccgcggccgggcacgcccgctggagcatcccccaaccccgctcccgccctgtcccgcggcgccccggccccgcgctgatgaaattgaggagctcacccagcacccttcctccccttcctcctcctccatgaaaggggagggacccctcctgagctacatttaaaagagcttcgggcacccggcctccctgggtcccgctcctgcggcgcgggtgggaggtgtaacttgacaggtcaggatcgttccctagaacgaggcacacccgcacgcagagcgagcccgcctgcggagggcagagcctcccgggctggggaggagaaaccctggggcctggttctgtgcggggcagggggcgggggtcggcttgagggagggggtttcactgcgtagcctgggttttggggttgtgttacagcttctgttactggttagtatttggaactcacgaggtgtgagagaagactcgttttcttctggtgaagggtagctgagaaagcggggtgggggctggggccggtggggggagtggtctctcggcgggaagccgtgcacgcctccagcgttgacactttcccggtgcactttttctggtgggaggggagagcggagcaggctcacgtgtaaccgcgcaggagcctcctctggcttgagccctttcttggtaagtcccaaaccttcccaagacaaccttggccttagcagtagaggaggggtacgtgtgatgaggccccaaacccggctaagtgatgccacggatttgggttgatgcgatttcatgccttcggtatcacagtagcaaatgcgaaccgtgcggctcacagtgtaaagttctgaaaggttatttggctacaaatagcttgggagtacttgcaccttcttttctaggagaggacaacctgttgcattgcaagagtttgcaatctgcagatgatagccagggacccctccctaactatcctttaaggaagagcatttgggaggaaggggctgcctgcaggcttttgcatctgtgggtgttttaagtcagattttcagatgagatggtagagggttagaatggatggcagtggaggctgtgtttctctgaagatgaaactcagaagcaaattccttaatcccagattccacccacgactgaatactagaattggcaagatccggaatgcttgttaaagacctaatgggcgagcagtacttccaggtagcaaatagctgcatacttccaacataaatgtatagaataactcaccttttccaatagctctgcttttgaaaggttttgtaaatgcatactctttgtaaattggatcatactcaaatgtttggagaagagaaggaagaaaacactttgtatttttttaaactccttttgtaaaaatcagtgtgccccagtggctttagaagcaaacacatgtgagctcagaaagttctcattctctgccaacatgaggcattggtcaagttccctcaagtctcagagcctccgagtctttgttgtaaatggaggtaattgttattttgcaagtttattgtgagatttttgagataatatatggaaagaaccaggtatccagtaggtactctaaacatgatgttaaagaagggtggaaggtccctgctttaccaaaattaagaccactaactcactggctttgtaagtctgaatgacctcctattgctgctgtgatgaattcctggaagataattcaagcctggttattggctgttgttttcttaaaaatgacagcagttgtatataatcacagatgttatattcctattttaggtttaagttattactcttctcaaataatgtgctgagactgttctctggtttttatcctagatcagcctgtagccctgccccaaggactagtgccttctttccaaagtaaataggaagatgttgaaaaacaggcagagatccacgtcctgcctgaacttttaactctagatctacaaaagacagcagccagagaaggaccctgccattcgtgagaaatagtcttataacaggccaggaaaagtgataaaagagcggtattgtttttcttttctttctttttttttaagtccagctttcccttcttctgcagcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtaagtgccctgaagattctcccttcagaaagggaggaggagggtgaatgggacaggcaaggtagagttagcataaacatcttaacactcaggttttagcaaagatcctaagagaggtaccttcttctgctccactcctggcagaggctctcccactttaatgagcatccatatcactcatctggagagtccggtaaatacagactctttgtatctacccctagaaattctgattttgcaagtctggaatgagggcccaggaatatgcattttaaccagctcccccatgggattctaatgcagctgatccaagggctgcagtttaagaaataacttacagttaatgatttggataatttaagcctccatcgcatcttgtatctcttttcctcattccctaaacacgtagataacaggtagactctcaatagggtttggtttacctatattcactcttgtctgtcctgaaggaaaaaaaatgtgagtagggatatggggcaggtatttttttttccatccttttcatcttgttttgtcattagctgagaagtagaatctaaaagcaggctctcatattgtgtttctgagccttcttcaggaccagactccatctctctcgttgctattcccataaacccaactgttcttatctttttttttttttcattttcatctgtctatcacactcagtccacctgtatcaaagcccacaaggctgcaaggtcagctgtaaatgatcttgaaatagtacacaaaaatatcacctgaaatgaccagtacttcaaaacccactgctaatgctcagatataaacacagattgaaggagctttgaattcatgcctttagcaccctgtagtaccaaatgaacaggaagaaagacgatttcatgtgcacaggtaaccaggaacaaagattcagccagataaatcatccggaaggtcacagagctgagggccttagctgtgggggaagacagaaagcaggacaatgcgaaacttgtgctagagattgttactgaactccgtgtcctcgactcttgtagaaatttctgtggcacatggagcaagatttaaatggaaggaaatgatgtaaaggaggaagagaatacccctgcctcgatatattcatattgaagttcctcctttcagacctctgtgtgctggccccttctccaaaattcactttgaattataactcaaggccactggctggaatggaattaattcttagcctccagccacccctggaggctgtgggagcttgggaaaacatgcctttatgtgatcctgatcccctgctacttagaatgtgcggtaccactatcttcaatttttttgtaggaacaagcaacaaaatgaataacccttcaaagtgggaaaacagccaggagagaagggaacagagccccagtgagagacacagttatgcctcggtcattgtgctctgtagactgagaatcaccactttgtagctgtgtgaccttagaaagcaacatcatttcttggagcctcagtttccttttttgtagaaggatacaatttctatttgattgagttattgtgaaaattagagataatacgtataaagggtcaactgattagcaatgagtcttctatttgtggaagcaattgtgatcattgttgtatgtgtcaacttttattacttatttcaatccctgtcttctgaaatatcttcgtaaggtaactaggtactgtatataacccttcctctggagagaaatgtcaggagattttgcccagtagttactggattggggtattttgaccaacacttgtaatcaactgacaagtatttcttagtcccctaccaaatttaggatgtgtaccatgttaggaatactatattttttcccaggagacctgcacatattgggtgttcacaccttggttcctactgagagtcaaaaattggggttttgggatttgaagcagcttgaaaactcatttgtcagagctcattagagtcagtattgatcagtgactctcagaaggcttggaatgcccaatcagagttgcaatgcatagcaaagaactcctgagtttcaggggatgtcattttgtaaggttctggtggaaagacactgggatcaaagggaacactgagggtctagaaataagttctccatttaaatgtcttattttaaataatggaaacacacttcaacatagtttccttcttggagttgaaaactcgatagtcctcatagaaaaggaaaaaagttaaacctcgtcttcaaataccaaactcaggtaaaataacactctgctgttcatagattgttgatcattataaagatgcaaaataaaattctaagagatgttggcctgatggatggatattgcaagcaaacctgaaaaaggagaaagttcttgattattctgtgtggctcacaggagtgaccagaatagaagtaccaagttaatcttgaggaaaataagtcctcagaagggaagagcacagatgtagccttggtcattctgggagctgtataatttcagtcttgattggtgtttctcaaccttggcactgttaatgttttgggtaaatcttttttttttttttttttttttgagacggagtctcgctctgtcgcccaggctggagtgcagtggcgcgatctcagctcactgcaagctccgcctcccgggttcacgccattctcctgtctcagcctcccgtgtagcgccaccacgcccggctaatttttgtatttttagtagagacggggtttcaccgttttagccgggatggtctcgatcgcctgacctcgtgatccgcccgcctcggcctcccaaagtgctggaattacaggcgtgagccaccgcgcccggccttgggtaaatcttgtgtcttacgctttataggatgcttagcagcatcgcggcccctacctcctagttgcaagtaggacccccagtgccccagatgtgacaagtaaaaatgtcttcagtcactaccaaatgtcccctgggcataatacagtcactcccggtggagaaccactggtctagaacttcaatttggacagcaaaatctggacttactttaggaccctgtcacacgcatggataaactacctgcaatgctttatggcaaaacttttaagaaggtcaggggacattgggttgccaagaagaaatagaatattaataagagcataattatacactttagttaataaaactaagccatcaggctaatcaggagataattgcagagtagtttaccaaacaattgtttttggctattcactcagcatgcatcttttgagctatgctccgttgtggtgttagtgcttcttgtttggttgaagggcaatgaaaccatgagctgataaagtatgcatttctaggtctaccccaaggatgtcttggaatgacaaggtgagcattcttgtgaatatttatttatttatttacttatttgtttatttatttttgagatggagtctagctccatcacccaggctggagtgcagtgacacaatcttggctcgctgcaacctccacctccggggtccaagctattttcctgcttcagcctctctagtagctgggattacaggcattcaccaccatgcccggctaatttttgtatttttagtagagacggggtttcaccatgttggccaggctggtctcaaactcttgacctcaagtgatccgcaccccctcggcctcccaaagtgctgggattacaggcgtgagccaccacaacctggcccatttttgtgaattctcatactatttaccatgactgccccaacccctttcttatcttgagcaccccatccctattcctctaactgtctgatcaaagaatgaatcaaatatctgaagaaatccagttttctttcaagaaacaatccagggattcattaaaacctgttgtggctattgtgggatcaccaagctttctgggctgacatcttaatgaagggaagagtagtggttcttggaggccagagctaactgcaggggctcctcggtcatccaaggtgcagtgtcctgaatgttcctaggccagcagagatgacaggagtcattctgatgacttcaatgtttgcattttagatactgtcagaggtgggatgtgggggtgctctcctggagggacgaatatgtgctgggtactggaaaaagaagaatctgtttgccatgagaattgagcgattgctttaaggacagccatccctttagggaaagtcatctatagcagacaaaggcagagttatttttatattacatgcttgtaaagccagatttgaaattatttcctctggtggtttttctttgaatagctggggggtgtcctaccactgttaggcccatattccgctgagaattaagaaggctgtctttctagttctgagcacggagactgggttatgatgaaggctggttacagagtaaagtgaaaacccttccatgtggttgtgtgtgggaaaaggatggcataagtgggtggcacaaaaggagcgggggtgggggagaacccattgtacctttgcaatatggagtttgtattctgtttctgccgaccttccttgtgagaaggtttgggtatggaaggaaaacgctggcctgggaatctgagtaatgatggagggaagttctgtgcaggtgattctgggtttatggaaggtcagaggattctcttacttttcccaatattatgaggtgaagctccgcttaagggcgtgcagttcgtgtatctttccagtccagcagactgataatgtctgcaggttgggagcgccatgactgatagtagctgtgcccggtgtctcaagcatcttggaagtgctgttcattcatcaggggctaggagatcctgaaggggagggagtctgcatggttctggagacaggtagacatttttctgtttcttgtagagtttatcttctccacggatccctgtagaggacaggcttgctgacattcacaggatagtagtcccaagcctgtggcaaaaggtatttttgggtatgtctggaaagcaaggcaacttggtggttaggattgtaggctctgggctcaggggcttgggtttacatcctggacccacccctggcttgccgtgtaactttgtgtcaatttcttaaccctttaagcctcagtttactcgtcaatacaatggaaattataaatggtccctctcccttggggttttggcagggttaaataagatcgcatgtgacaagtctggccagtgtgtattgcacgagtactgggtgcattcagctgttatggtgtcagtggcatgaggtacagaaaggaatgactggattcccaatccctgttttctatttagggatttatttatccagtccccttccctctgcaaaaataggacatgctttcatgcattttttttctttcccatcatgtccaacacttacagcctgacctttctcttccttctgggttgggacgaatcggttccctgatgttaaccccgcagcatggcttctgggttaccaactcctgttttgccaatgtggaaacagccactgtctgggtgcccagtcccccagctctcgtgtgagccctggcaaccctggctgcctgcctgcatgaccgtgtgctccaggcacgtggctgtgccctgtggagcttgcccaacgctgtgtggtgtgctggcttgcttttttttttttttttccctcctccccctcgcttcccttcccaggagaatgacagcaagtgccagcaagcaattgtaatcctgaccctggcatgagaaagctgagctctggagggcagttcagatgccagggaaacctgttctgtccaacattctagccagaccccaaacctggccctctctcctgcctgtctgcccagaggccctgtcttctctgcactgctgcggtgggcaggattcctggaggccagctcctgccaagggtcttggcagagtctttccagttcagcactgtgcctaccagactagaaaaatagcaatataaagacagaattaggtggaggagaaggaaagggggtgggggaggtgggaagaaaaaaacccttgataacatcctaatgtagaaagccagaggaggggaagacagccgtgatttattaggtttctcagaaacctctcttccaattagcactaatcacttttacccaggaatcattttttatgtctcagcaatgaaaatggaggtaagagggaaggtagtagagaaagtaataagatgaaaaaaagtagaaaataacatattagagaggtacagggcctgtgtttgattctgtaatgggtgtgggtgagaatattggtcacagctaatattgattatagtatttggccctcccccagcaaatgtcttgtcctaaagctactaaaccactgtttttctataaatttaaatttccctcagacttaggtgcctctgtctcaccatgcacaatgtctgtcagaatgtcctgtgtttgagacaccagtctatacgggcaatatagcagtaatgttttttagagcacagaattgaataaacaaaacagcctgagtgtgaatcctgactttgccactcattagctgctcacgatctcaggcaagtcatttaaatgctctgagctttcagtttctcatccggaactttggaataatcattggacctgcctcataggactgttgaaggtcatatgagccaatgcatgcagagtaattgtcacagtgcctcgcacacagcaagtgcttaataacagctgctgcaagcagcaccttcaccaccatctaatctcatttcccatgggaggaccaagcgtggggctcagaaagagtcttgatacttttcccttcctagctaattaagaacactggtcaagaaatttggatttctctcctgcttctctgccaagtcttgcttgcccttctcttagcctttgaattttaggtgaccttgagtagctaactgtaccctttactcattcttcctggctcatgggattaaataaacaaaatgcattttgaagaagtttttttgtttgtttgttttttgagacagggtcatgctctgtggcccaggctagagagcagtggcgcgatcatggttcaccacaacctcaacctcccaggctcaatagatcctcccacctcagcctcccaagtagctgggactacaggcatgcaccaccacacctggctaatttttgtattttctatagatacagggttttgttatgtttcccaggctggtcttgagctcctgagctcaagcaatccaccgaccttggcctcccaaagtgctgggattacaggtggaaaccactgtgccctgcccaaagaagttcttgattagatttcttccatgtcatatttgctaatagatcagtcagttactgctaccattgaatttttaacaatagacattaataattatatttaaaggcaatatagtgaccttgggggtaaggaaaccataaaggtatgttatggtgtttcagaaggagaaggttcagtttatcctccggcttgcaagcaagactttacataagcattccagaataataattcctcctctccccaaggggttctttaatgagtaaatccttaatctttctgaaccttgattgtctcttctgcaaagcaacatccttgttgggtttttgtgagctttctaaagctactgtgcaagaaagatccagcttggtgccctgtacatagtagccaagcctttaccataagtcagttcagttacttttctctaagaaatgataccatgattagaaaacaacagaggactttgggaggctgatgtgggaggattacttgaaaccaggagtttgagagcagcctgggcaacatagcaagacccatctctacaaaatatttttttaaaaatattagctggatatggtggcacgtgcctgtagtcttggctacttgggaggctgaggcaagaggatcgcctgagcccaggagttcgaggctgcagtgagccttgattgcatcattacactccagcctgggtaacagagtgcaaccctgtatctaaaattaaaaattaaagagaaagcaacagaggaggttttaggaggcgaagagcaaggtgtatggtcccagaaatagcatctgtttttgctctgtgctttggtgttttgatttgtgcaccctgaggaagagagacaagagtacaatttggctgctagtttcaagagacagtgatttagtagggaagataagacttttaggcaaagtgatgagtgacaggacaaactagcatgttctcagtgtcaaatgacgggtatatagaggcctccaatatctgctgaaaagaggaggttgaaagattaatcaagaaaatgaatataaataagggagcagtatagccaataagagctgccagacctcacaggaagaagcctttgctcaaggcaaaggtgcctggggcgaggcttcttggaagagttgtagcctgtgatgggcccggaaggaggggtgagagagccagattggagaggttaatgccccacaaagttatagaggcaggaatgcccacagggtgttttaggcaacagggtgtagatccaatttggctggtgcagaaaattcatatgaaggagtcagggagatgagtcagagaggttggtgccagtcaggctgacaacttcatgagtaccaggctgcagagcttgaactttatccagtaggcaatagggagccattgaaggtttttcagcaggaaagtgcatgtgaacatttccacttgagttcaaggttggatttgaaacatttttagaaacttgacaatagtttcctctggcaagccaggatttccttatttttattattttgaaaataaatactctcccttgaacatcaaacagcttttcaaaacacgatgttctaatgatctagagaaagtaattcaaaaacacagggtttaggtttcatttataaaacccataattttggtgattgggggaaacactctttggcaaggaaatagtttgagggatttgactggttcagaatttaaaagtccaaaagcaggcctggtctcataggagtagaaaaatagattttaataaacccaactcattaacgttcatcacttttaaatgcctctattttatacagcttactaggtttgcaaataagtatattgaaccagatgttatgtgtatgtgtgtgtgtgtgtgtgtgtgtgtgtgtgtgtgcgcgcgcatgtgtacgtgggcatgcgtgcatttgggtttgtgggtgggggtgggaaggttaatgtctcagtgatacaaatagtacctgattgtaaggattacctggggcagtaatatcaagctaaaaatacttagccaagtttctggctagcttaaatcagttttactcctgggaaacaaaggagtcattattacagttttgcattcttgagtcctgaccttgtatttgtggctcccttcttccctgaaaacagaactgtacatcatgcttagatatgggatgtgtgtgtgtgtgtttcatattgggagtactagtaaaggaaagggacattgtgggaggggatcggattggggggggttggactgctgaatgtcaagtgcatgaaatgacttgctcaagcaccccctgaagtgtgctctgatatcaagccaagatttcagaaggctgaaagagttgccataacccaatctagttcacttaaatagaaaatagctgtcaaggtgggcaatttcacctccagctacatagagtagacaattacaggagtgttggcagaatcgagtgtctgctgggggagaaactatagtatttgtttctgttaaattggcttgtggtgggtacagactccatgaccgaatgtggaaattcctaaaatgttggttttccttcttttctgacttttacaaactaatgttactctcttaactcactacccatccaatctcattttctttcctgaaaaactacacagctcccctgtcacacagggttcgtaaaagtttcgtttttagaagtttaatctgggatttgtttccttaatgatctttggaagaatgctttggaatttgaggtcttataatgagacatggcttgtggctattaaaccctgttgcctctcaaattttgcctgggagaccctagattcctaaaaacaatgagtgcatgctacagaaagatgcttcagggagctacaacactaaatcatctgtgacaaaatgttctcttagaaagtggaattgcataaatggatcagcagaaataaatgctttggcagaaattccttgagtggggaagagcaatgctttcttttctaattagctctgggtaacagtctgctgtggtgtctttgctgtggaacccaggcatggacagtagagcaggaaagtctcatcactgctctctaagtgcttctgcacttaatggaaagagttaagcacgcctgtccatttgtacccaataaatgcctcttgaattgatttgagtggcgaaggtttgtttgggggaaggatgccaccaggccctgaccaatgggaatcaatgcagcaaaccagatgaacaagatcatctagatatgcagtaatcagattacccagaacagaaatctcaataccccaagatatgaggggttattttaaggatagtggcaaacagttaaactcagcctgccctgaggattgagcagaagactgaattcaccttagtcattatgatgtgggctgagttagtaacactgaaggagaccatgcaggcttttactagagaactatgaaaacaggacagagatctcagatccaattagtactggatcaaaatagtattgtttttaaaaggccaaaggccattgaaagatttatagaggaaagagtaagtaatataaaatgtaaagatggaaataaagccttgaaagagttcctgaagacaagaagagagaaatttgcagaactgaccttgtaagaatttcataaaattcatttcattatgattgatttctttgtattagtacaccttcctggggaagtgagtatcttttttcctcataaaatctaaagcatgtttatttcaaatgggcagtgacaactaaatgatttaaaaataatatttatattcatgtcaaaaaagttatttttaacattataagtgaaatttacccaaacatagtaggccagataatgatatttagttattggcttcctggaagactgatgacaggaagattcagtattacacaaactaggtataaagaagcaatttaggtctacttattttatttctcctttgaacctctcacttgcctgacagtagcattgcattgattgagattttatgatcattttatcttgaattggttaaactaaaatttatatctttgtcttctttataaagaaagatattactagctgggcacagtggctcacacctgtaatcccagtgctttgggtggccaaggtgggaagatcacttgaggccaagagttcaagaccaacctgggtaaccgagtgagaccccatctctacattatatatatatatttttaatttaaaaagaaaaaatattaccaaacagattaattatgcaaacataattttgggacacagagttaacttgaggacaaaatagtttttaaagattttaactgtgtatatataaattaatatcctgaaccacaagtgcgtattagtgaatagcaaaagaatttttttcattctgacatttcagtaattcagattagcattcccaccaaattgttgccagttatctccatctgtccccttctccattcccccccaccactcaattttcatatctttaaaattaaattttcatataagtatatggaaccaaaatattattttcattcatttacctgccaccagagaggatgtcatcggccaacccgcaaaggtggtgggatctaccagccatataactcttctgcatttgttccctccattgtaagtgagggtgctgatacctgcttcagaggattcctggagaagtaaatgagatgatacatgtacagcacttagaacagtgctcagtatataaatggcagctttcagcagttttatttttattctacaattactattccttctcttcttccacctccatggctattttatggacacttaagtaggaacacatcttgtgttacagcaatgctatagcagtgatggcctggaaactgcttttgagttattgcagggaagaaaggatcaggaagagatacagcaggtgagcaccctgtgtttttacacctgtgagaagatacatcccacctcaaacaccatttgtggtcctatcaccctagcatgtcacagtgtaattgcctgctttcttggatagctctttgaatagatgtatgctctgtgagccctggctgtgtcttccatctccatatgccctgctgtgcctgcatatgtcttctggtgctatgcctggaagatcttgagtgggtaagggtgaaagggaatttagaatacatttcctttggtgctctagagcctttccaacatactgccagatttgtgttttaggtttcttctttttacccttggtgacacttctgggccataaagtagtgaactggctgtcctctagttgttgttgatgggctcttgagtgatgtggaggcaggataatgggttttcaatggtcacaaaactccctggccttctgctctccttagtgtgagtctctcaaatacataattcttaactctcctttctctgtaccagagggaaacgtggcagagaggggtccagataggaaagaatggactcttctgctgaagtgaaatggaaatacaaggaaattgtaaaaacaaaaatagattatttggaagaaatgtctaaaaacggtttttacacaaaggggacaactagaagttgatcgatttaagaattgagattaacctggtatgactttggtttccagctagattacagctgtggggttcttggcccttggcatgggtcacgcttgatacagtatgttgtgcactgtacatgtggatgtggcagggtaaggcttttaaaggtacagcagtcttgagggattacaaagtacatcagcatgaaactaggcaagattttagcctcttgtgagggatgttgaatttcagctaaagctccctcagcatatttttgtatcccatcaaatatctctgagtcgcggccaggcgcagtggctcatgcctgtaatcccagcattttgggaggctgaggagggtggatcacttgaggtcaggagctcgagaccagcctgaccaacatggtgaaaccccgtctctacgaaaaatacaaaattagccaggcgtggtagcaggtccctgtaatcccagatactcaggaggctgaggcaggagaatcgcttaaacccgggaggcggagattgcagtgagccaagatcgtgccattgcgctccagcctgggcaacaagagcaaaactccatctcaaacaaaacaaacaaaacaaaaaatatctctgagtctgtctccccttttataaaagagtgaacacaatgctcctaagtttaaatcagataaattcagtatgaaatcatagcaatagccattatgtgttaaaaccagcattgtcctaaacactgactgtaagtagttgtagcaaatcaactcatattagaaatgatattggtccctggaatttagtctgttcccaagaggactgaatgttgtgaatacattgccaaagtatgttttctttttttctccatcagcccttccattctgactacaggcagcttaaaaataaatttgggcatatctcagtggccaaaaaccatggagatcaggatgaaatcattttcaaggcagaaataacaggcgttgataaagatattcagagaaacacagtcctaatagcatcggcacgtgattgtggggccctttagtcaccaagctaaattgaatttggaatcaggggtctactgaaaagccaggaaacttttgagcaagtcacttgaattctgagcccccatttcctcatccagaacatgatggcctattttgcaggattgtcatgcaagttaaattacattaaacaagctatcagtaaaaaggatgtgggactgtgcctactcggattgtcacccagtgagttttaattcggagtccgaatctggtatttaaaggccacgttctaaaatgcacttgtagttaatatctttggagtcttgcttccaggtttttgagttgctggactgggtctttgtaagctccgtgatgctgctttgggaacacaagagatctaatctgtagtcctggctatgctattaattgcaagtataaccttaggtgttcagcttctctggcttttacttcttcatctgtaaaatgggaataatctacgtccttctaacttacaagtatgtcataatagaaaactgaccaaacagtttacatcaatgtccattattatttccattggcttttaggcggcaagagatggaaaacacgtagcaacaatttcaaaggtaggccagttccaaagagcactgaacttggagtcagccaatctaggttctaaagccagtttgtcagcattagatgtctctggacaggacaggtcaccaaatctctcaaagcctaatttttcttgtctataaaatgtaggtgctgtttctagctctacgactctgtgttcaaagactactatgtgctggaagacgactaacattcacattttggtgaatgtctaaaaaaatttaaagcctcttgggggtaatggagctgctcccaagccaagtagtagatggattaagaatctgacattcttccactcataaaggatgacagagtttaaaaactaacgctgaaaagcaaaaaacatttgacaccttttggaataaaaaaatcaacaataatcaagctagttacttccttaaaaaatggtcttcatgccgaatggaaaccaccagattctctctggtgttcagcattccagaacaaccctgaaaataaattatctggctggaatcattgctccaacggttggatttcttagtggtcgtttactagccagacaaaataatttttttataaagaaaagaaaaaaaaaaggaaagcccacagaaggaaacaccccagggcccactgctggctcttttgatggcaacttttctaggaggacagtggccagagggggcctttggctgctcctctaggtggctggagtcaggtttgtaggacctgcctgtgatagtaggtttcatcttgcaactggctctgatggattagtaggtgcctgagaagtcattttgaaagggtctgaggctcggtctgggctcagtgaagagttctgtgattaattagtgatgtctgcccttggcttgggtggggcagtactggtgcctggtgtttgctgtcctgccagagcaggtttggaagatcctttagtagttgtccttctactgggcagcagatcaaggactcaggccggtgttgcttccgatgtcctggaaaagtgttttctgagcctccagcacataatgttttactctctgaaggaggcttattctgattagcttaacagagggtatggaagaaaggaagtctattgattcagctccttggtcacgagacaggaattgcaaggtggagggaagctgtaattccaacacgtaagtccatggatactccagtaaagcacaggcataggtgccactgatccagcagaggcagccacaaaccacaggccctggtaagctgcctgtggccagaggtcatggctgcagattccagggaaactgcgtcctcggtaggcagtcagccgtacactccatacttgcgattcttgatatttgaaatcaaaatcaaagtgcagccactttctttaaggaagctttggagaacttgccagtctgtttaggattgaaggtgattctcagttatccatgctaaaggaacagataatctgaagtttatttctcctcagctgtggaacgtgctttgcgtttttgtgctgttgatctgctttcctggtaaggtttgaactcttcagatttttctttctataaagaacggttgagggggagtgtagtgctttttgcagctcccccagtatgtttctaacatagccagccaaatgtctctgagcccttccagcctcctaactttaaatccatgaactgcaccagggaaataatcaaccagttgcaatttgttgagcacttactgtgtgctccctgggatccaggtaactgtgtgacaaggacttgatccaagagtgtgttgggcaatagggtgaagtgggctccaggttaaacattggctatagggatttacaaaagagttcactgagagtgggcctgacttcctctgctactgctgtttcctgttgtttccagtaactgcacttgagctctgcatacggttaactttcaattatcctgaggctgattaactggtttgcagattaaccaaggtgaaggctcacctgggcctgggagtcgctcatcaactcagctgctccataattagctggtgatggctgattgcctgccccatggttgggaagcctgggcactgggcgactgcaggggagggggaccaagggatgacttcttccaggaccttctactctctccaaccagaggtgccctctagccctgtaaacttctgcattctccagcacagttcctgagaggttcagaagttacctgggtcctggtgctctgctcctgctacctttcagctcctgcccccaacaccctgttcaaattgggaacaagttgaccacagggcacagtgaatttgaaagtccggagattaagtcatatgttgaaagagggcccagtgagcaggggccactaatcccctttcttcctcaacctaggaacctcctcccttcccaagatatagatatatatagattgagaccctgagcaatggatctcttttgaggccagtggagaccaagaccactgaagcaaggagtcagggactgcccacaacagcaaagctccccagagtccaggccaccccatggtgattgtttgggttccctgtgattgcctcccatggctgccctcgttcatagagagttgactgcatttgcctgggtccctgtggggtgagagtatggaagtatgtgtattagtcacaccttacaccagaccagaagatatacagtttaacctaggagtcaagctcctgctatatttggaatggtctcagttttgagacgtggtaccttggatcccaggtatatccaaagtcttgagagtgtccattgaggactttggtctgtagccaccaagaaagagtaaacatttgtgcaggatcatgtttgatgggattccatggattgttttcatttcttaagcagcattcccctgagcctttgacatgtctttccatctctggctgtgttctcacttgcatttgccaggcctgcaatgcctctgccttgatacaacacagtgtgccagcagctgcagtcccttttcagccagggccatgggtttccttgggtccttctctctggctcacgttttccagggctgttggtgtgtacagtctagagatcacattttattaacacaaagaaatctgcttgggctgcctggctcttgcagtcacgtggagagaaatgtgttcctttggtccttcagcctgcagcactctgtgcaaaatacagcagagagctgggcactgggccaagcttacatttcacttcggaacacactttcgcatcactccttggcagaacatccacggtggtgtctatttggggagtaagttagagaagtgttgtttgcctcttatgagtgtcgagagataggacctttagaaaatgttttacttttgcgcctgtcttcatcttcttcgcggtgcccaggtactgaggtgatccagctaaatgtggcagtgatgcctgagagaagccccttccttcctcgggccacccttttctcttgcaaaatcagtaaacagagccaggactgcctgggacagggaaacttaggccaaggtaataacatcaaaaccaaagtcctggaactcttgagtaagctagttaccctcccagataaaacaactttgttgtccaaatcttctttccaaagatctaagacctttctaatgttggtccaaggccagccatggaaggaaggaacttcagcaagccgcctggaatggcaaacactgttaaaataaacaaatggacctttgccatttggttttccctgacttgtctatttttatttcttttctccccccacccttgtactttacctctcgatagtacccccctttctccacccctactcccattctcatctcacttttctcaggggccaagctggctgttttgccttcagtaaaacaaatatctaatttcaaaaagaggaattaggagaaagaggtggtataattcatttcttggggtaatctcgcttccctcagctcctctattgtctgttcttgtaggtggccacctgaagcttgacttgcttttgaaaataaagttggttttggaattttaaaccttccttaggaaagacttgaatggttagaaaacaaagatttattggaataataatgacgtttcttttctcaatgaaatagacccctctcataacaaacggttgaaaataaactctttttccccatcacaccaagccataaattccataaggatttcccagcgccaagccttattcagagtcttatatttactgctttggaatgttacttttgccatcagtatcatccagccaagcaacaaccaatcaagacttacagaaacttttccagctagatgcatgtgccaggctgcttcttccttccatgatggaaggcctcccttgtcatagaggatgcccaaaatctcagggactgggatacagcctcctgccagtctgtgggtacagtctttgcttactctgcagaagggaggtgacagaaacccattccacctgtctcagaaacctgctggtaattaactttaaaaataatgccaagttctcacgtggctggtagatgcattagctcaatcaggggggaggcaggggagaagcatgctgcttcaaagagtaatactgttgcaatcacattagtcattccaggggaggttagataaggttattgaaaaggtgaagtcaccctgtacattgaaagaggtcttctgaaagtgttgagaaatagttgaagttcagaagttttatttggagctttgctcccccttccccttgtaaataagaccagtattttttaaaagccacattttctttgtttgatcgatgaacactctcatagttgatgattgagagtcatctacagccagtatcaagggtcagttctgcattactcatgtgtagattatctctttggtatactagccatggtcactgtgtaagccctggccagttgccacccagcataacaacaccataaggcatctaccccctgcctgcacttgggaagtgttcagggaatgtaatttcattttataattaagtgaaacaatgcacagtgcatttccttggtggattctaacagcaggacagttattattcagaaaggactgtgtctggactactttgagaatcagtagtttaagttgttgcacctgtgtttggcctatcctcataccagtgtaaatacttcaatcctgcaagattttctcattttgcataaaacaggtgaaggtttgttgaagtccatcttccaaactcccaaagtactctggataccttggtaggtccttgtggactccctgttgttgacttgcaagtttcccagaggtggggactggcttttatctccagcacctaggcagctgctttgtaccagagttgatatacaggaaacatttgttgagtgaatgaagtaacaaagatactaatttcattagaaatggtttgaaatgagtgcttgtgttggcagaattttgtccaacatggttggtctttgcaaagggttatgatagtatgatgcacgcctttgggccagatgtgagtcaggatggtcttggaggaggcgaagtgcagatatacccctgctgataggctcctcataatacttcagtgagctgtttttctcgtgactgtttcactattttctttttttcttttttctttttcttttgagatggagtcttactctttcacccaggctggagtgcagtggcgcaatctcagctcatggtaacctctgcctcctgggcccaagtgattctcctgcctcagcctcccgagtagctgggattacaggcatgcaccaccatgcccagctaatttttgtatttttagtagagagggagtttcaccatggtggccagggtggtctctaactcctgacctcaagtgatccgccctccttggcttcccaaagtgctgggattgcaggtgtgagccaccacgcccggccagtttcactgttttctgattggtaaacattcaaggctggatgccatggctcacgcctataatcccggcactttgggaggccaaggcaggtggatcacttgagctcaggagtttgagaccagcctgggcaatgtaatgaaaccccatctctaccaaaaacagaaaaaaattagccaggtgtggtgtggtgtcccaactactagggaggctgaagtgggaggatcgcttgagcccaggaggcagaggttgcagtgagctgagattgcgccactgtactccagcctgggcaacagaaccacaccctgtctcaaaaaaaaaaaaagttaaattaaaaaaaatattcaagaatgaagagtgttttcagagaagaggatttagatgcttacaaataaaagtggatattgaccccccaattttccaccctttaatcacagagacatgattggaagtcagcagctccagcctgcatgttcccagatcacctgtaagagttcttaaaactcatcccacaggttcttaattgggatttttaactgggtaagtagagaagctccatgttgggtgtggggaagggaggatgcagatggatataaatttttttaaaaaaacatcaacttatgtttctttggttaatagatgcaggagaatgcctcttctctccatgtggcatgtcagggtatagcttctttgagcacaggatttggtttacagaatggcatgtctccccatgccagccagtgataaggggcactaaaacagacttggccttgctaaaggcttccaagcaccaggccatgagcagttgaccccaccacagaggtatgtacagctggcaggaagctgcccttctggttcactgactcaagagttggagcagattgatccctggatttgcagtgccctcaatatcgctgcacagaattcattctatgtaccccaggccctatgtgcccacagcaggaaatatagtgtgagcctctggcaatatccagagttgcttgagcctcctcacatttgcttctcctattcagtttagtgtgcctcagtttactaatatgctggggaaaataacacccctcttgccaaggtgagatagcagagttctctgcataaaatagtgcataaaattattcctatgacaaggcatttgaaaaattactttgagaatgacttaaaatacagaacaatttttttaaatgtggcaaacatccttattcttatcacccagaattaacaattcagtacagttgccatatattcatatataaatttacctatatattcatatgtgaatctagacattgcagattcacttgggggtctcagggaactttttataaaaagaaatgcatttagttcgtaaggcctgattgagataattccaagtctgttttctcagctcttaatccttcctagcactttgcattcattgtattaataaataagcctgttttcagcctagttagaaaaaaaaaggccagcctcattcattagaattctgcgttccctttggttattctttgttggagagaagggggctcactggtacagaattccaagatatttcgctttggaatgtgaaaggagtctctcttgacaacccaaggagaacctgcctcagaatgatctttcttcctcagtgctggaaaatgaaaaccagacaaataagcacaaccaacattaacagaaggccttggtacagcctcaagaattaaagtgctgtactctatggaaaacagtgtggaggttcctcagaaaactagaaatagatctaccatatgacccagcagtgccactgctgggtgtacagctgtacttcgttttatcggacttcaccatattacactttgccgatagtgtgtttattaaaaattgaaggtttgtggtaaccctgcattgcacaagccttttggcactatttttccaacagtatgtgttcacttggtgtctctgtcatattgtggtggttctagcaatatttcaagtttttcattattattatatgtgctatgttgatctatgatcagtgatctttgatgttactattgttattgtttgggggcaccatgagccacacccatataagatggtgaacttcataaatgttacgtatgttcttctgactgcttcaccaactggccgttctcccatttctctccctctccttgggattcctgttccctgagacacaacaatattgaaagtaggccaattaataaccctataatggcctctaagcactcaagtgaacagaagagtcgcaggtctctcactttaagtcaaaagctagaaatgagtaagcttaattttgaaggtaggtcgaaagccaagacaggccaaaagctaggcttcttgagccaaacagttagctgcattgtgaatgcaaaggaaaagttcttgaaggaaattcaaagcactactccagtgaacacacaaatgattagaaagtgaaacagccgtattgctgatatgaagaaagtttgagtgtcctggatagaagattaaaccatccacaacattcccttaagccaaagcctaatccagagccagggcctaactctcttcaattctgtgaaggctgagagaggtaaggaagctacagaagaaaggtttgagctagcagaggttggttcatgaggtttaaggaaagaagccatctctataacaaaaaggtgcaaggtgaagcaccaagaaatgatgtagacactgcagcaaattttccaaaagatctagctaagatcattgatgaaggtggctatactaaacaacagagtttcaatatagactacacagccttatattggaagaagacaccatgtaaaagttatagctggagataaatccatgcctggcatcgaaggacaggctgacttttgttagtgggcaatgtagtgggtgactttaagttgaagccagtgctcattcactgttccaaaaatcctagggtctttgagaattatactaaatctactcttcctgtgctctgtaaatggaacagcaaagcctggataacagcacatctgtttacagcatggtttgctgaatattttgagcccactgttaagacctactgctcaggaaaaaaaatcctttcaaaatattactgcttattggcagtgtacctgttatccaaaaactctgatggagatgtacaagaagattaatgttattttcatgcctgctaacacatttattcttcagcctatggatcaaggaataattttgactgtcaaatctcattacttaagaaatttactttttaagacaatagctgccattgatagtgattcctttgatagatctaggcaaagtaaatcaaaagccttctgaaaggattcaccactctagaagccgttaaaaacattcatgattcatgggaagggacattaattaactccaacataaactgaagttagtaggagttgattgcaacccttatagtggatgactttgaggacttcaaggtttcagtggaggaaataactttagatgtggcggaaatagcaagagatctagaattagaagtagaacttgaagatgtgactgaattgctgcaatctcatgataaaacttgaatggatgaggaattgtttcttgcagatgaacaaaggaagtgctttcctgagatggaatctactcctagtgatgatgctgtgaacattgttgaaatgccagcaaaggatttagaatattacataaacttagttggtatagcagtggcagggtttgagaggatcgactccaattttgaaagaggttctactgtgagtaaaatgctatcaaataacaccgcgtgctacagaaaaatgtttcctgaaaggaagagtcaattgatgcagcaaacttcattgtcgtgttattttaagaaactgccacaaccaccccaaccttcagcaaacaccaccctgatcgattagtagccaccaacattaaggcaagacccatcataagtaaaaatggcccactaaaggctcaggtgatctttaccattgtttagcaatatagtattcttaaggcatgtacattgtttttagtcataatggtattacacacttaatagattacagtatagcataaacataaattttatatgcactgggaaaccaaaaaaaaaatgatgtgacttgctttattggattcttagctttattgcagtggtctagaaccggtcctgcaatatctgtgaggtatgcctttatatccaaaggaatagaaatcagtctttcaaagagataccggcattccatgtttattgcagcactattcacagtagccaaggaatggaatcaacctaagtgtccatcagtgggtgaatggacaaagaaaatatggcatacatacacaatggaatactattccaccataaaaaagaatgaaattctatcacttgcagcaacatagatggaattggaggtcatttatgttaagtgaaataagccattcacaggaagacaaatattgtatgttcttattcaaattgggagctaaaaaggttgatctcatggaggtagacagtagaatgatggttaccagaggctgggaaggttagcgggggctgggatgtgggatttagagaggttagttaagaggtacaaaaacacagacgaaataagttcaagtgttcaatagctacagtagggtgactatagttaacaaggatttattgtatatttcagaatacatagaagatttgaaatggtcccttcacaaagaaatgatcaatgatcccagttactctgatttgatcattacacattatatgcatgtatcaaaatatcccatgtactatattaatatatacatttttttaattaagatttgaggtgctatatgtgcctgaggagttataggggatgccggtggaacgaccattacatgtggcagctggactgggcaacggccgatcgccactgtgctctgaggagagaaggcagagcttccccctttatctgctggctggtgaagtcctgagaaccgggcagtcagctaagcaccaagttttctctgactacagagctcctatcaaacggatgggtagaaaaggaatgttgtcataatagctaacccttctttagtgcttcttatagtctgggcactggactgaggtttatatgtgttatatcattaaaactcaatctctgggaacgactgttagtacttggtaggtatactattattattgtcgttttacagatgagaaaactgaggcccagagaaagtgagcaaaatggtgctgggggcgattaataggtggcagggctggaacatgaagccacagtctggcaccaaagcccattcatggagccccaactcaatgggctgcttctcagtagaaggctttgccttgtggaaggtagtagaatgtctaaaatcatcagaacacctgtgtggatggtacaacacggtgacagatatgtaccagggacctagatgtggagggagtgaggaggaaaggagcaacatatgcacctctggggaggccctaaggtctcctcagccaattcctagggaatttaattttaaaggacacagagagggtagtttttaacacaggttttacttttaagtcatgagggatgactttctaagccacagttccttctgataacggtcttaaaagagaagcaccatgaagtgataaacacatcagtccaggaagatttagagacagcctagtagaggaggattggaaacagtgtggctgtgtccctgagggtgctggtgctaaacccacggcacagtccatatcagtcaaagcttcattctccttgtgcccacactatgctgatctgccccagtgcaacagggagacgcatatggtcaagagaatgtgtctttcacgaatagattttctccttcgaccatggtgagaagtccttgtaaagaagcatacatgaatatatggatgtgttgggcatcagctgtgcgtgtggccctcagccaggtgagtggaggaagttggaggcattcagtgttcacctccatgtgcttttcagagacatacctggtgagctgtctgcagatacacagcgtagtgggagagatacgcacgtgaaagcagcacagggcatgtagctagcacttggtaaatattagtttccttcccctttctgtgtgtaaggcaagttgtacgagcaaagcatccgcagctcagaatgcaaaaatagatctccatgtggggatgtggcctcttttccccaagtgtggaccagatgtcaggccgccttgtgagtactcaaggaatgttacggcttccttcttcaggacttcactgcttctctccatatggagaaggctccctttccatgcacttcctggatctgaaaaacaagaacaagaaagaggatggctctaaagtctcaggaaatggacctttctatatcctcccttttaaaaagcatttgtatgtaggttttttaggtcttgctgtcaagtcggatacacagctgtcatctgttatatcggtgatttaataacataataaaaatttatagagaaccacaagctcatggatgtttgttttggagtgcatttattcatcattagtatgggtatttttaatcatttactgagggcctagcaaggtgctggtaattcagagataaggaagatgtcatcctttaaacttgagaagcttatgaatggcgaagagatataattaattgtgaatggagtgtggtagatagcatcaggttgtatatgaggtagaatcaggaaagcaagaatggccagctctgaatagagtgaggagggaagatgggagatgatccttgagttgtgtcttgaagaatgagcaaaaattatattcatggaaagaaaggatacaatataagtgacttgttgagtttttcttggctgatactaagaatgaattttcattaaatatgcaccagtaattcacaggaaatgatcaggtcagaatgttatgggacattggtctgaaatataatgagaggggaaaaaaacagaaaatttaaaacgtttatttatgatggctaatattcagaggggctaactccctcctgcccagataaggagaactttgccgcctggcaagggacctgcggctctgcactgccagggcaacagaaccacacgtctcaaacgtggtgtttaaagaagatgttggaaggttagaggcggtgtaatggatgggatttgacagttgctgtggcaacacacccacttccagaacattagtgttagtgggagggcaggcaaactcgtggtacttgccctgggctgccctatgtcccgtaccacctgttctatgccaaaggtatgaacaaattcaaaaggacaaatgcctcacatggctgatggctgcctgcctttgtagaactgaccctggaataagataagaagatgagtaaatcagagaaaagacaacagggaaatagcgtggaggaggagggggaggccagagcaagcagtgttaactcctttcaggtcaacatttcccagggttatattagaatgtattgactaactggtagatttttatggggaaaaaatgcatatggcatctgtgtgtctaaaatgcccttgatagaagcagtagtgtagaatgctttggggcataaatagtccttagagtagcaaaaagacaggttaatgcaaaattggttggacaggttttggttggaggcctgagtgattgcctccggagcaccaccttctggggagtcatgggtatgacatggtgtgaatattcctgaggtgtgggtggttggtttccttacaaggtagggtttgcaagctccttacatccacaggggctgtttcctctggaccagtcgttctcaatcttggcctcacatgagaattaccagtgatttttttaaaagaaatttaaacattttattacaaaattaatatacgattgttgtaaaataggactgtataaagagtaacttgagttcccatattccatttccagatttaactgtccacagtttctgcgtactcttccagacgttccctttgtgtttataagcatttatatacatatatatgggggtgggtgtgtatatattgtgtgtatggaaatatggaaatatatgtatatgcatacaatacatagtgttatgcatcttgcctttttcattcaatattttttggagatttttccatattaatacatatagatctgccggctgcatagaacctatgatctggatatgctataatttacttaacaatgcctctagggatttagattgttttcatcgttggattccattctttgtacacttgtgtggtatatctaaagttttcattcctagatgtggaattgctggatcaaagtgtgtaggctccaaaagaattgaactagttcacactcccactaaaagtgtgtgagaaagctgtttcctcttccattcaaaaaaatttttttttttttttacagagcccaggccccattttcagatcttctgggtgaggttggaggggagctaagtatctgtacttttacagagctccacaggtgaggctgatctgtaaccagggttgagaacttacatatgttcttatctatggccttagatagagggtgtaaaattaggagacgcagctcccactgatgatgcctgggtcatgtcctttcagatccaaattgcaagatctcctttaatgtggttaattgggagaaattgaatgacccatttcttctgaaatttctgttaaactggaggtctttatttagacaaatgtaaacattaatccatctttattaagataatgtatgattaaagcaacaaggtaccatctaggttctgtttgatacttttcttgttattctgtagttatttgttcataaaccattttttcttcttataggctttcaaggaagaattatctaattccttttggtgtggcctcagatttcattagcagtaggtagagtttgtagttattgaaagtctttctcttatttcagtttgaaatgttcccaggttggcacatagctttgggaactggaagtgtctcttttcccttgcttaggtagcctcaatagattgaaagaaaatggacatctcttcttcagaaaacctgttctaagaattatccatcttaggaaattagggtggttattgctcttctttactgcctgcctgaaaaaaatttcccagccctcatttctttcatcctttcctttgaggccatgacttgtcaccctctgctgtgttcctctgtcccctgagcagctgtaaggggtgagagtcacctaccctcaccccttacactcccaccaacctgaggaccacgtgtcttcatctaacagcatttctttttttttttttttttttttttttgagatggagtctcgctctgtcacccaaccaagctggagtgcaatggcgcgacctcagctcactgcaacctctgcctcccgggttcaagcagttctcctgtctcaacctcccaagtagttaagattacaggtgcccaccaccatgcccagctaatctttgtatttttagtagagacggagtttcgccatgttggttgggctggtctcgaactcctgacctcaggttatgtgcctgcctcggcctcccagagtgctgggattacaggtatgagccaccgcgcccagccagcatttctttcttttcctgtttgaagaaactgagtcctgtctactcccacccagcatttgcctggcatatcttcacagttggtctccttatcaaccaactgactcccatgattaggtcagattagatcccctgttcaggggatttatgtggggaactacacactgattgggacaggattttgtcaatgtactcaaatgacaaaggacttcagagatgttggaatattcttggtctacccaaaggttgcagaccacggtggcatttccttcttatataggtcctggtgggcatgggcttgagaagctgaaagaagacgcatggaactcagaatctgatcttttgatgatgacttcatatatatggtctgtttacccacgaggcacacaaaccttaccttatgcctgtgaaatataaaggcagatttttgtcccatgaaggtttctccatagactacattaagcaggagacagatgggtttagcttggctaatcttagtgcaagctggaaaatttcagtttttctgaaacaacatatttctaagaaattgtctggtctagaatgttattctagtgtatgttagggatctgtatgactgtaaagcaaggctgaattactgcaggcctataaatatgtgtgaaaatttacctacttctccctaccaacatggaggtggaaagaagtaggtttaataaaccccatttttattacgtgtgtaaatcagtggctgtttggccatttttctcctatgtaggacttgaatttatatgagaaaacttgagtgtatgccttttcccaagtcttggcttgcatctgaatgtaaaaatcagatgcatgctcaatgaatgttaattcagattatagatagctataaactatataggctgctctgtggtctttcctttccctctgcctgcatgactgaagaccaaactgtcacttccttataatctagttcttcccatgatacctcatcacaaaggtatatatcagttggtcaataacaggacttgtgcagtgaatacttacatgaagcagacactgaagtgcccagcaagaactgcaaaggctggcagtattaggagattgctcaccgtaccccaaatgagatgccagaggcataaagtccattttgtttaggtaccagatgactctgtggaattaacttgatttgtccccagtaatccatattctttagcatacacttccaggcaacacttattgcttagcaacacttacttagtaacctttcagaatgatcattaactaatagggagacagcctgtggtgccgatcgtaggctgttgaggctatctctacgggcattttcacctatcctgcctacttccgtaacctatgccccacaaaacatacactctccagacatgaaatttaaaaataatgaaagatgatgcaggaacttcagacactagatgcaatagacagcaaaaggaagcacctatgttagccttggttctcaacataccaagatgctcttatgaacacttctaacaaaatgttcccaaggagaacacaaagcaggcacctaacatccaagaagcatgtcatcacctcagcatgcctgccacacgtctagcgcactgcagccttcaactcctggtctcaagcgatcttcccaccttagcctcccaagtagctaggactacaagcacgtgccaccatgcctcgctaattttttgaaaaatattttttagagatgagttcttgctacgttgcccaggctggttttgaactcccagtcatattgttcctcatttgctttttttccttcttctttgttaagagacagggtcttgtcctgttgcctaggctggagtgcagtgccaccatctagctgactgcagccttgaactcctgggctcaagcgatcctcccacctcagtctcccaagtagctaggactacggacacatgccaccaccaggcccagctaatttttgaaaaatatgttttagagataagatcttgctacattgcccagactggtcttgaagtccaagcctcaggttatcctccctcctcagcctcccaaagtgctggaactacaggtgtgagtgcttggccttcctcatttgtttaacagatatagtaatgcagccacttgattaggaggcacagtgaccgctcttgagggatcaacagtgtaaccagggaaacatctctttggtcagtcccgtttcactagcctgttcaagaactggtttacctcctacctttctggcttttcctaagtaccttttacagagtcctcctcttcagctgtgcctaaactgtcagtgttccccaggactttttctttggttttcttgttctgtgtgctctcctggggagataatcagattataacatctgcatctccagtttacattgcccttctatagcctacattggtatatgaagctgagatccacatgctctaggcttcttcatctgggcatctgaaactcaatggatccacaatgagacattttattttcccttaaatgtgctcactccacaatattccctatttcagtgaatgtcaacacctcctttgcaggtgtccaggccagaaacctaaaagtgaatcttgctctctcctcctctttccccatgttcagttggcaacaattcatgttgcccccatctcattaataactcttgaatccacctagtcctctgctgttgatgtaggtgagctcttaccattcctggttcccctgtaagccaagctctgcctggttgccacaacaatctttctgaaacgagtcatctgatcaagtgagtcctttgctctaattgcatcgatagttccccgttctcttgaggatagaacctgaacatctaagacccttctgtgtctgtctcaatgcttaccactcttcttacccgccgtgagctccagttacaccagctactctcagttccccgactggcccatgaattctctcatatcttcatgccttcacatattttgttccctctgccttggttaccctttatcccatttacttttctggccaatttcaagacttggccaggatggcaactccctctgagggacatttcctgttgtccctgcactccctccaaagatagggatttgtgatcaacctttcaactccaacctgtgactccctgggcaaagcccttttatagcacatattattctgcaatctaataacctttttacttacctgtctgcacctccagactgcatgcttttaaagtttgggttttatttatatattctcagagcctggctcatagtaggggctcaataaaagtgtttaagcaaatgaatgtcttaatcaacaaagacatagtttatcattttctgtgtaaggcagtggcatggcctttgcctggaaagatttgcaatctcgttgattaaaaattatagagttacttaatctgataaaaaaattatcagtatagacattgtgagagaagttaggaggaattgtcgccaacattggtatagtcaggagtcggagggcttgaattagaccttgatatggatgttaggacaaatagaagtggcgaagacgcaaagcaagattgtctagaaacaaagcagaccattggcttaagcagagagcatgagataggaacaatatgcctccctgtggaggtctctccccagtagacaaagatttcagaccaggaggcaatgggaagccattggcttcctttgatcatggtggcgatactctaggaagagtaatctggtggctgtgttggcagatgggattgcaggtggcagagaccagttaggaagatcttgcagttgtccaagttcctcatgactgcacctgtcttgtgacagggatctgaaacacaaaggaaagcctccactgcactccaagaataatttattgctagatctggaaggagcctttgctatcatcccaaacatctcatcctattatttaacagtggtgggcaaactgaggactaatctcaaggttcccataactgatggggtctttggattccaatccttgtctcattttcccaacctgcctgggaagtgggtggttaaagtttaaagcctggaagaatgggggaaatagttcacaggcatgaggtgacctgcaggagaggctgatggtctataggagattggaggatgagtttggcttaaacatgttgatttagaaatgacagagggattggaggcaatgaccagcagtccacagatcagtttaggactctgtgaacgttagtggaagagattacagagaacactggctaggagccaaggcaagaaggctttggaaaggcatgtttgcctttgagtgcttaacttagagactcatgcgggaaagaatctgtggatctctttgagaagctgcagaacagcagatacacctgaatcctattcatgttcatccagaaacgcagactttaaaacaaccttgttattcttcctttgttttgtttcgtttggttttagggggttggaggggagggaagggtgtcaccgggggagcatatgggtcatttgtttgcagttcacaggggttcttagtgaacatcagcgaatattgtcgctgatttcgtctcctgcttcactctcttttctaaaaacaaaatatttaatgtagcccaaaggagaatagtcagtttaataactagccatggcagctctttgaaaactgcaggtttcaaataactaggcctgcacattttcaccaactcagacaattaaaaagactccagggacctaggtggtgctgattcaagtggcgcatattgtcatttaaaatggaaagtctatttctgaaaatagactccaggtatgggagaacttgtttctctgctggagaaggtagcccatcctagggggaccgaggtaaattgcttagtggctcaacatctacatagttaaaatgggcccatttggccctacctacttcgcagagttgttaggagggcagaatgaggctatagataggcagcatgtcattggactaggtccgccagatgcagaatgttgacaaaagcagaagtcccctcccctcagactcctctggggaaagctggcagccttgaccaccatcaccgctctgcacaccatagcagggatatgagaaggggctgaggtgagcattggactggaggctcctccagctgtctcttgttgcctgtcctctagtgtgtagagttgcagtgtggcttgaaatggtcatcacacccaccatcaccatggcagccctgggaggagggactggctgctactctctcaagaagggataactgttgcacaaaacactgcagactttgagctggccagcagttgaccagctgacctaacctcccgttttccaggtcttaacctaccatccattccctgcaagtacagaggaaactagaaagctacccttctcccaccatagttctgtaactttgggatggagtgagaagcatggcattgttaccaggtgatagggctcattgtccagtgcactagaagccagtattatggcactgggtctttaagaaaagaaaagcttttatttcatgtcagccaacaaggagacaggatccagctcaaatctgtctccctgtgcttgctggctttcaggcagcatttgtattagaaaaggtttaaggggtggattttgggattagcaggtgattggtggcaggaagggtgaggtctggaaagtccttgggcatgcacggttatctctctctgcatcctcatggatggtttgtgcaaattcagcgaggggggtgaatgtgaaacgtgtggcggaagttctggctgtgacgtcagtaagctcgttctgcacagactccagttggccatattggtcccaaacaattttagccagccttatctttccagtagagggagttttagtgtttccacaagcttttatttaattttttttttcttatctgccatcctgtaagctcaagaatttctgttagtcactggtttaagtctttggggcatggtttcaatatgagtgtgggaaaggggaagccattgcctcttgtttcccattcgtgaccatccctacccacttcagtgggcccagtgttgccagacctgaaatatacctcatgtgggtgtttgtctctggtactctgggttcatttctggtcaccctatgatatttccttgccctaaggtactggcacagctatcgggtaggaggaggccaaggtagaaggcacagagccattcttgcctcaccttctgccacacggtgaccccacatgtctggggagaggctcccggcccagggaggaggaggtggaaggtgcactgtcataaccatcacagggggcaatggcgagaaggctcatgggccacgtgcctcggccattagttgtcatgtctgttgtaccccaacttaactgacttctaaccggctgtggttatgagttccgctggtctcacctttcagtgggttcaagggggcagattttgctgacaccataggcaaggaagcatgatggtaaacaccactggaatgagaggccttgttaatccagcccaagctcctgccaagttagaagctgaggagtctagtctgggccactttgagtactgatgcatgatcccagggcgatgtgctgttctgggcacagggtcacactgggtgacatctaacaggctttgcttgggctgtagctagagggaaatgggagctggggagtgtgacaggagggaagtgtggactctccacctaccaaggggccttcccacatactgtccatcccattcagcgccctgaggtgggcgtcatttctcccacttgacagataagggaatcagaccatgaggcagagtaactggccccaggccacacacaactacgtagtgtcagagtcatgatgaatcctgtttgtctacaccttctgatgaactgagctacctcgtgcaggacaggcccaaggaaaggggctcaggccagagtgggagcattgaaacagggttcaaaatgtctgtctgcccaaaccaaacgttaatttgcatactaatagtttaagggcatagatataatacagacctcccccaagaagtgacctttgaagccaacttcttcttcatgtgacggaatacatcagacaccctgtctgccgggaatccttacccttctcctagtgagccgtggtctctggcctatccagaagctccttaaaaatactagtgcatgagatgtagcattgacaggagccctggcctgtgggtcaacagttgctttgtcaaatgcaatcttgcccttggcacagctcgccattcaggaggatggaggaagtggacgagagagagggaggtaaaagaagggagggaaaggaagcaggatgcctggctgcctggagcttccttgggctcttgtccatgagaggaagccatacctacctctctggggtttgccaactcttgtccaggaacctattgggctagagtggaggggaactgcagagtctccccttcctttctcttctgcccccatgaggaggaagtgaagtggagcagaaagagcgtgggctatggttgagcccactggagtctgcactccacccagcctccccctggctttctagctgtatgactttaagcaggtggtttcaccccctctccctctccactttttcctctttaaaatgtgggatacagtgcccgcctcgcagaggctgatggttctgtggagtgttgtgcacaaggctccagcccaggtcctgatgcaggactctcattctggaaggctgggtgcctggctctccttggggcacaattaggcttcctggctgcattcctggggcattcgcatgaaaaagaacatgggctttagagtgagaaggatggggagatgagtctctgtttttccatctgcgtgggcaaattatttagcatatctgagcttgtcttaagctttctgttttctattcctttatttccacatatggaaaatgggtatatgaactattctgccttcatatagctattgtgacaattaaatgaagtaatctctgaagaaccttactatcagtattactgatattaccagagaggtggctcatgtttgtaatcccagcattttgggaggccaaggtgggagcattgtttgagcccaggagttcaaggtttcagtgaactatgatcacgccactacactgcagcctggagacagagcaagatcctgtttaaaaaaaaaattgctgatattgattattcagtaggccagggaagcccgtctaccagcctacaggacgtcattgcattcaccttctcagtaaatggcaacagactcttttcctaatgtttacacgtaatggattgaactggcttagcatcatgctttacccatatttctgttgacagcctgttactgtgtggagagaattgctggataagagccactgagatcaaagggatctttacaatgggcctttcagtatatttgttctgtaatcatggactgaaaacttactgagcacttgccatctgaatgaggcaaaaaggaagtgtgtgtgtgtgtgtgtgtgtgtgtgtgtgtgtgtgtatgcatgtgtatgtgtatgcatgatttgtttttgccttaaaattagtacatcaaccgtgtaatgtgcaggacatttaaaatatgtcagagctatgacaggttcccagctactgggatccaggacaccttccaatttcatctttggctaagactttctatctcttttttcttcttctttctttctccccctcccttttgatgcctttctttccttccataatacctttctttattctttctttatttcttctttgattcattcttgtatttcttcttggtttcttaattcctctttctttctcttcctttcctccctgctgcccaatacacttctgacctcagggcatagatgcattgaagggcatctgctgctgtggccttttggatgggaaccctgtagatctcagctaggttggtttatcagctataatgtattccttgatttggtaaaacagccagcagcagagcaacatgcttttacctcctctttttttttttcctcatcccatttcctccctctctttggtttcttcttcctttcaagggggttgaatggtctcctctcagcggccttttttttttttttttttttttttgagacggagtctggttctgtcacccaggctggagtgcagtggcgcaatcttggctcactgtagcctccacctcacaggttcaggtgattctcctgcctcagcctcccaagtagctggaattacaagcgtgcgccaccatgcccagctaattatttattattattattattattttttaatagagacagggattcaccgtgttacccagggtggtctcgaactcctggcctcaagtgatctgcctgccttggcctcccaaagtgctggcattacaagcatgagccaccatgcccagccttctctcagtagcatttaacacagactcctggaacatacatgcacaaagtgaaaaaaataacatttttaatttctgattttgaaagtgaagatcctcattatagacaatttgcaaaatattgaaaataagaattaaaatttgcccctgttcctcccaaaagtccctgttaggatctggggggtgttatgtccagctgctcagtagctcgtgctgtcccctccatgcaggttccatctagaatctggggcagcagcaggtaaggccaggtcactgttctgtggggcttacatgggagtggagggaagagatcagcaatatcaaacaaataaaaaagatcgtttgggatggagataaatattgtaaaaaaaaaaaaaaaacatcaaacagagttgtttgatgggtattgagcaggggtagaggaaagtcagagggttcgaggaattggcatttatgctaatgtctacataacgtaggaggactaggtaggcagagagcagaggaagaatgctttaggtagagaggaaactaaatacaaaggcctgggtgggatcacattcaggggacgcaaggagcagaaggaaggccagtgtggccaagtgtgtgagtgaggtagagccgtggatctgatcatatgtggcaatgggaagccttgggagggtttgatatggagatgtgacccacacgggtctgcatgtttagaattatcacagtgtaccgctgtggagacgtgggagatagaaaagggataatggttaaaagttgcagtagttcagaggacagacagtgctggcttagacaaggggaatagtctgtttatttgatttactttcaagtatctctgaactattatctgtattttgtatatgtgtttatatagagaccatttattgcacactttccgggtactacagattgtgctaagcactttgtatgtattatctagttcatttttcacatagaatcaggcatagtaatctccttttacacataagggaattgaaactcaggtaggttaagaaaagaagggggaaaaagtcaacgatagtccctttccccaatacagaccttattaggatttagaggggcattttttgggggtcatttatttacaaaggcccaagtttataacatacaggtgacagaatcagcattcagacccaggtctgactcacttcacagcgtaaaacgactgtcctgtacaaatttaaatcctgctataatgttattgtgggtgtaaacactctccccctatgcaataactcagcttataggtcagtctccattgcaatgagaatgtttaccagacaatcacagaaactcaccgtacacaaataaaggcttattgttcactcatctgtaattgctatgggttgctcaggtggctctgctgatcttggccggactcacatatctagagttcaggtgatttaagctgacctaggctggcctcttctttcattttccagcaggctagactgggcatgtttatggtaatgacagaagtgctacagaaaaggggcagaaacatgcaaagcctctttaggcccagcctcagaactaacactatcatttctgccacattctgttggccagtgcaagtcagagaccagcccagatgcaagaggtagggaaataggctctgcctggaagtgcaggtcccatggaataggacatgaatgggttaggaatgagcctttggccatcaggacgttagtgttaagcttttgcagaaaggacttgttggacaaataacagattcctgctgcgggaatggagaccagctaatatggcctgagtcccgaaagcccatatccttaggctgtatttgtgaggttttaatttaatctttgtatatatcgtgagcactcttcgttgaccttatagtgttgctatcatctcctaagttgattggctccctgaatgtaaaaggattttcagaggcaggcatggtttgtagcaaagtcagctgtaatccctgatgatggtatcatcatcgagggatgccaagagggtaaaagcactatttcagattatggctacgtgggatccaggaagtcatgacaagtgaacagaccctaaactggtgatgaggaggagggcagaggtgagcaggagggaaagattcggcaccaaactttgaatcactaggagtttcactcatcagctctaaaggaaaccctttggccaaaataaaaattgtcttctctttcctcagccttaattgatagaggataatgttatcagctggctaatgctcatcagtgatcaacattagactactgtgttttgacgttactgctgcaaatctcctgctttattaactgcctgaatgaggagcacatcagaaagattggaggtgttgcaattagcctttaggatgaaataataagtaacactataatttgtgactttgatgcagacatcaatttaaaacataaaccactgactagagaagagataaagacagagtgctgctgttccccttcattgatggctgcttgctaatgagctaattgaacacaagctgctaaattcttgctaaaatacgaaagaatatgaaatatcctgtttccagttatactatttggaggtttagccttgcctaatctgtgacaaaagtagaggccaactttgggtttgaaggtaacttctattctttttccagatttctttaagccctttgttccaccctttcctccagaaaccctccttggttcttctggaagtgactttcagcaagaagcttttagaaagaaaaacaaaaaaaacgaaaaacaatgttccagtaactgcagaggctacatgatggggttgatcttgtccactatggatcttttaaataaagctttggaaataccaagctcagacttaacaaatacaggagaaaaaatggcatgattatctcaataaataaatatcaaaaggcatttaagagaacttaatacattatttctggttttaaaaattattagtaaaacaaggttggaagaattggaactgccttactttgtcaagttgtatctactaagatactagaacaagcctttatattgaaggatctgaagaattaaaagcatattcctttaaagtctgggacaagcagtgatcattagtctcagtctctctttcttctcattgtcttgcagaaaccggctaatgcagtgagactgaaaattattaaaaagaaagtaggaattataaacatagaaaggatgccacctctgtctatagaggcagaagatgagattgttcacctaaaaactaagagatgttagaactgttagaactattagaactaataagaaagtaaagtggctggatataaaccagtaacttttaaaaccagtagcttcctatatagcagcagtaaccgcttaggaaatataatagggtaatataccctagtaacaactcttataatacatttaaggaataaactgaaatgtgaaaggctaaaataaagaaaactataaaactaaactgatacatgtttttaaaaaagcccacaaaaaataaaaatggagagcatactgtgggtgtattcaatattttaaagatagttgtcctcaaatttacctgtgaaattgtaattcaaaaatgccaaatattattatatttaaaacggtaactttaaatataacttaactaatgtattctgaagtttacctagaagagtatatgtataaaagtaccttagaaaattttctaaaaagaacaaataaccaataaacatgcaagatgttcagtgtcaccagtaacaagggaaatggaaattataacaatagtaagaccagcctggccaacatggtgaaaccctctactaagagtagtctctactaaaaaatacaaaacaattttagtctctacttaaaatacaaaaaaaaattagccgggcgtggtggcgggcgcctgtagacccagctactcgggaggctgaggcaggagaatggcttgaatccagggggtggaggttgcagtgagccaagatcacgccactgcactccagcctgggtgacagagcgagagtctgtctcaaagaaaaaaaaacaaaaacaaaacaatagtaatagttgtgcatatcagattgccaacatttaaaaaatcatattgtgtgacacgtgcactcttacaaatggtggtgcaagtgtaaatagctatgacattttttggagcacagtttggcagtaggtttttaaaatttattattatttttaattttagattcagtgggtacatgtgcaggtttgttacatgaatatactacgtgatgctgagatttggcctttgattgaacccttcatgcagagagtgaacatagtacctaatagatccttttcacaccttgccccactcacttcctccacctttttagagccctcagtgtctactgttcccagcattatgtctgtgtgtacccaatgtttagttcctacttagaagtgaaaacatgcagtatttggttttctgtgttaattcatttaggatgatggccgccagctgcatctgtgttgctgcaaggggcattatttgattctttttaatggatacatagtattccgtggtgtagatgtatcacattttctttatccaacccactagagatggcacctaggttgattccgtgtctttgctattgtgaatagcgctgcgatgaacatgcgagtgcaggtgtctttttgattgaaggatttatgttcctttgggtataaatccagtaatgcgttgctaggccaagtggtaattctatttttagttctttgagaactctccaaactgctttccacaggggctgaactaatttatattcccaccaacagtatatgaatgttcccttttctctgcaacctcaccaacatctgttatttcttgactttttaatagccattctggcagtatgtttaaaaatataaaatgtacatgcctcttgcgtgagcagtctcacttctagaaatcacttctataaaaacatatacctaaaaatccatcagttgaggaattatacatcgttatatatccaaactatgggatcctcttgaccctttaaaaagaaaaagtagttttatttgtactaacattggaaattgcatatggtatattgatagattaaaaaagtaacttgagatatgtgggtagtataataccatttgggttaaatcacttatgtgtaaaaaccaagatataagaggttcacgtcaagatgttaagggtgatcacctctggaaagacagtgagtgagactgggggaagaggagaatagcaagaaccaggactttcactctctttacacattcctgtatttgttaacatttcgcagcgaacatctttgatcatttaaaaaattaatgatgcattcttatattgacaattcttatactaaaattttgaaaatccacaggagataggaaaaaataccccttacttttgatactattgacattttgaaatgaaaggaaaaaatgagtttagtagagttaattcagcagaaaatataaatatataagatggcactaaggtatctttggggagaaacgggacctggttttgtttcgcaggtcctttgccatttgctgtttgatactggggaagccacgtaccttgtctgtggtccagttaggtttctccactctgcaggtagggctgacctacttccattggaggaaaaacctagagagaaagaatgtcaagaaaggttccacctgaatgggaagtgttattgttagaatgtccatgaatgaatgtcagagtccagcatctcagaggccatcattaaatgaggagcagtctttgtagaagctgaactctgaagtatgcatcatggtgaggagtcaggtggggataaatgaataaaacataaaagaccatgtggtatggtagaggaggaggtgtgtgcgtgtgtgtgtgtgtgtgtgtgtgtgtgtgtacagcttaagaacataaagcaataaaggagaacattttgatacagcataataaacaatattggagtactaaggaggagcttggagcaattcgatttgggaagtattaagaggtgttacatgatgataggagatgggtgcacatgcctgtgtaagaatggggaggtggggacattgtagtgatggggcattggcattgggtagctttgttattaagttcaaagagtttctaaagggaaaataaaatccccatttgaatcacaggtggttcattttctgaggcaatctcaagaggcacaagatcaaatctagcttgacaccatccagtacagaactcagcagtctctagaagctggagctgagctacagcttggctaatgagaactctccatcctctgccagcacctcagggcccatctcttcctctttggcaagcaggatacaaagagagcgcaaagcagagtgggacctagaaggtcacccagagcattcattttgcaaactccccaccaggcctttccagaagacagatgatcacggtttcacagttttgctagaatccgagccagtggcttcatgcttcgacctggggtaggttttaatgaaacctaaagaatacttcacacattgacctaccattggcagtgaggaagagggggagatgggccaaacacagctgaacgacatcctctcatttattcatggggcgtgagaggagtgattgtaaaattcagatgaaaactagaagttaaaattcagagctcccagtataaacatttgggtctggtatgaagttcactttcaccagtaagacacattgagaaacacaagaaacccattgttctctggatgtttgtgcatttcagtggttttgcctgtaggaccctcaagtggaagttagattgtctctattatgttctttctaatttgttaaatatttcttgaactaatctccttctcactatctccattgctaccgttaatgtgtacactgtttatcacaacagccttgcatctcatcagtctgcagccgtggctcatgcaatccgttcatcatgctgcctgattcttctttccaaacatcagctctttgtcacttcactgctcagcatctctcactgacatttggattgttcaaaatcatatccccactgcccaccttcttggccacatctcttgtgcttgcacctctccccactctgttttcttctgattcaatgtgacagctacccaagactatacgtggttctgcaaaaatgcaaacctctgtcttgtcttggcacctagaataccctttttttgctaattactctttgtctcaagatgcggctgtaccaagagtcatctctaggaaatgctccctaacctcctttgtgttacgtaccatttcctcacactgtggaagcacatgagaattacttccatcccaacatctgtactctcccctaactggctagttattggtctgtctccctgactcacctggaaaccaccctcaaggtgaaaattacgtagttctgttcattgcatcttgcagagtgcctggcacatcgctgtgtgataggaaagaatgaatgtgtatttttaaattgggcttctccttctctagtttttgaacatgtgtatgtgggtttctgttttgcctgatgtgacgtgagtcaagtcatactcaacctgctgtgttctcagaaatgcagtgcggatgagtaagataaatcatgttagcatcatatataagtgagctgaagactcttaccactcatctcagagcaccattaagtagctgcctactgggtctctctagggtgttcatgaattaaaactcctgtgttgttccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggtaaattggaactggtaatcagtctttgggcaaatggagagtgggatccacagacagattaaaagggtgaccccaggatgatcccagaagctagtgcatgaaggatttctgatttctgatcctgtttcttggcatgtgacttctaggccagttgtttcctctctgggtattttttgaaatgcacttttatgtcttgatgctgaacagaaacaaggagaagcagtaaaatgttggagtgattttaaacccatgaaggaaacaaacctgctcctatctgcatggaaacccacaaaagtctaataaaattaaaccccacatctttcaaggttgagaagagaaagaaaatcatttgagaagggcatctgaacctcattgccctcgaagggttaccttccttttagaaaatttttgataatttgctgctgccatttccctgtaggctgcgaggaataacagccagagataggaccttcctccatattgccaaccttggatgaccagggtgggattttgtgaaggaaactggtagttccctgacaccatttatatgtatcttaagtaacgatcacttgaatatctcaccgctagattaattctaagtaggttttctctgcagtgttgaagggacaccttatttataaagggaaatagatttaccttggaagtcaaatacagcttaaaacaaaattaaccagacacaataatgacatcttaggatgaaaattctttccaaaattatgccatgtctgctaatgccaaaatagaaccatttcttattaaccattgcttagaactttcatgcttctttccaatcatgtgggtactagagatatgattattatgtagtcaaggccttggaaccaggcataattagcccttttctactgtctgccccccatctctcaaacctaactattgttcctatgtagagacactcctaggctgggaaataggaatttgagacaacgtctgaactggcttagaccagttgttcctgctttacatagctagaaaaaatgctggaagcagaagtacctggcaaatttaaatcactgctgtcatccacattcctgagattaccttaattgatgcagaataggaaaacatcagggctgaaggggaccttagagattcatttgtccaaaattaccacttgcagttgaggaaatgcagaaaatggaaagctgaagtcagcggatcactacctgttagagaaaggcttagcctggctcccaggttgtcttgcttcccaaaaggtcacagcagcatgttggccctgacaagggctataacgggggcccatgggtgacaaatcaatggctgtcaccctgagaatcaaaaaaggaaatcacatggtaaaaacaccagaaaatctaaactagtcaggacattgatggttagactgagatggggtaaaaaaggggcaccatgggctcaggtcttgggcaattaggtaccttatttcaatgagatgcctttcctagtcttgtcttcttagtgatccaattttttatggtgttttttttttttttttttttgagatggagtcgcactctgttgcccaggctggagtgcagtggcacgatctcagctcactgcaagctccgcctccccggttcaagccatcctcatgccttagcctcctgagtaactgagactacaggcgcacgccaccacgcccggctaattttttgtatttttagtagagacgggatttcaccgtgttcgccaggatggtctcgatctcctgaccttgtgatctgcccacctcggtcttccaaagtgctgggattacaggtgtaagccaccgcgcccggccttttttgtgtattttaaagcctcgtatcttaaactaaagccagggatcctgttcaacctggattttctcttgaatggagggtagtttgaaaggatgctgctatgagtgatagacagaacttccagccagactttcacaaagtctccagatttatcaaagagcaagattagttaataacccaggtaaccttggcaacaaagaggccagacaaaaaccgtctgtgctggaattacacatattgctgctgtcatggtcaggcctgacctttccacatagcaggtggggaatgggcaggaacattgtcctgccaggtgtccttggatattttttagttgtggacgaagtctcaaactaaagaccatgagctaatataaagcaggaagcagagctgtaacatgtttctccttctggcagaaaggtctgagctaagggtagatggaggagaaggtgtttctggcccccagcattggacaagtaaaccagttcaatgaaatggccccactaaaaatgatcttccctgtagctgcctgaacttcctctcttgagccaatcattagggttagcatgcatgcgctggagaaagaagggagaattgaggttgacatgctggggtacctagctgaaaatccatttaattaccttgattttttaaatgcttttaatggtccattcattcacttgatgaattttttcaaatgctagtgtgtgccaaccctctaaccctgtatcaggggctgggaataccgaggtgagccaatactgatactgttcctgccttcatggaacttgtagtctggtgagaaacagggagtgttgatctgttgggtggggcggggctaagtgggtcccttgttgcatggaggtaactgggtagccagatggcatcagcaactgggagagggaaagggggcagaggatggagtgccaagtttatcagccccgctcaaaatcccgcttcccccctgcccgcaacccttctgcgataacaaagggaggcgagcaggcttttctagtccaggacactcctttcgtcattcctgccttctgtatcctcttctggacccggttcccagctcccctccctcccacctgaaaggtttgttttgcattccacaccttggctggctcatctgcatgtgtggacaggtgaggctgggaaatgagagcactttagaagtgagaagagctctaataagttagagagaagttggttgttaccctgaagtcagctggtgactccctggtcattaagacctggtcagaattgtcttacaccacatcaagcctgtggcctatggtgggaccccccattcctcccccatcacatacatgcagtttctacagtgttccaggggcttgttcttatgtaccccttcgcctcctgggctcctgttcccccgtgtgcagactctgatacatcctaaatcaagtcctcttttgagtgctcttggaaaccgcactcccaggcacattgttgggtatagatttactgatactgtgaagggattggaacccaggcttctatcaaaacacaaataacttccatcagaactggaggcttcaccactgttgttaactggaggcttcaccactttgggccccctcaccaccatgacgtcattgactcgcctgactcctcccagcctctcccctgcctccagctcccctgctcgctttcagaagcacagacaacaaattcggccaacaaccattgcacacctgccctagcttgctcacccaggtattcttcaaagagcagcctcctccctcctacccagaagaattctggtaacatctattttgaaaatcgtttttttaccctgttgcatattgttatgaaatgtataaaaagctgggggtgctttatttaagatgatagtactagtttgtggatggcagataggaggtatctacacagtttctatcccacactttctgtatttgtgcagggcaaatgcctgttgagggtaatgggcagttttgggggtggaccgctgaccttagactttccttgcagctttggccccaacccatgtgacctccttcaatgccaactgccccttggaattctgaggggtgcaagcactggcctgacccatttattctgggtggcatgtaactgcaggtagtagcattgctaggactgagggatttgctgttgcaaattgttgaaaaaggggagttgcaaaattcaccaggtgccaccatcagtgaattgggaagatctaaaagaagatccctgtttcttagtcttcttaagaagtttttcctttctgtcagggaggcagcagtgggggtggagggcagggaaggagggattgtttttacactgaccacagtaaaatattactcaggctaattaaggcctagagaatggttaaacaagaaattagagtaaattatgtaaattctggccaccaatatgagtacattgattagcggcaggttgaagatttttttttttaatttctatttttaattaccaaagtgtatgtatctattatatgatattgtaatagttcagaataatataaaaggtagaaagtcttacatctttgcctctgccaatcccccttctagaggctccacctttatagattagtataaatctttttgcgcctctttctatgaatatatgatttttaatcaaactgggatgagaccatacatatttgtgtgtaaactgtcattgtttccacccacatagtggcatatcatatgaacatctttctggtgcaggtgggtcattatttttaacagctgccaagtatccctttgtatgactgtatcataacgtggttgttaaatctcctatgcatagtttttcctcattttttctactgcacataatgctgcagtgaacagtttatgcttgtgtgtacatgcacatgtatggagattgctacaggacaaaatcctggaagtggagtgctagatgaatagtatatccatttaaatagttgatagatattgccaaattgccttctaaaatttttgtaccaactcatacccaaaaaagcatatgagtgcccttgaaggaaaagggttcttaaaatgttgagcagggagagtaaagaaagttgaaatgtaatttaagggtgaggtgagccacctgctttcatccagcctctgatctctgcttcactgagcacgcctctgctgggcaaagagtaggagcctgttgggacagatcggtgggtccttgctccaagaaggaagtgtggctcatgggccacactctcagacatgcagaaactgtaaaggaaggagacacaagctaagaaacccgggctggcacctctgcacaatcctggagcctgcccgtgccctggctggcactgggctttgctgaaatctaatatcttgtttctttttcccttctgtaactaatgagcaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaattctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaa

SEQ ID NO: 36650 - DNA, 58517 bp, Homo sapiens; identical to SEQ ID NO: 36649

SEQ ID NO: 36651 - DNA, 58517 bp, Homo sapiens; identical to SEQ ID NO: 36649

SEQ ID NO: 36652 - DNA, 44216 bp, Homo sapiens
cttcgtttccgtctcggccgggcacccgagcgcatcccgccgaggccgggccgtttcagggggaggcgccaactcatcgcggcgccgggcccctgaccgtgcagtaaccgctacccaggaggcggagcggacaaggctccggcctgcgaggaggtaagagggtggaggagtggtgtgggaggccgagggggatcgcggccgtgacgtgggatgctgtcaggtaccactggggcaggccacccctccccgcccctgcggcccgacctccccgccagagacagctgaggggcccaggggactagagccgcgaccgtgccacaggcctaggcgtcgtcgcgcatgcgtaaaactgctggcgggagttaagagctaggttccggggctacacccagcccaggccgcaggcagaggcggccctgcgcatgcgcaattccgctggcgtgggcccggtgcgctgctcgcgactacatcctgcccaggccgccggcccaggctgcgctgcgcatgcgcgagtcctctggtaggggtcgcgtttggcgtcgttccagggtgatcatctgctcggaggccgctctcatcctaagctcccacgtctggtgtggctgggggggcgtcacaggtcccgagggagcgtcctgcctgaagtttctccctcctaacccactcgctgcactgcatatgttgccgatgttttcatttctgtggcctcgacccctaggctcccgtcccataaatctagtaccccaggtcccgggcaccggcccggctcactaactcagtggcagtatatgctttcgacatttggtcctgatgtccaggaatagcgcgaaaagtttgactttgttaggcgaagccgttttggaactgcggagggatgggaagaaatcgccgagcgtcttaagccgcaacatagtgctctgctcagccctggaaatagaggttttcagacattgaaaactttccaagtgctccgtcttggcggagaaagaactgagttggaaggctaatttagaatgaactttttgcttttgttctttgcaaaaattacataaaatgttgcaacagttcgagaccaggactataacaaaacgcatttcatggagctactttgtaccgcgcttggcgacttaccttgtcagagctgaataaaagtggttgagttcacaaacagtgctctggatcgttgctctttcccccagacactgtttaacgtttattgagcctcctggctttgcaccttcctagtattgcgttcctgctgggttttacaccttactagacagtgggtcttagttaagtcagtttcgtgactcctggggctactgtgaagagtttctaacaatgtcattactctgtgctttgtaatcttatatgatgtgctgatacagatatttgggggctggaatagaagagccacttaggctcagagaatgagtattctaggtgaaacgtaatctctttatttcctgctagacagtacatgcgtgttattaagcagcaggtaaaagcaacaagaatgatacgttcttgcataccccacttccaccactcaggccttattgctcttgctgggctcgccaagcggaccctcatcccagggcgtctgcgtttggtatttccagtatgctcaatgctcactttcccactcttcgcaaatctgcatggcacagaactttatttaagtcttgaaacaattgccatcatttcagagaggtgactacctcacctaaaatgtctggctctccaaactcttgtactgctggttcggctttgtagcacttaatcaccatctgatattatatatttgtaagggtatgatcaatctatctccaccataattgaagctcagaaggtatttgttaattgtagaaataaaattggaaactaacttactccagagatatttttttactgaactcaacctagattcattcatttattcaacaaaaattgattttctatcacgtcctgtccttgatgcttgggatgcatcaatgaacaaaagagacaaagatcccttccctctggagcttacattctagcaaagaatgataaaaaacatatttgtatattaggttagaaaagtacaaatgctatgaaaaaatgaaaaaggagaacagagaaagggaattgggagtgcaggtgtgggttgcaattttaaacatcatgggtacggtgagtctgaaggataaaccaaaggtgatgtttaacatggggaactgggttttagaaataaatgttcttctgggagaaaacgttctttatcgtgctctacaatgtcttttatgggagcccacggcatgacccttgtgataaacgtcaccattttttatagtatataggtgaaaaaacatttttttcctaaataagagttcaaattattcaggagtttacagtttaacttagcacatcaaatgaagacactggacttttacaaggaagagctagccagacatctatgtaaattgtgctgagaaaaactgtacgttgtctccacagtttttgcaattgcttctaaatgtccctctgactgtggatgactagtgaagatcttttctaagaatggtcattgcttttctgtatttgaaactgtgtaggagaggagcttaaatcacctggtgtgatgttatgctataaatgacctctcttacaggtatctgaatgaaccagatagacctaactaaatttcaatccataattaaagaaggcttagagaaagagggtgatggagaggaataattttagaaagtaaagtgtgtttcccctcatgtcctttacttacatagattacaaatactctgttcaaacaccaaaatattattaatctaggaccataaatgtaaggagtccatggaatttgcttatgccctatgaaattgtcatattcaagtttggttttatcagttggttaaagtaaaatttaaatgccccaagatactgctactgttgaggtttacttggatttaaattactacaaatcaggccgggcgcggtggctcacctgtaatcccagcgctttgggggagaccaaggcagtcaaatgttcttgagcccaggagttagagaccagccgggacaacatggcaaaactctgtctctacagaaaaacgaacaaaaaaaaaatgagccaggcatggtggcacacacctgtagtttcagatacttgggaggctgtagtgtgaggatcactggagccgggaaggttgaggctgcagtgagtcatgatcacaccattgcactccagtctgggcaatagtgtaagaccccatctcataaataaataaataaatattgctacagattaaaattgtccaggaaaaggtagattggagaccaggaattattggggttacagagtgacattaaggactcttgttaaagactaaaagagagttctacttggagattttacttcaaaggagtggatggcttgcctcctggtaagggatattgataatgtccatcaatggaaggctgagatgatacttccagctttcattgtctggaaggaacatgtatctagttcacatggtgatcacattctaacaacgtgaaagtttccaggaaacttaaaccataataatttttcagcattaatttgacattagagtgggtttcttttacgtcttcagccttgctaattggcctgagctaatatctcttatgtatatctccctatggaagatgttttgagctaacaagtaccagtaggagatagtatgtgaataaaacataaattttgactgcattataatatgtcctgtattatgctgcgtgtatgtatgtatataatactgaacaaaaccaatctcaagtggaaatgagccaaggccaagagggcctgccatgttgaaggaatatatatgctgtgggtcaaagatctttaacaattaggatctctgtagcaggcgtgttaagatttttttttgaaaaattggattaaatctataaggaccgagatttaaaatggatttacaaatgagatctcaaatctcaactcacattagtgcatataacaacttaaaaatatttttatcatttatgttggttatttttcatatttgaaaatgacacttttgccgtgtgtggctgaaaagactgaagttgtcaagctcagtaatcttttcaattaaataccgctttgctttgtactgaagatctgactcatcactcttgttgaaatttggaaaactttttaaaaaaacaaataattaaaatagcaacagggtttctgtattctacacaacagttttctgtttttcatgaacatatgacaataccatttcctttgaggttgtgtgctagttttagttatgcttttagtgttttagttttgtccgtcctgtttataattgttccattttaattagccatgtaggtattttactgttacttgtcattgattttagacatctcatttaagtggagctaatattacagctaacactatccctttttgcaagtgaaaactgggatcatgttttattgtatacgtatttatattatttataacttgaagatgacccttaaaaagctattaaagatactatctaatgactcacctaaggatatatttgggaaccatcattatcctattgaaatttatgtggtctgcagctcattaacacaccgatgctgtaaactgcatgctggtaccctaaaagatatcgatattatttaatttcctgtttcttttgattataaaagcatcatcaaatgtgttacccacccagatgggataattttaagcatagagttctatattgagagaattctaaaaatatcagtgtgtttctcaagcatagctttagagttgatctcattaagttgaattttaaaatatgtaatactgggacttctctgcaggaattgctattttttttcaccccttcttctgtaatcacttctaaagaagaattattagcatttagaagcccctgattaactgcaaaatgtcagcatttaaaacctaccattgggttggggtaatgtggacagaagtccctaagagagctggatattgttttgctctacgttattctgtttgctctcatgtatttgctttcaattcagtgcctactgcaggcactgaattaatatttgttgaatgaattaggcaaatgaacctatgtcccataatcagcttaactcattttttaggtcagaggtattaccgagtaatataacacattgtgtagcagatacactgattaatactgattactttgccacaaataatatgtacagactgcctgttatatcttttgtacaggcaaatgaattatttgactttatgtgaggattaagaatgaatgtgtttatcacattatcaaaagagtgtccccttgttcagtagtcttcaactgtgtagtttttaaaagtgtagagaaaactctcaacatagaatatatagaaataaggagttatctgccccaaacagggatactttaaaaataaattagtgaaccgtacaattaggaaaacagctgaaataggaaatgtcatgtgacagattaccttacttgatatatatttggctttgaaacattacttttgtacagacttgaactactggccaccgagtgtcccatttggaacctttaaagacagagatcagtggcaggaacttctgcgtggagaggttacttatcattccattttctatttatattgcaaggcaaacattagtataataagattctgtaaaaacagttttaggttacattttaataaaatgaggaaataacataggagactgttttgcaaagaacaaagcaccttttaatataaatatatatcatatatatatatcatatataaatatatatcatatatatatatatcatatatatatatatatgagccaagtcatatatcccaaaacaaacatataagggaaaaactaataaagtaacacatagtaagatagtaagataatattactgtcatcctatagtaagatgatatgagatgatcttatgctgtaacactgtcactatgaagaaaatcttcccaatactgttgccagcttctgccttggctctacaagaaacattgccctcctatgcagaaaaggggggacatttgtaagcagatttagaccataagtagaaagcacatttttgccattttaatacactgatattaaacatttttttaactattttggatttttcttacaggtacaatagtataaatgctactcattggatatgttatttaatcctcctatttaaaaaaaatctatttattattattattttttgagatggagtctcactctgtcacccaggctggagtgcagtggtgtgatcttggatcactgtaacctctgcctcccaagttcaagtgattctcttgcctcagcctcccaagtagctgggactacaggtacacactcttacgcctggctaatttttgtatttttagtagggatggggtttcaccatgttggccaggctggtctccaaacttctgacctcaattaatcctcccatctctgcctcccaaaatgttgagattacaggcatgagccaccgcgcccaggctatttttattttcttagagacagagtcttgctctgttgcttaggctaatgtgcagtggtgcgatcatagctcattaaaaaaattatttattttttattttttgagataagatctttgtcacccgggctgagtgcagtggtgtgatcatggttcaccgcagcctccacatcctgggttcaagcgatccacctatcttagcctcccaagtagctgggactacaggcgtgtactaccacgtgtagctaatttttaagttttctgtagagacggtgtcttcctatgttgcccaggctagtctcaaacttttgggggcctcaagcgatcctcaaagtgctgggattacaggtgtgagccaccatgcctggccttcctagggtattgattcaattttattttacagatggctaaagaaattatagtttatgagttttcattaccaaacgtttattgaatttccatgtccttggtaaaggcaaaattagaatgatagcattctcattttaagagtttattttctttaacattgggtaaccttaatctctccatcctgagatgattaatttaagcttaaaatcttgaaaaccatcttgtcagatggaaaagctgtagcataccaattcattgacagagttacatgggaccttttatctttggtattccctccaccaaaacttccccacgaaaaaattcccatcaaagtctagccatgcatatgttggtatccataacacattaaaatagtactgtcttctgcatgttttaaaatgttatcaaatatcaaatgttatcaaatgataccatatgtatcattttgtgacttagtgattttggtgaacattgttttgtagatatacctgttttgattctagataatttattttaatagctatatagtatgcatatgccacagtttattggttttgttgatcaatttgttctttcttgctttttgctattgggaatatttgtgtgtatgctctagagtttatctagggcagtgttgctaaaattgcaggacttgttagtgatctggaaattagtgggctgagatcagcattttcttttaaaatgaaattgaacaagataaaataggatagagtagggtagaataaaatagcataaagtagaaaaatggaaaagatatcaagcatctcatgtaggaggagtaagaattattttgtgaaatttcagttatatatacatatataactgaatatatatatatatatatatatatatatatatatatatatatatatcatgaatcctttgctcacttttgaattgtgtcgtttgttttattcttactgatttgcaggcattctttatatattttgtgtatggatcctttccaagctgtccattatgcatgttacaaatatcttcccccattctgtggcatatttttccttttgttcaagtttactgctcttttctttgtgttttatgctttcctgtcttatgtatgaaatctttaactgctctgaggtcataaatatatttctatacttctaaaagtttgaaagttttgcttttttttacatttccacatggattctcttttattttccatatggaaatactatagattaaattctccttagtgtgcattttttcatgtgtttcagtgtccaaattgttgaaaccctctcctgaagcttataaagtatgatattctaaagttacattttataactttagtatttttataatagagcatctctgctgctgactttttaatagtagatagcacagatacaatttttaagctgtatttttctcagataaagaatggattgttaaatgtgcaagacagtatattcttttccttctgtttttctctaatagaatttatttgtgtatttatatttccagtcacattaactttgctctagaagacaactttacaaggatctaaaaggaacaggattaaagatgactgaatactgggttccagaaatttaaaacaatcaggtacaaaagtttttggagggaatgctcccagccagtcagtataaaatagaactgttgagaatgtacacaagaaaaacttaaagtatctagccctgaaatacagtggagggtcccaaaacaagggctttggaatagtcctggttcaaatactggctctgacactgattggttggtgactattggtcacgttactgaaatgtgtgaataaaatggaggcaatgattaacctgtttcatttggatattataaagattaaataaggtgaggcacttagtgcctggcacagaataactttatttttactgttgttattgctgttgttatttagaatacattttatcacatcatggatatggctttctgtatgtatattgtgaattgttattttaagtatatatatcaacatattgttaatagcctggtgaaatcacatggataacagggtaaggtaatctccacgtgtagtgcacaaactatacatgcaaattggggatgatagttttctttattatgtatgcatcacattgaaataatgtaaaaaaaaaagccaaccatctcccacaatgctaaaaaattcaaaacactttttaatagtattatacaatagtaattaatcttgatttatttttaaatcttgaaggactttctgattgacaaatatgaaattatgttaatcttacatttcattcaatttgaatcctgcatgtcatttctttgaatgtggtaatttccatgacatacatacaattatgtcttaacctgatgtcagataaacagaatggcctgttttcctaccattctaattttaaagagtttaattttacttgaaattgataaaagacactgaaaagaggttatttcctactcaaaagcccaggatcggtttttcatgattttagcacattaggaagatttcccttctgctaggaacgaaagggggcctagggtagtgcagtgaggggcagtcacatctctacttggtcccttcttttttctcttctctccctctttcttctcctctccttttattttttattccagtaaacttggggcaaatatggaaaaagtgtttcctgatagggtgaggcagaaggagagggaactttggttacaggccagttccagtatacaaaaagctgggttctaaggatgctttgtatgaatacgttgcgttttactctgagccatgggctgtgggttatagcaatgaaggaatcgtctgcccttttgaagaacttaccaattaatagagaaggtacatcatacaagaataactgtcatatgaggcagaatttgaaaaatgccttcaatgtagttaaaaacaaaacaaaaagtgctgtggaaatacagagaagaggtcccagcccatttgggtaatcaggatccacattgatgtaaatctcagtggcagtcatgctgggtcttagagaaaattaggattttaacagatctgctaagatgccatagataatatgtagtaagtattaattaaaatgacagaatatctttccatattgtcaatcagatcggtttataaatttttaagtgagaaacttctaagtaatcttctaaaaagcaagcatatcttttttacttgtttccaaatgttagaaagtaatactttgctattaattttcataattttaagttataataattctgaataaattatgatttctcgtattctgagagatctttttatagctgaggaaaaaaattactaatatcctcaagggcatagaaaacattgataaggaacactgtttagacttggctgtattttgattattgtttttatctgtctattatgaggctctcactctactgtagaaaataccagataaaatgttctgatgttagtacctgaaataatagattgtatttaagtaaatagaccctacctcgtcaattagaaaaagcaacatcattaaatacagccttattaaattgctttttggaggagagagaatattttatttttatttatttttaatgatgaaatcgttaactacataatgattaaaccacagtccagacatattgcatagcttctgctagagctgctcctgctgttacttttacctggtagaaagtaggtgatgtgggcatggttattaaggcaagaacatttagtgcattgctacatatttgatggctgttgtttcagatttttcattaagtccagaataacaaagccacattcattcattcatttttttcatcattttcattcatttctccttttttttttccagcttagcaaatcatatattcttctgtggagctgagaattgatgtccgctcttccccgtgatttggaactttccaatcccagagaaaagttgacaaaggtctaaaatttatttttccttatcacaggaagtcaactctgaaatgaaaattttctactgatttcctttatagagttaaggacccatgtgaattttgagactactttttcagacctcagcaggaagattcccgtaagaggccatccagtagttccagaacagttaaaacatttttggagttttatagctgttcattcccatgcctaaagcttaattcctttatcttcctttcacaacatttgagcttagcttattttccctgctaattagaagtaaagtaattttaacctgcctggttccatcgaacataagggatcctgattttaccacatactttttcctcagggactgcccaggactgagtccatatggaagaagaacttcctcttttctctggagacagtggcaaggttagaaaaaaatcatgcccttggagcatgtgtgttctgttgcatgaaacatacttcatgaagcacctattggtcaccgataggaaaatcaatgagatactatctatctttgaggggctcacagtgtaatcactgagatgccaacagataatcgttgtgggtatggagaatgctgaaggggccagcaggaaactgatatacctcaggttaagagaaagggctcccagcgatggtgacagtgacagatgaggcgcaaaggccatcccctgcattcagacagtgctggcctgcaagaggctatgagttgatcaatgtttatcccattcccagagatttttaaaattataaactgtctgatcttagatgatatgttctcaattcatcatagacattctttaatttctttcttcatcacatctgaacatgacagtcaaccaacttatgtctactcagtgtccagttgttgttaaaagcctcacatcttcctgcacgcatattgatttccatcttgtgttattttgttaaatttacataatatctgcttattgctattaacagcttaatattaactcactattatttaataaaatcaggtcaaaattcaataaaactgtaaataattatgcaaagccagcattgtatacaaagatggcaaagcttttgaaactaaactgtagcattaccgtgtgcagacttaagtgttcatttgtgagcccttgtaggaaagtccaaaagtagtttacaaaagtaatgtatagaactcgagagtcctacaaaaatgttaacagaaaaattcctaatttttcctaggaacagctttcataaaataaagaatagtttcacagaatcagcaatgaaattactatattattactacatagtgattgaacatatacaaatatatatacaaagtgttataatgaatgaatatgatataatgaatactacatagtgaatatatttataagatataatgaatataatgaatatatatgaagtgttataatgctaggaagtactcaaaagttgaggtgttggcattttttcttaactcttttttgctaggtatgcctaacgtaattttgattctctttaaatatactgtattttaaattgaattgcaacaacttgatagctgtctgtaattaagtgaagtttggttatacactcgattcttcatattgctggagaagcatagttatacaggtatcacacactcaaaggaataataaagtgcaatttggtctctaattttgtggcagatgtatttccttaattatgttttccttgagctaatattaaaatttcactacttgacatttctcaaacagatgccaggtcttgaaggaaggggaggtggactagatgtgagaaaagtagtaaaagaaagccagtctgggttaattatcacctgcagtagtgttatttgcagtaaggaaggttacctgtgccaaaccaggactgaattctagggacaccatattgccatgctctcattccttagtagtgcttttttccccatacagatttttctcttgaccatacttggctcttgctcagccagtttcttacttgacagttgggcacggagttgattgggtcattctgcagagacagctgctgtcatgcagaatggctgcagatagattgaggctcctatgggggactattgtgtgaatcctacattgtttcatgagtgtgctggacagaagaatgtatattgcttctgtgaacaaagatgctgtaattccttgagactgacacaggtagagtatcccttatccgaaatgcttgggaccagaagtgtttggatttcagattttttttttaatttttgaatatttgcattatacttaccagttgagtatctttaatctgaaaacctgaaatctgaaatgctctaatgaacatttcctttgagcaggacctttgaacatcataattggtgctcaaaaagttttgggttttggattcagatttttgaattagggatgctcagcctgtattaaatatgtacttcaaaaaatgcaaatacatgcattttataaatttagtcatcagttccctatgtaatagttgccctaacaaacttaaaaattgagtctttgatgactaacttccaacagccagccttctgccagaaattaaaagcaatgtattcacatctctgttgtacttaggttatattgtaattatttgttttctattaaattgtgacctccttgaagagaatgatcatgtcttatttttgtaccttagtcaatgatactatcagatcccacattctcttgacttgtagcatcatttcataaaacttacagactggaggtttcattaaagaaaacacacgcattggaatcccagtagccagtagagttacgggctgggtaccataggtttttatacaggtgggccaggaagaaagcctagaactaatcatttgtagacaggtatgtaagagctggctggaatttacagcctgattctagacatccagaaaaccacttgattttatagcagagcaggacgaaatataaaactctgcttgcaagggaaaaatgaaatagccgtcagtcattgtatctttccatgtgtgctgtttgtggaagacaacccacagtaggtattattgcctgttccttaaggagtctgagaatagccaaagccctgcagatgcaagcaaacactaggtctaccagcagtatcacagtttatgtaaactttttactcaacaatcagatgatatgtggaaagaactctgggctttaatctggctcatccactgagaagctagtgatcttgaaagattacttagtctccctgtgccccagtttcctcataggtaacatgaggataataatatctatgtcctacaattgttgtgaagatcagaaataagatataagatatagacattattagattattaacatctacattaaatacttgttccacttcctaaaccttgttcttttggaaatttacagacttaaaataggaaaaaaattaaaaacgaaggcctcatagaaaataagatttcttcatgatattgggtggtggggtaatttaaagtagaagcttaactaaaagctaacgtaacaaaattccatccttagctctattgtggccttgggcaagttgctcttttttcagtaaaccaagtgtcatagagaagaaatacaaattttaaataaagattcttggattcctcaattaatgtaacatcaccatagaacactgtgttcctaaaattatatatataataaaattggggacatagttttacacttgcatataactggaacttcttacatatgtgagatttttttttgaattccaaattccaaattaaggttgtcctgtaggaaatgcctgtggattttcctacctctaagaggtaaatatatatatatatatatatatatttttttttttttttgcaaagtactctgtaattaaagtaaatgcagaaacagtaagcactgtttcaaaagtgaatgggagaaccaactgttggtgttgcccaaaagataacagaaggtgtcctttttagggcaaggtcttatgatccaagtggcacgtgagggaacatgactagatttggcatcaggagagcttagccctggtacaggctctgccattaactcacagggtgatgctgatagcagggacaagctgcttgtcttctctgttagtttctttgtgctgctgtaacaaatgactacaattcaaacaacagaaatttcttttctcacagttctggaggctagaagtctgaaatcaaggcatcatcagggcaatgctcccttgatatctctcaggaagaatcttctcagcttctggtggtggcccccagcaatccttgctgctccttgacttccagatgcattactgcagtccctgtgtctgttgtcatctggccttcttccctgtgcatcactgtgtgccctctcgtcttcttttaaggagactagtcattggacgtagggtccactctaatccagtatgactccatcttaactcattacatctgcaaagaccctatttccaaacaaaatcaccttctgaggttctaggtggatttggactttggggggaagccattcaacccactgcagctcctctctggggtttcttcgggtttctcagaaaactatcttttgagctctttttagctacagcattcaatagtgccatgaagattattcagaaaagatagaaacctgaaaacaaagctttatttacaagaaaaaagctggtggctctgcttgtttttgctttaggtccagtggccattgggacagctgctccgtgcatcctagcttccctttactgactgcaaactttactttggatacaagttaatactgttggccgtgatcagaaggaaacttaaaagtttgaggacttagtaacaaagttgtgtttgatgatatggctcaggtgaagtagaaatggagagcttggagccgagagcagggatttggggcccagttttcggaatggcttccgtgtgaaggagttacagaggatgagatggaaaggagggctgtgaatctggaaatgagtcacagccattcatttacttgttcattaaccaacacaaaggtaggtattgcattgttagctcctttcaagggatggatgacatggtggtgaaagactcggtctctgtcctcctgaagtgtactcaggagtctgtgaaggtggccccagagaaattcatggtaatgaggacaggggaggcttactaagttaatagtgtggacttgagaagagcagagttgctgacttgtgctctcctaaggtggaagggacaagtaggtgttcagatctgtagaaggtaagtggatagtccactcagttatacaccagaccacattcccggtaaggttgatttaataactgatgggaaagagaggccttagaaaatctttgttgctttaaataatgtgtaagtttgttgatgctgtgggaaatagcagacatgccatttgatagacatattggctgtttatgtatcttattataacctacaaaatgttggcaagttgaaaagtatatcaataaaaatgcctcctaagtagcaaataggtaaaactctttcaaacaaatttataacttcctcttataggagtgtgggtgctcgtgatcttaatgtatgctgttagggggttaattgtgaccctgcaacatttatgtgttgaagtacagccagtacctcacagtgcaacttatttggaaatggggtcaatgcagatgtggttagttaagatgaggtcattagggtggaccttaatccaatataattggtgtccttataaaaaggggaaatttagatgcagagatatgcagggcatggggggagatgatgtgaacagacatagggagaagacagccatccacaagctgagaagcacagcctggaagagatccttccctcacagccctcagaaggagctagctagctgataccttgagtttggacttccagtttccagaaccataagacagtaaatttctgttggttaagccacctcgtttgtcactactttgttacggctgccttaacaaacaagtacacgtgttttctgggtgttaattcctgtcaacccccaaacttccttgagggatgaggaaacccaccaattccttaaactgaaggccaagtaaagcttgcccatgaactaaaacttcggaccatttccttggtgtcactttcagcgttgttctttaccaagcattgttcttgacttagagagcagatgacatggcagctctctctctctctctctctctctgtctctcttgcttttacaaccagcctagtttccacagctacttttaagacatagccaatatttaaagtatctgctgaacattcagttcccagaagcccagctttggatgactcctgtgtccttgaggacaatgagtaggggagacctggttccatccgggcctccgctgctcgatggctgtgagccgcccaaaagcagctggcagaggcaatccctgcagctgcgagaggcctctcaaaaatggatgcagtgtgttcctcccaaaaccagtgttcgccctcttctacagaactgaaggggcagagaaaattcactttttaatttgtcatttcaacatatattttttccttttcagccagtacaggctactctgtcatctttgaagatgttagatgtgggaaagtggccaattttttccctttgttctgaagaagaactacagttaattcgtcaggcttgtgtctttggcagtgctggcaatgaagttttatacactacagtaaatgatgaggtaattttgaagaaaataaatcagctactcacatttttagaaatggatttgccaaattgaagatcttgggggaactaaggaataaaaggttaaaaaaaaaagcatggaaattaggttttatttattatataaagaagcagtttgcttaaggaagatgattcctgtttggatgtaatttatagatttgttagaaatagaactgcttgaactaacagtggtttttcccatagatttttgtgcttggcacaaactgctgtggctgtttggggttaggtgacgtccagagcaccattgaacctcggagactggattctttaaatggcaaaaaaatagcctgcctcagctatgggagtggtccacatattgtccttgcaacaacaggtaacctaggaaccccatgtagaatttcagctttattcgcagctgcccttgagaacattgtttaattggttgagagttgctagctcttcctgtgaaattgactatgttttggataccataaaacatgaatgtatctgaatgccagcataaggtgatgtggcagatggaatctaggaatcattggcattttagatgtatgaatgacaacgctgtaagcccagtaaacactgacgaactgattgtggactttggcaagtctgtctgaactttggattcttgatctatgaattgaaagactaaaccttgtgtccaacatccccccgccaactcttagcattctgtgattcttacactaaagagtgactgatggctgtagttggcattagtagtagggattagccacttcataagggattgactagaaaaattccttgctctgagtgaagcaaggaggaaaaaaggaagaaaataaataaaacttctccccaaaaggttgtaaccatggatttgtagtttaattcacatcaagactgaacggtccaagaaatctcaacccttgaatttattcaaggtactggatggcaagtgccttaagggcatgatagaagttaatgcagatcctttctaggggaaggcacctttatcctaggcctgagagaattaaccaaaataattgttcagtggcaataggcagcacatagtcagagataaccagatatacagtagtctcccgttatccttggttttactttctcaagtttcagttacctgcagttgactgtggtctgaaagtataaatgtaaaatttccaaaataaacaattcataagttttaaattgtgtgccattctgagtagggtgatatttcaccatcttgctccatcccagctgggacatgaaccatccctttgtccagcatctctgccatagacactcccacccgttagttacttagtagctgtctcagttattagattgactctcttggtttcatagtgcttgtgttcaagtcacccttattttacttaataatggccccaaagtgcaagagtagtgatgcttgcaatttggatatgccaaagagaaaccatacggttcttgctttaaatgaaaaatggagagtttccatgctgaggttgttaagatttatggtaagaacaaatcttctatctgtgacattgtgaacagtacattttgtaattgttctctttgattattagttattgttgttaatctcttactatgcctaacttacaaattaaactttatcataagtatatacgtatagggaaaaacagtatatacaggttcagtacgagagtcttagaatgtatctcctgcagataaggggggcttgctatgcaaggaaacaaggtaccatgaatgggaaccagaagaaacaacagacagcaagaacggattactaaatatcaggcattaaaattatcagacaccaattataagacagctgtatttattatttgaagaaattaaaatgagcttgaaaataatctgcagggattatagaagatttgaaaagatccaaatgaacaatatgattatcaatatgaaaattcagtggacaaattttgtagcagtttgaacacagcaaattagtaaaattagtaaaccagaagataaatgagaagtcactattcagaatataacactaagagacaacatgctggaaaatacagatgaaatgagtacaaactgtatgattccatttatttaaatttcaaaaacaggaaaaactaaacatttgtatgcaagatgcatatgtgagggccttttggggggtgattataaggttatatttcttgacttaagtagtagtacatgggtgtgtgctttctaatttgtaaaactgtacatatatgttttattaacttttctgtatattatgctacccaataaataataacaaagatttttaaaaatcaacttggtgattattttaaagataaggaaattaagacctaggggagttaagtggccttctaatatttgacttcattctaatgtttttgctattactcccagcagccttttctctgctctttattaaaaacttattttccagttattataactgcatgcatttaaatttcaccttgttgctttgaggtagaatgcagtttatactttccaaatagattcttttgtagaatgactttggtggaatggggaagttgattagctttttgcacctgaatttttagatttcatttgtggaagctgtgctacatatattttcgtataatgaagtagatgttgtaaaaaactgattgtctttctttttattttcagaaggagaagtctttacctggggtcataatgcttatagccagctgggcaatgggacaactaatcatggtttagtgccctgtcatatctctactaatctgtcaaacaaacaagtcattgaagttgcctgtgggtcttaccattctttggtgctaacatctgatggagaggtgagaacagtcagcataaagctcattgatttttttcaataagattatgtagacttctatagtagtcctggaaatacaatcatttgattaaaataaccacctccctcaaattcagccttatttttggtagcaattcacagtcagggtgttgatgttgtgacatttacctgtacgtagtaaggtcttccataattgcaaaatttaaaaggaggtattgttccttctctgttgctgtagtaaagaggttatttgcaataagaaaaatccccaaatgctggaaaagatggctggggcaaagtagatacttttgtgttacattttatttaatagtaattattactgtttgtatagataacaccaataacctaattgtataaaatcatgtacattgtataagaatgcattttataaacacttctctgcctgtgttgtgaggatttatgaatgtgaagcactttgagaggaaagactcggtgccacaagtacatgtcagtgtccagttgagacagtttataaattaatctgtttcatttactgatctttcctttaaacaggtatttgcctggggttataataactctgggcaggtaggatctggatcaacagttaatcagccaatccctcgaagagtcactggctgcctacaaaataaagtagttgtgaccatagcatgtgggcagatgtgctgcatggcagtagtagacacgggggaggtaaggaagttattttacatcttgtttaaaaaccgtgtttgccacatcagtctcatgccagtatggtatgtcccacataacagacagcttgctggccatttgtctcttgagaggattgagggtctcattttctctcaggtctatgtctggggttacaacggaaacgggcagcttggactcggcaacagtggcaaccagccaaccccttgcagagtggcagctttgcaaggcatccgtgtccagagggtacgtccactgtcagtttgtgtgcgtgtatttttaagtcttcgctggcaaagatatcaatgtattaaaaacatagatttgttggcaggatgaaaagtttagctgcttggatgtcttcattaaagtaaaggttaagtctctttttccttgaattaaattgcagctgttcagaaaatttctcttccagggcactgtcacataccttttggaatataaattgttacaagctttcctgaggaagcttaaaagcttttataccctttgacctgtagttctactcctagggaatttccctgaggaaccaacaattcctgtaactgtcttacagaattagttaagaagatacatatacatataaaaagaggataactttaataaaaaaaataggtgtaacagaatttactaatcaaatcgtaagttaatgattagataaattatgccaagtatatatgctggagatgatgtattgtatacaaagaatttttaatgacatggaaaactgctatgtgtaatggtaaaatgaagcaagatacagaactgcttatacaacatggtcagtaaaaaaatgctataggtacatatctctatgtctatatagaaatagaaaaaaaatgcctctgatattcagagtacttttatatttatatttttctatatttttcaaattgaacatgttttacttttataatcaaaaaagaaaataattatttaaaaaatacaagtgtctgtttcttacattcccctcataccccttgatttctgtgagtattaaagctctagtgaactggggcaggtgctcacgccagggtactcatggcaatcttactgcaattctggcccacatgttctggaaggatgttggttaacttaatgcttgcctctcctacgggtaggctgcctcttcctttttttttcatttttgattcttaacctactttgtggaagcagtgaaataattacttatatttgcagtcctgagtggatttttttccttccaggtcgcctgtggctacgcacacacattagtattaacagatgaaggccaagtgtatgcttggggcgccaattcttatgggcagttgggcactggcaataaaagcaaccagtcctatcctactcctgtcactgtggaaaaggacaggtaacacgggcattttcacagtccccacactggtctttggtgattgtgattaaacaggacttagatatatagagaatggtggggaatgtactgctagtgttagaatattatttaacaagagtatttattcctttagaaaaattggctttggaattgttggggaggttgattgtatgttaaatatgctattttcacttacccatgtttcatctatacctccaacagctattctaagcaaactgcagtgactaaacttgcaacagctattctgttactcttctgccttacaaatcacccttttgccctcctccttttcctgttttacattcttaagggggtgtcaataacattcaaggtcgctcttccctggcttaggaaaaggtaccttgcatggggtataaagctggtcactcagctacatggaaatttgccagttgagaaggatagggttatttcattactttaactcccaagctgtcactacgaggaagagtaaaatggttaggaaattaagatttacttttgtgcacttgtttgcaaggttgtgttatgtaattagcacatccagaattagtttccacgttattctgatatttttgaaagcctttggaatttctcaagcatggtcagatcactgcctttccacttttcatttcctgatagtagtgtagagcaaaaacgtttcactatcttttcttttaaaccagggttgcagtcattgtagaaatgaatgctgctgtttttactgcatatatctttattatatttaattttaaaagaaatatgtagacaaacagattagctcacatttatatgcagttcttttctaattttctgctggaatacttaacaatgaaaatgaagaaccaaattgtcatttttcaactgcctcagttttcatttgggtattgtgaacttggctgactttctttaacctatgttttaaaagttttatttaaccaatttaacataggttaattttataggttaaataaaacttttttctccaaaaaccttaaaatttaagacccctggccccttcagaattgggaggagggacaataatggaggcaggaggtggtgcaggtagatgcctgcagctgttcattcacacatcttgtagcttagagctcctcagaagagaagggacagtcctgaggctttgaataaccacaaaagtgcctcagttggtagggacacttaacatttaaactgaaaaacagagttaaaggatcaaataaagatggcatggaaataaaaacgatggatttgtatggcctgttatttttttatttttattttttgagacacagtctccctgtcttccaggttggggtgcagtggtgcaatcacggctcactgtagtcttgacttcccaagctcaggcgatcctcccaccttagcctctggagtagctgggactacaggagcatgccaccatacctagctaatttttgtgttttttgcagggccagggttttgccacattgcccaggctggtagctcctgggctcaagtgatcctcttatctcggtctcccaaagtgctgggattacaggtatgagccactgcgcctggcctggcccattactttttatggtgctcctacacttacccagaactttagcacatccatccctggtctcacagaatctgccgtcattgcccaccagtgacttgctgcattgcactgctggtccctgatccagaatgatcacccaaggcttctgattcaggttctcactggggcagatggattgtggggcgtcaaggtgggagaaagaaaaagtagcagagaagcaggtaatgggaatggaagctgtgtgagtgccaagttgcttaactggacattgggagttatctattgcatttctgtcttcttaaactgcagttatttttgaattataatttggttataaaaatcatggatgggccaggcactcacgcctgtaatcccagcactttgggaggccaaggcgggcggatcacctgaggtcaggagtttgagaccagcctggccaacatggtgaaaccctgtctctactaaaaatataaaaattagctgggcacagtggcacatgcctgtaatcccagttacttgggaggctgaggcacgagaatcccttgaccccaggaagtggaggttgcagtgagatcgcgacactgcactctagcctgggcagtagagtgagactctgtctcaaaaaaaaaaaaaacatggatgaatgttttaaatgagatgttcctgattttctgttttccgtacttgaatttcaagtggtggtttctgaacttgcacagtttcaaccaggcactcaatcacgggcgtattccgagggaggggtttataggtctgtgctgggacttgttctgcacttctccaccctttccagggatgggaaagtcaagtatatgtcataacttatccctggggaaccccggagccttacttctgactcttctgcggcccattgcaggaaagcctgactaattaggaactggattgaatgtggggtggggtgggtttcagttcttagttacctgttcacagaagtgggaaggagaaatctgtctacattgttttctttgctggagcaaccatccaagggaaaccttttaaaatctttcccagaaaaagattttatttatgatggagaatactgatatttgtcagcaatttatgtttacataaaaataagtttaatgattaaaatgattgtcttctcctaatccagtcatccaatctttctgaagtttcagtaccttggggacagattgaccaacatttgtatctttgttcttaacgttccctaacggcatattttaaactaaactgatgtgaagctaacttttccttgaatttctgagaattctttgacttctgaggtagttggtataatacttgggctcttacaaaaccaggattgggaatccctgctgtggatctgtcatctttgctgtttcttctccaatattcttctccctcacagatgacctttcacccccctcaaggttttccagtttctattctttctcactctctgctttttcatttctagtacttcatagccaataagctcagcagttgttgttgatcattccctcaaggtgacacaaaacctgtttattatcaacatgtagtgattttttttcccattaagattggctacaaaataaaagtgtgaaatacgccagacatcctgacagtaaaggttagctcagttgatagtcattgtctgtcgcatgtctggctggaaaattggaacgtcggtgtttgctgcttggtgtgagtccagtttaaaaaccaacgatgaccttaggcaatggcaggattccttagcggttgcttgggtcacaagcctagacctgaaagtaccctctaaactttctgcattctcattcctgtagcagctactgcagccaaccaaatccgcgccccacccctgacttcccatgtggagccgggtgtgccaggtatatgtcacaaggccatgccccgggacgggcagcatcacatggccttccctgacccaccctttggctctgtctgtcccagcccttctctagagagtagtgtcccacttcaggtcaccagctgctctaggggcagaggctaccctctttcatggatgctaataacaaagaacaaacatctcagaagggaacataagaaccgcattatttggcttttctgatgttgggcagatcagtgaaggatgctgttgtgctccagtcactgacatttttcatagaacattaccccaaaggacacagaaatgattccaaaaaatgtagaagtctttgcctagtaggtcactgcaaagtgctaaaatctgaagaaaggaagagcagttcataaatgcttatcttcacattgttcattgggctgccctaacctcccctgctcccagagaatgccagatggctttacaattgaggtggttcaaacacagaaggccctttttccttttattaattgctcagctatgtgtacattggcccccacacctgccacctgaccagcgcggcttctgcctccctcagcactgccagccgggggttttcttagactcatcccctgggccaccttccgctcctctccctccctctgcattaacatccaggccaccctcattactccttggcaacctagcttgggttggcctccccagccagccttccagactattctttctctcccttgcagcctgtcttgcacaccactgtggccaggtcagtctttctgagaataccatttcctcacatcatggccctgtttacaaagcagtttcccatttgcctatcacatcagatcaaatcagaactcttcggctctggattgaagccgacgccactgttcctggcaagcctcattgccctccgatcccggcgttggcctccgtccctgtcaggtcttgtacgatgctgctctctgccatcctgccgtctccagctctgcctgcatgttggtcctgcattgctctccacctcacagactcttattccacggctctggccagtccaaagcatacatggcccagttagttcccttttacttgaaatattccctgaggagcccccaggtatttttccttactcactggagacttgtagtcagggccacactgatgtcatttgggaattatttgcaaagtcacagatctggacttctctctccagctaaatcatgagttcctcagctaaatcacgggcccacagttctgcagcagctggtaaacacttttagtcacggaaggaagcctttttcggttctcagctctgccaaggaacttatttcacgtacacaaaaccacaaaccgtgagaggattgctgcctgtatcctgttccccctcatctttttttttctttgaaaagatggtaaagctgattataagaatttaaataacgtggccctagaactacactctgactctgatccgcgtgtcctgcccacagcaccaggccacgaagacagaccatgtcgctatcctcacatttgcttgtaacttaggaggcttgccagtaaaatcgatactaacagtggacgtacttctctttgaataagtttattctatttccttctcccattttctttatttgttgaaaagaatgatgctgattgagaagccaaatattgttaaccattttccccgtctggcacggttcttttgcacagcactggattaggccaggggactggcctaaccctgcaaatatcaggaaaggactcttctagggaaagtcgtactaatttgaattgatcactagaaatacatggtctccacctaaaagatgctttgtcacttaaaaggctgagtagtcatcataatgtaaagaaacctctattgtcatgcaaccatttgcacccagacattgtgcctggttggcacttaacattttatcacttgattctcacaccacccttgcaatgtgatgaaaccaaggctcctaggtgctaagtgacattcccctagtcacgcagcctagtgctagtcacgcagcctagtggtagagcgaggattcaaacccagtttttgttttcctttgagctggagctgcaagaaaaaaaaaaaaaaagaaagaaataaaaaacaaacctaggtttgactccaaatcctgagctctccactgtgggccatcgtagcctttttttcctctagtatttttgggtggttttcaagggctaagaacgatcctcataataagtcagtgagattaccgcacatgagaacagcatgtctcagcctctgaggcgagccggtacaagctccaggttctgtgataacacctccctcctggtttgagagcaactgcctaaaggaggcagtggaggatcatcctcacccttcaggtgctagcccgtgtcagtggggtcttacacaacctttgctctgtgttgttgagtcttcctcagtcagtaaagtgacccatagattatattcagtaagacaccacgttatgtgcttagagagaattaagccagtgattaggcctgccagaaactggtcatctcgctgaacaggtgaaacggatgcataaagtaacagggccaggctggaatggtgtggacaggaagtgctgcaggagctcaggtgagcgggagacctcaaacttggggcagtttgaactgggccttacaagatgggtagggtttgtaaggcagagagaaagaacattcctgaacaaccatgtatgaagtcattgaaggtcaatgagaaagcctgtttgttgaaacagggtgtgtggacaaaattgacttgtgagatgtctgtacagaggtgacgccaaatcatggatggagttatgtcttgtgtcaggattttatctgagagaagccactgcccgtgtgaaagttctgatgagaacggtgttccaagaggatgattaacctgccagcactgtgtgagttggggcagaagagagagtctaaggcaagggagacctgggaggctgttacaggggccagatgtggggtgtacctgaccccccagtggtggctgaggggagacattacaaagaaagcatctttgttatttaactggatattctaaagaaagtggtaaatgaggagggagaagtcaaagatgaccctgaagttctgagcctaagtctctgaggatgctggtaccattgtctgctgtagcaaaatcaagatggggacttcccctgggttaaaagagtttaccattttccttcaatctgtatggtggcttattctgatggaaaagaaattacttccagatcaacaagacaatgttttccattaagaagtgttctgaggccgggtgcagtgtctcacacctgtaatcccagcactctgggaggccaaggtgggcggatcatttgagctctggagttcaagaccaacctgggcaacatggcaaaaccttgtctctacaaaaaatacaaaagttagtcaggtgtggtggcttgcacctgtagtcccagctactacagaggctgaggtaggaggatcgcttgagcctgggaagcagaggttgcagtgagccaagatccaagattgtgccactgcactctagcctgggtgacaaggcaagactcctctgtcttaaaaaaaaaaaattgttctgagaattacctcctcatcaatcgtgaacttagagcagtagggcatatcacatagtgatcctaggaaactgctctcctgggctccaggtcatacagcccagtgtggtagaactactgaatttactctgtgcaataggagttggaatgacccatagcattctaaaaattggtgaagtcttcattaaaatatttatttattggccctcagtccagatgacccaaatctttattattttcttcagtaagtgatgttttagggggaaaaattttaaaccacccttttttggtaggggggaccactactctcttgggttatacttgaatttcaaaacaggatggtgcatatttttataggcctactggctagaagtggtacaaacagatcttcatgagttataagtgccattgaagtgtggcttaaatgtaaataacggtttggtgcctgataatttaggagatgaggtgtatgagtcatgtggtggtttgttttgttttgttttttccttttcctgaccctttttgtaattttatgatgtcccacatcagttaaacctggcgggaggaggacccaacttgtttctgccccggtcactgtgcttatgtggtgtgtgtttgtgaatttaggattatcgagattgcagcctgtcactccacacacacgtctgcggccaagacgcagggtgggcacgtgtacatgtggggccagtgccggggtcagtccgtgatcctcccgcacctcacccacttctcctgcactgacgacgtgtttgcctgctttgccacgcccgccgtcacgtggcgcctcctctccgtgggtaagctggtcactgtccatttgggggatggcctgaaaatctgggaaagagctcagggctttactttgataatgaggattttgttaggtgcactatcataatttatttctctctgatgggcttctacaaaagggaactaattttattttcttcagagcatcagaaatcaacaccagtactaaactaaaagtaattttatttgactacttttttttttttctttaagagagaaagatgaggtcttgctctgttgcccaggctggagtgcggtggtgcaatcataactcgctgtacccttcagcccctgggttcaagcgatccttttgccttagcctattgagtagctgggactatacatacccattaccatgcctggctaatttaaagaaactttctttggaggtggggtctctctgtgttgcccaggctggtcttaaaccgtgggcctcagaccatctttctgtctctgcccctgccaaagtgttgggatcacaggtgtgagccattgtgccctatccttatttgagtgctttttaattttactgagaaactgttttttacttttaactagcgtatttactcaaatgtttaaaatttcatgcaaaattagtgatgtggcttgggactttttcttgttattttgccagatttataagcagatatttgtgagattcttattcttaatgattacagagatgcaaatctgtcttcaggggaaaaaatccattgctcagttgctcagttattttgaggaattggtactttcatgagtaccagtagagtagtgccatatcctgtcctgtgtgttcattatgtctgtagctaactctggaagcatttgcattattctcctagaacctgatgaccacctcacagtggctgagtcactgaagagggaatttgacaacccggacactgcagacctgaagtttctagttgatggaaagtacatttatgcacataaagtccttctcaagattcggtaaggaatcatttatttgagaattgagaaaagtaattcgttcaacaattatattctaagtgtccaactatattaggcacctcagtaatcaagaaaaattgtaaggctgtttttgctcttacaagcatacagtggagcggggagaaatatacatgaaacaagaaataacacaggttgtgtggttccgggaaccagtaccataggcgttccttaggcttgaaaagtggcgtggtcaccttggcagcagggagcagccagcgcacgctccaagtgtgtcctgtgctctgaacactgtattgatacttggacgtccatcagttaccgtttctgcctgggaatcaagctcagctcttaataatcaccttcttataatcacttgtggcgtacttttagatggtttaagaaagagaagatcaaggcctttccagaccaaaaaggtctatagtgaggctagcacagagattttaaaaaatcacatttgtgaatgtttttgagcaatgagctgtgtgcatttcaaatgtgcagtttgatgagtgctgacacatgtctacgcctgtgaaaccactgccccacatccagacagagaacattcccatcacccttcaaagacccctcatgtcctagccctgggtgaccgcagctccttctgtcactgtagctgagttagcattttctagagtgtatttagatgggatgatacaggatgcattcatttgtgcttggcttctttcttttacatgatgattttgaaattcattatgttgttgtgtaacagatatttaaatcctactgcagtgagtcacacactcaacacagcattttagtctcaagttcctctttagtaagatcaagctgtgcagcgtttgctcactctctctatatcacatcaacctgcatgaaagaaggggggtggatttgtttgctgtaacacagtactatggcccgggtggcttaagcaacataaagttctggaggctggaaatcccagatcaaaagtgtcacctggatgggtttcttgtgaggctgtgagtgagaatctgttcctgcctctttcctagctgctggggatttgcagacagtctttggccttccttggcatgtggctgcttaactccagtcagcatgtggcattctccctttgtgcatgtctgtgtccaaatttccccccaccttattttttttagatggcagagtctttctctattgcccaggctggagtgcagtggcctgatctcggctcactgcaacctcctcctcccaggttcaagtgattctcctgcctcagcctcctgagtagctgggattacaggcgcacaccaccatgcctggctaatttttgtatttttagtagagatggggtttcaccatattggccaggctggtctcaaactcctgacctcgtgatccacccgcctcggccttccaaagtgctgggattacaggcgtgagccaccgcgccctgtccaaatttcccctttttataaagatgccagtcatattggattagggcccaccctagtgaccttcttataacttgattacctctttaaaggctctctttcctagtaaggtcacattttgaggtattggccattaggacttcaacacaggaatttttagaggacatcattcaacccgtaatggagtgaggaaacagaattacttagattttataaaaataaacccactgatttctctaaatgctgacagtggttgtggtgtgagagagatgccagggagcccagctctgtccccattagcacggccattggggctgcttcccaggccacccctggcagcaggtttgtatatacagccttgctgaatagatgattgtttgaaaaccctggccagcaaagaaagtgaggagccacagcagggacgtgccagcgtgcaccttcgagagaagaacgtggtcctcacagaggccatctgtcctggctgggaagctaggacctgacatactgcttttttccttcagatgtgagcattttcgttcgtcattggaagataacgaggatgatattgtagaaatgagtgaattttcatatcctgtttaccgggccttcctggaatacctatacacagacagcatcagcctttctcctgaggaggcagtaggtaattgccaaagacttccaaaaacttggcaaaatgttgaggaactgacaaggtggtttctatagaacctaaaagaaagtcactgtgagggtaattacagaagtatttctttttgtgtgtgttgaatccaaacacgtttcccttgttactactttattacaaaggttgactggacagataagagagagaagaatcaaatcatcaccaccgtggagcattgcaggcagcagcatggaggaagggacagagactgagggccatgcagcagatccccgtgtctccaccagcagggcccaggaattccacttatttcagactgtgggcctgagtcagtcaagtctgtgcccagtggcttaggaggctgggaaaatgggcatttccagagggccgtagcttggctaaaaattctgtggtttcagtagaaaggaagaatggatgtgtgtgtgtgtgtgagagagagagagagagagagagagagtgtgtgtgtgtgtgtgtgtgtgtgtgtgtgttggggtgggggtcgggagagaggcaactagcagcttctgccacaggagagatgtgatctgtgtttaaaacatcagttattatattggttcaggtgtgagatgatggtctcctgggttggggttgtatagcagtggaagtattgaaaagagatcagattctagatatattttaaagaggttgctgatgggatttgttgatagatgggatgagaggtgtgagttgagagagaaggatggctgcactgaggtacttggcctgggtagctgccttaatggcactgaggtgaggaagatagagaacaacaggcttgctctggactttgaaagtcaaaggagtttgagcttcccattagatacccaagtgataatttttttttttttgagacagagtttcactcttgttgcccaggctggagtgcaatggcacgatctccgctcaccacaacctccgcctcccggtttcaagcgattctcctgcctcagcctctcgagtagctgggattacaggcatgcaccaccacgcctggctaattttgtatttttagtagaaacgaggtttctccgtgttggtcaggctggtcttgaactcccgacctcaggtgatccgcccatcttggcctcccaaagtgctgggattacaggcgtgagccactgcgcccggccgcgagtggcagttttttatcggcccaccactaacatttgtggggctgtagccaagactccaaatggagacctatgttccatatgtctaaaaacttaaagttatatgtcaagctagtgaacttcagataaaaatatgtccaatcctcccaccttgaaaaatgtaatttcattaagaactgaaaggacaggtttcaattttagttgacatttagagttgcaggacttcttgtgccagaacccaatggcacaggcaggacagacccctcctccagcagaagggtgtgtgggcaccctagcttgcattccaagctctatccacccccaacccaggttacccttttgggccagggggtctgcacattggtggtggggtctaagggaggaaatacccacacatgtggcctcaaggccaattatgcaggcagtcccaggttcccaggtacccaaagtgtggtctagaagtgggcatgtggctccttagccaccctgtgctgaaggtgtgcgtggaggaggcgcagagctggggcttggggcagagtcctctcttagggcagtgcagcttgcatgtgtgtctgaagcttggggccaaaaacaatgaagccattcacaactcaagatttcagtgtcctccagtgggctatctgtctttcctctataactttgataatatttgttattaaaaaagcaagtttccaaccaaagtctaccacatgtataagatttattagcagatagacacaaaaacaattaatatggtaaaattgatgaaatccctgctctttatacttcgtacactctattaagtaccttgcatgaaaagttagcttgaggtggacatgacagtgttctagtagccggattcagctagccttttgatcctggctaccactcatttcagcaatgacaaactaattctgacattctttatgctaattacaaatcctgtaatgaagattcagaaaaacaaataggatctttcagatgctgattgactgcttcaattagagtacttcctatcattccttggggtagattaaaattaatttacatatgtcacctcacccagtctacgttgaattacttgaaaataggtgacaggtaatataacaggactcacctgcatatatagatgatatttaaaaccctggggctggggttttgggaagtaagtgaggaaagtgtctgaggatttaaccctggggcactcaaacatttggaagtcaggaaaaatgatccagcctagagaactgaggagcaactaattaaagagaagaaaaatgcaagcaagtgacaaagtgtcctaaggagagcattatcaaccatatcaaattctgtgtaaatgtcgagtaagaggaaaccagagaatattgcaccctcaaagccactgtgactgccacaggtgtgaccaccaagggtgtgactgcagtagtggtggggatggggttctgcttgtaatggcttgaggtcagaatgggaggtgggaaaatggagacagcagatacagatagctctgtctaggagttttgctgtagagaggagcagtgggatagggtaacaggaggaagacacgtgtccatgaaagggtctcccctcccctcctctcccctctcctcctctcccctcccctcctctcccctcccctcctctcccctcccctcttctcttctcccctcccttcccctcccctccctctcctgtcctctcttcttttcttctcttttgttttcttttcttcttttcttttctttcttttcacggcgggcactcttacagcatgtgtgtgtgctcctgggagtggcccaggagaagctgacattgagattgcaggggaaggggtcattcaaggcgcacatgcttttttcctaggaaaaaaatattaaagctattttccctgtgctcctgtttttcaacagctaatgatttgtgtatcatgtttgctcagcttggctgccatcctgggtagagccccacactgaagtgtaagtgtcagtcagcatcagtctatgcagtgcttcactgaggattatatctaaaatagtgtcaaaatcatctctgagtggctgagtgagcaactgtaaatcaggatgcttgaaatcactccccctaataaacacctctttccgccaggactgctagacttggctacattttatagagaaaatcgtttgaaaaagctctgccaacaaactatcaagcaaggcatctgcgaggagaatgccatcgctctgctctcggctgcggtgaagtatgatgcacaggtaaggaaagcttgcttccagctgccggcctcctggagaaatggaacccaggtgtctgcctcgtaccttaaactaaaagaaagtctgggtagaggaaatatttaatattttttaaaaaatgaagtaacaagagtactagacaacgtataagcaagtatttatataatgttgggatggacatcaaaggcagaagccataaaggatttatagctctgatttaaaaagataagaaacttttatccacttaaaaataccatagagaaacttacaaagtaatgagacactgggaaaaatacttgcaacatataatgaagtctgtttaccagagtgaaaaacaaaaagacaataggaacagtttggttgaaagaaatggaccaaagaacaaatggctctataaatagacaaaaaacataaatgaaaacaaggtataacttttcacctgtcaaagcaggaatatatttttagagataatgtataggatcagaataatggtgttctcctaaactgctgatgagagtacaaattggtatggagaacaatttggtataatatgtattaagcaccttaaattaaagacataattcttcaaggaattcactcacaagtatttatcttgaggaattaatcatggatttgcacaaagacttagcttcaaaggtgtttacttcagcagtttataattttgaaaaatcagaaaaaggttagtgtgaatagtggaggcttgtttataaaatgttaatatcaagaaattatgcagctattcaagatatatcactaagtgaaaaacttatcctatttttattttttgaaaaagtataaatagctgaataaaaaactaaaattcattatctacatagaaaaaaagactgaaaactatgcttagtggttatcattgaatggtgggattgtgggtgatttttattttcttctctttgcttatttttttttaacttttacagtgaccatgtattgttatgataataaagaaaggaaagaaaaccaatcttagaaccaaatctttaggaaacaggctgtaacatcttcgagtcagtttccttttggtataaggatatcctctcctttggtcaaagaaaacagagacattttagtagatgaaaggttataactttttttctgtttacataaataatactatgcttattaaagaaaatttgtaaaagacaaaaagtgaggaaggtaatgactcatcaaccagagaacattagcactttcatataacagcttctgagtttttgttttatgtcacattatatatttgtaaatacttgaaacctagattttttttcacttaacattaaaaaaaaagtactacctcaaaacaatgacatttaacagcacagtgaatgttttatatcaaggcaataacatattgggcacttacaacacagaatgtttcatggtcagacaaaatccatgcacttttcctagtccattcttgagcatcacagtgatgagccacggtgatggagggccatctcagatgtcaagatggtggcacgtggtgtttgcatctgaatcaggcttcatttttaatacttttttatattctctatttatgtgaattatttgtctggctaccttccagctctctgttttctagaaagtaagctctttgaggcatggcagggactttgttttgctcacaaccatatccccagcgcctaggacggtgtctgacacagagtaggtacctactaaatacccctttcatggatgttcagttttgcctatagagatgcactgttgtactacagcctgtccagctaattgctgtaccctaaattagtataatagactataagtaaaatagactgtatatgtacttaatgtaaaatacaagctttcgtaaataaagaacagtgctgtatttgatttgcctggctcaaataagcaagaaatgggctctttcagcaaattattatccctcatgctggactgtcacttagtacataattaatatgagccagggattattctaagcacagttcatgtttcatttactcctcaaaacaaccttatatgacataggcattattatattagatccagtttataaatgagaaaactgaagcttggaaagattaagtaatctgagtaaactagtaaactgcaaaactgggatacagtccaagattgggcacattttaaaaccgcatgtttaactacaattctccattgtcctcagtattttgaaatcaggagtatttatgcatggattcaacaaatattcactgagtgcctgctacatgcctggcactgccctacgcactggggtactgcaaatgaacaaaacaatccaaaatctctgctctcatgggaatttctggtgaggggagataggtgatcaataaatgaataggatatatagtatgtcagatggtgacaagtgatatggaaagaagtaagacagggaagacagcctagggaatgccatcctgagatgaaagttgaaattttaaatagaatggtcagggaggcaagacatcagtgagcaggtgactcaagcagagacctgaaggaggtgtgggtggtgtgttctgggaaaagcaagcccggtgtggagggagcacagtggggagggaagtagctgatgaggcagggagatggtgcggtggaggtgcacagtggcgtgtgtgggaggaggcagggcctgcagagtccataggcaagtttcaggaatcagagttccaaggtgagtggccatcagagggtttggagaggagcagatatgatgggcatttgaagtaatcctcctgcctcctggctgctgtgttgaggagggagggagggaggtagggagagagagagagggtgagagagagaagagaagagagagagagagagagagagagagtgtgtgtgtgtgtgtgtgtgtgtgtggagagagagagagggtgagagagagaagagtgtgtgtgtgtgtgtgtgtgtgtgtgtgtgtgtgaaggagggtacttaggaggctgtataatccagtaagtgatgatggtggattggtccaagttatcacctgtggggatggtaaaaagtggttaagattttgaatacattttgaaagtagagccaacaggatgtgcggatggattagatgtgaggaaaaaaaagacgactgaggaggttctgtccctcagcagctgtaaggatgaaagtggcatctattgagatatagaagataggagcaacattttgggggaaatatcagaaatttggttttgaatatgagaagtatgtgatgtctattagacatccaaatggaaatgtctaataagcaaattggataagcaagcctggaagtcagagagaaatgtgctgaagtcaaagctatgaggcagtgacgtgagacaggtttgaagattaagtcctgagcactctgtgcttagaggttaaggagataaggagacaccagcaaaggagactgaagaggagtgagcagtaacggaagagagaaaccagcagaccgtttcctgcaggctgggaaagaaagcgaaacaggaaggaagaagtccgaaccacaccagatgctgctggcacgtctgcacgaggactgagaactgacgagtgggtttggcgatgagaacgccggaggggccttggcaagcagttttagcgcagtgaggcgggaagtctgatcggagcgtggaagtagaggaactgaagatggggaatagaggcagcttttcatggtaattttattataaagataaaaaggaagagctttggggcatttgaggtaaaacatctttacttttttaagatgtgggaaatggaagcttgtctaatgatgcaaatgactcagtgaaggggaacaagccagtgatgcaggggacagttggtagagcagggccccttagtaggtggagcagtgggatctagtgacagagcaagggctctgctttctatagggtcttggacctttgatccagagaagattgcatccacaggcctctctgtaataggcaaggagacgtggtggggagagcttgtggaggttcttttcaagtgattctggttctcagtgaaataggaagtcatgtcagctgaggatgaggatgagaggggagatgtcaggcttatggggagaagtatgagagtcctgtaggagaatgagcaaactaggagaatgtggtaggactgcaggacagaacagagggccccattttgaacatgaagccatacagagtggtagcattcaaaatagactacaattctttaactgaaaaataatgggggccttgttttctatggacagaattcccctataaccagtaccaccaccctatgccaatttattgaattcttagaatcacaggaactctttccaagtcctgtccttaatttagtatttaggggaagatcccactctagaataaagtaaaggagcatggatccaagtgataactttttagggtcctttcattctcccattaattagcaattttcctgatgctgtccagatctgtgaggcatcaaactgcccagccacctaactccagacacactctaatgtgtgtggtgtaggtatgaattcctccattcctctctgtagacttcagccaaagagatgatgcatctctatctggtttcacttttgtgtgctgtaggcaaaaatgtcatttctaaaaatttaagcaacagcacataattttaaatggactctgagatattcagcatgtatcattgaagcacatttttatgtatagtatgctgtgatgacaagtgggtgtgtgaattttccctgtttatcactgagggcttacctgggacagagacacatcatattgctggtgtggtaccaacagcctgcccagttatcttcaggcatgaaataaacattttcctagtatagtttctttcttttcttaaaagaaaatgtaccgtaggtttatatgtacattggcaaggctatcagcattgctattttttttattttttccatcttcagcatttgctataatttatgtctaaagaagaaaagactatcgtgtgtaatgttcatatgtaattgcttagaaagtatttggggcttttattttttataaattacctacagtagcttggagaggaaacttttaaaaattgaccaccacctagcagcatcttgtcctaggccaagtagcctagggtttgaggcatattggaggtctcagcaccctgccctcacttctccagggccaaaaagcatctggtcagcctcattctgattttcaagttatagttctaatcaagagaattattacagcattattctttggcccagagtgcattacagtaagccagaaaacaccaatctgttgggtctctcttaccagagacttggaagtcatgatttctttaaagcattttcccagttgagattattgaaggcatatgtagtgtgatcaaatccatccatcccatcctgtgtcgtctcataaagagaaaaagcggtggcctgttaatgacttcagagcagcaatttcttggcattactgctttttatggcttacctttttcttccatcaactctttataggcagacatacttaaagacgctgatataaatataaaagaggagtatagggcttttaacaattattgaaagtgaaatcaacagttacaaatactgtcactagacaaaggtaccaaggaattcacacactcacatgcctatctctgggaagaaaaagttagattctttacctaggttagtgcggaggaacttgaatgttactctgtgctacttaaatttttacaagcatagatgattcatacttgttatactttttatgactattctttaggtattaccatgccatcatttcctccacttgcctattaaatcctttttctttgcctaacttgttttagcgattttcatgctatgttgcattgaattagtaaatatgaatttattaaaccatctttgttgttgttcctaggatttagaagaattctgcttcaggttttgcataaaccatctgactgtagtaacacaaacatcaggttttgcagaaatggaccatgatctcctgaagaactttatcagcaaagcaagcagagttggagcctttaaaaattgatcccatctgcaggaaagtttttgagcctttccatttcccctgcaaaagccagagatgaatcacttctctttaattaatagtatgtatgatgagctatgtttggctgagtacttgtaactgtcagaagaaggatggtggtgagtggtctttgtctgcctaaacccagagtttatgtagaaagcattgaatgttctgatcagatgtgactaaggtcaaggaaaaaaaattgaaatatcttatttaccatttcctctttttgagtcacttaaattggacacctttggtaccctggtctcagtatatgctattctggcccaaatgttccattattcagctggctgataccacatagatagcttgacaaggagtgctgtctgtccttaccacattttcagcactcagcacagtgccttgtgtataataggcactcaatttattataaatcttcagtatgtcctgagaacagctttagtcatggaatactgggagaaggaataactttcacaaaataaacttaaaacagcctgtaattattgaggttcatattcttctggtatatcattctgagaaattgtggctaatttagaacattgtttagaattgacaaaaggccctggcaattaaattgtcaaggcccaagggctaattttaattttctttttacttggagtcattcattaatttctcacatgggattatggagtatgaagtattatctttgaatgaaattcctgggctgatctgccttacataatcacataaggtcctttgcttttctttgtgttaagagggacttgcctctgtaaatgaaaatgacaatgtgcttttcttgtagttgactttcatgtcactcactataaaataggtctcttaacctggcaccagtataactataaagcactagctgagaaggaactgatacttacatttcatggacagcattaacaagaatgagataaatttgtactttttagatcaaaacaaattacctaattgcaaaagagaaactgaaatggaacatagtctcagattcttctaatgtgtatctcacaatgtcatgtaatgtaaaggaaacccttttggaattagaattcttgttctgatgctgaactatttggtaataaagtgcttatttgcagataacag

SEQ ID NO: 36653 - DNA, 165003 bp, Homo sapiens
atgggatgtactctgagcgcagaggagagagccgccctcgagcggagcaaggcgattgagaaaaacctcaaagaggatggcatcagcgccgccaaagacgtgaaattactcctgctcggtaaggaccgccgctgctacccccatcccccgaccccggccactccgcaccccctgccaccagctcccccaccccactcgcgcccgggagacctggtccccaagttggcaccaccatgtgcccaggatcgcccaccccctcgcatgccttagtccccccctccccctgttcccttaagctgacactcaccagtttttccccactgtctgtgtcccaacaggggctggagaatcaggaaaaagcaccattgtgaagcagatgaagtaagtccctgtggcattgggattcgtacttttattaagaataatttttaaatcgtttttattacattgcttactccacattgctctccaggcctgttttttaattcgtgcacacacacacacacacacacacacccctatatttgactcccctcccccactccctacgttggttctgggtcctccaccctaactcctgggtgggtgttttttgggagggggaaggggagcgcctgtagttgtatgaatgacagtgtccgccatattgatcagaacatcacactattggcatgattatgatcattactcttgcttgtggaatattttctgtgtctcactgcctccatttctgtctgtgtctctgtttcattctgtctctatttctttctcctcttccctccatacctccctatcccccaaggtccgtaatcccacttccccctgctcttttcctggggcagtgattttgaacttggctaacatggaggggacccagccctagactggggtggaggatcaagtgtctgctgttcatgcgtttggtgctgaattggaggctgtggtttctacatcccctcgcaccccctcccccgcaaaaaaagagggccagggttaggggaggggtcgtgtgctaggggaaggagtgggtttccaaacgtaggtgacgggcacagttttatccaaggtagaggtggaagggggagggaagctgcctgtgaggctgaatgtccgccccttgctgcccccagctcctctcctcccccaccctcccagcattgctctcctgacacccgcagttttcgttcgctccgtggcctttatcagtgtatttatttacactctgcataggccgtgttccatgtaatctacccacaatgcggatttcaggccccacttgccgccgcccccttctgccttagctatcagtttcccctcctaattaactgggggtggatttgagtgatggttgaaaattaaaacaaaatgggatattccttcccttccacactttctcaataaggagcctcgcccctcctttccacttgcaggctcgcttcttgccctatccactcggcagttcctggtgatcccacaggcaggtttgcttggggagggggtggccggcagcgaaggggtgtgcgccctccgggcctcctgtttcggttggcctgtcagttcgagacggaggagttcgtttagaccgtttagcgaagattccacgtcgctttgctgtgacaccttcgtgcacacacagctcctaattaggggttgctgtgcagtaaacaaaaatgattatttttcaacttgacacaatagccgaaataattgcatcgcgtagggaaacaatggaaaataaaaacccctttcgtgggaaggtgggagtgggagacgaagcatgcttgcggtttcagaaccaagatgcaaaaaatcttggatgtgtaacaggcatgacaagcgggttctaggcggcgccatgatggtagggagtagcgactcggagacaattttcccatctgcttgacatgttcttatttttattcgagagctccctggggctttcttcgcagagccccccttggctcgccgcacccttctgagccaggggtaatttagcttggggcttctcttgagcttgtgcaacccaaattgatggggaggcggggcctggggaattgccctttgcaacaaggtgcatgttgcatctgtctggagcccttgcagatctgtaaatgcaagccgcgccacccctttctcccgaggggggacgttttaaaacttcagaagtctgtaatcagcagtggcggactcggagcccagtagaagccccagccacctgagctggatgaggtttcaggcgttgcaagtggtggacagcgcccagccgaggccggaaaagtcgatggggctcagttcggcgacgctcggctaggttcggtgcggtctgggcgcggggctcggagggagtcggcggtgttcggagccgagtcggtgctccggcggagagagccgagccgcttcggagggggtcgaaagcattcggaaatactcgggggaggggagtgcgcaggaggggaaggaggagggggagaggccagagtctgcaaattaactttgcatccgccaaagcaactgcttttcctgaacatgccccataaattaggttgatttaatgagaagtttaaaaatatatactgaatcccccaaaggggtgcctcgcctttttttattcaaagagagctgagctctctgaggaaataggtgtgccactttaggatgaaaattcctaattatgtactgggcaggaaatcttaaatgaaggctggatgtagacttccccaggaaagtcctctgtgtcttgtatttggttacaccgaggaggggggaaaatgaagtgagtgatgtttgagattgttaaatcagaaatcagagcatttcttctctttccctttacttctcctttttttttttttttttttccaaccttacaggacacctttttcaagaaaaatgtcaggaaaacagattttgtaggtaaaacaattttttttttaaagcacaatacaccaactctctttaggaagtagggtaggtctgttcaaaaggtccatcacaaaagtttctggttcctggtttgccacaagggaccctggcgtcctgtcctcctgaagcattcatgaatggcagttttccctgtgagccttccagcttggcttgaaatacatcagatcagggccttgtgccaagctgaatgcaggacttgttttgttaaccacaaaatgtgggattggtgtcactgtatcctagtaacaaatttttttgagtcctcccttgcagagatggtttttgagatggccacttgactgagagtcactttgagtcaggagaattctactgtggatggggccaggcccgaaaatctaggtggcatttatagaaagcagtttccaacttccttgtgcaatacaattggtgaccaacctatcaggccatatgtacaggttaattaggaagctgtgttgtttcacctggacagatgaaattcagcagaaagccctctttaggttacaccctgtgataacccagtgatttcctaatggggggctgcagtctaatagctcagcacattggattgagaggaagaatgtggatattcagacatcactgaataaaactccttttatttagcatttccagaagagcaaagagtcattccattgagcctgtgttctcatccttgttgtggtgtgctaatttgaagaaactggcttccatatatttccatagtaactgaagtgaaataataaaggaccggctggcaattgctgtttagaacaaagggttaacatcttcatcagcctaggaacattgcagagatactgacataaagttcttctgcttgataagtgttgtaaggggaaacgtgcatctgcttaagagataccagtttagagtgtcatttgaaaagcctgattctcagtacttatattaaaatttttatttgaacatagtgttttgggttcccccccccttgtgtgtgtgattgtgaattcgtgtgagggagctctgtgtcagacaatccaaaatatttcagtactgagaaataaacagtgataattgagacagcacaaatataattttatacataccatgtgtgagtaatcagtgactctttttttgcatggcattttaaataattttgcttgttagggggttgtgacctcacctgtgatacagcctcatcattttgtagtcagtcaataagactctgagttattcagactaatcagaaaatttttaaagaattgtcaattttatttaattgccaaacccttacaaagaaatcccataacaagttgtaattttatgaggtgtagaattgacagaatatcactttaagtgacttcccagttctgaacaaatagtgacacccacttggaccatgtacctggtgaaaatgtaaaatggactgcggaattgctctgggagccacagtttgccctcattcgaggtgctgaattttctgtaatgttgagttcaggctatctgtctctggagcattaagtggaatttttagaaagggagttcgaaggtggccatgaggcattgcatgctagctggtagtctttaccgaaatgggcacaataaaatcgagcactttggttgtgcgtccattcccacagtacctgcttagtgccattttaaaacaaatttaagaatttgcctgatgaagatgtcattgctcatacaaatattccagcctgacaagtgggatgtgattcagagaacagaccctaccctgtcaggaaaggctgtcttaaaaggtcacctgtcaccaaaaagctgatggctttttcctcccagctgaccctgactttgtaattagggtatctactgtttggtatgggttcagggcaagcttgcagtcttcacttgatcttagccaaaaggctgagaagcagtcaagcttgcattctttcagcacaatgctcttcagcacctactaaatgacaggcattaatggaggtgaatagcaacctacagccattactccatgaaagtgcgtccgtctaaaaggacatttcccacactggcccccagggtcgcacgttgggttagtattctactgagagccactcttctagatttgtagacttgttatttctgcagtcatctcaatggctgctttgcctccctcccttcgtccctctctatgtttattcaaatggatgcaccttgctctctggagacagcaagagtgcgaacggaatgtcagatcaagtagcagatgagttctcttttcctgatggatggtgctctctccctccttactgtgcactgagctgtaaataccagcagaccttcctgccagaagagtggcaaatagtccacccgatctcctcaggagtcagctgtggaattcttgagcctgggttacctattggattctaaagtagaacctatatgcttgttgaaaagggttgttgccagttagattaaatgggtgaagcttcatgagaaccaacatggctggaaaagaatgcagaacgtctgttctatgtgtgaacagggctggattagatttacgatgctcagagtgggagtgtgtcttgtttcttttaacacatggaactcgcagattattttgtgcttcttcacatgccacatctgctaaagataggacaagatcactcatgtttttcagctgctcacaataccctatctccgttaacactggagatttaatatgagtagaatgaggccctatttttccgatatgtgctcagcccatctggatactgggacttgactccctgtctcctagggtgttttcattctcatttcttatggagccagacaggccattatcaccagaatacatcttgatctgaaagacaacagaaaagctggtgaaggggtgattccaaactgaaaaaaacaaaacaaaacaaaaaaaaccacattttggaaagagttaccctcagaattgacactaatagagaaaacttttgattctgaaaaaagaaagtgtgcctgtttgtacatacccacagagtgtgggtttacaaatggcagatgttgagaagagcactcacctcactttcttactgattgcatcatcttaaaaagcttgaagatgctcaaatgaactccatcctaagaatttcttcaaatctgtgtcacattcttattttcttccatccctctcattcacacacagcattggtagaaaggaagctgtccaacagatctgtgattagcactgaggggaaggagaggagagagcagtggcttgttaactggttcagataaataggtagtttcttgtgtttagagaagcagtttagcatgcttctctaaaattgagagttggttaagagcatagactctgcaaacaggctgcctggcttcaaatcttggctctactgctaactaaatatgtgaccttacacaaggcccataacatttggtgcctcagtttccttacctgtaaaatgggactgataatgaaaataactactaataggattgtggagagcatgaaatgagttaacatatgaaatgtgctttgagtagtgtctagaatgtagaaatcattatacaaatgttagctctagtttttattcctttgattagtgggtgttcccttcccatgtggagttctcttgtcaagtaagtatgtgggacttagccaccctgagaagcagaaggggggtgctgtggttcatgttcatggcttcttccccttgcctgctctgcagcaccagttatataacaaactgtgttgtcataactgatgtgacatttttgatggcgcagctgcttcagcccaagagctggggtgacatttcaaagggtgggaaagagcactgaaccaggagtccaggtcagtagctctgcctctgcccctccgagggctcggtttcctgaaagagttggaccagggctaccccaggctcccttcctgttgtcaacggtgtatgaaattgggaattccctttgttttcagggtcttgatgttctcaatattaaagcatgaattatggttttatcccatgggggtgtagggtatccatgaaagttcttttaagactaagttaattgcagaatagcaacctcagccacagagctttgtcagccaggaaatttgtagttctgagagtcaatttgagaaaaacacctctaaccaaacttttcatgcagacatggttcttaaaccaaagaggaggatctgaaagtatctcattagtaagaaacaggatgtttctgggaggagagagccagtgacattagaagagaagtggtttttccgtggcttccaggatgctcagaagtggagacagccctagcgttcaccagaaatggctgcatatgaagaaacttgcctgggttaaggtgcctaaaacccagggagcagagagatttgcagactagtaaaaggggaggctcaggagaactgtattttaattttgattcactctctcatttaactttgggcagatcatttggccaccctgggcctcaatttgttcatctgttaattgggatgtgggttttcaccatagaatttctcagggctctttcgggtttccagctctaagatgcagtaaatgcaaagagaaacttagaagcctgaaaggcggtggggaatagtgggagtatttaccacccacagcttttatctgctgagccatctttagttctaattttctttacagagaagaggaaaaacattgtgcttttcatagcaccaaaaaattaaagtaaaataaaatcttgcaaggctaatagttggtgccctgaatttggccccttactctcttgatttgtcaaccatcctagaaataagtagaatggagaaaagagaaagggagaataatacataagactaggatttcatagctaacaatttaccttggattctctgcctgtgtcttagccaacagataggttttctgtagaatattgttacttatgagaatagcttctccatgctttaaaattgatcctggggtcacctgaccccagggtctcagagcactaatgcatattgcacattgtgaattaattaggtgtttatttgtctgtatcccttgctagcctgggtgtcccttcccaccagggctccctgaagcaaggatgttacttatttttgctcatagtacagcaccatgcccaatgcctggcacaaaggaggtcttaataaacgttagttaaagaaaaggaagaatacgaggtatataaggaatgaaccttattattctccataaaccaaaataatcatgttgaaagcttttggtggccatggaatgtgttcatcattttcaatctattatattcatttgtttatcaacctgtgagcaaatatagtcatcaattccattttacagatgaggaagtgaggttcaaagaagtaaggtggcttgctcaaggccacacagcttagtaggtgacagtgttgtattcagacaatgatttgtctaattctaaaacctgtgttcttttcgttgtaactccacacctttcttactagaccacccccagtatgggcagtagagacctggcagtctacgacctcacacccagatgttgatggtgccagctgtggttgaggtcagtggctgagagaatagaaagtgcctaattggtgctgagttccttctggaggtggtagtaatggtcatcatatatcacattgatttggataccagagtattccctagcaaccatctggacaggccttgaaatgatttttcattaccgcctcaaaaatgggggccattttcagattgcaacagagagaaggctctggctttggtggaggcaggtgtcttggagaactatggaaagacaggatggtaggggatccatccatctgtccatccataagcatttatgattgcctattttgtgggtagcatacacacagtgtcatggaagtagagaggaaggcctcagtccttgtcctgaaggaactcatggtctggagggagctacacaaaaaagactcttgcacttcaggtaggaagggccacaatgtctgtatacacagtgtgctatggtagaacagaaggcaccttctctaggcaggaagttcagggaagacagccaagagacaatggcatgtgaactgagcctttaaaacaagtggtagttcaccaggtcgaaaaaaaggaatgccaggcagagggactggcatgtgtaaaggcattaagatgtcaccacatggaacatgctaggagtgtaaaatagtttgatttgactagagcaaaatatgtaagaggagtgttaagaaatgaggaatgaaagattggacagaaaccagatcatgaaaggccttatctattgtgctaaggactttggattttattctgaagataatgagatgccacctgagggttggcattagatcacctacgtagactggaggagatcagctctggaggttgggagaccagatggaaagttacttctgtgacccagttgggaaaaagattaagaactaagttaaagcagtggtagtgtgggtggggaaaggaaacagattcaagagatatttgggcagtggaataattgaacttatttgttgatcagttggaagagcattgaggaggagataaattttaatgagtatggacaaaaatgagtccaggattcctggtttgggctactggtggatggtagttaaatgcaggaggaagagagaagacttggggagaaaagtgatgactgcatttggtcatgttgacgattcttgtggatcatctgagtgcagctcctggtagtgggtcagataggacacacctggggagaggggtcaatttgaaattctgtggtgcttttgagtggcgagagccatagaagttggtaaccttagtaggctgagtgagaaggagagagaaggcaggcatgcgtctcccatcacacacacattccagctccaggaaatgagaataatttaggaagaggaacctgtgagggaaactgagaaggggtgatctgagaaatgaaaaagaaaacccaaggcagagtagcatcatgaaagccaaggaagaaaagactttcaagggcaggaagtggttagttgagtcagatatttcagtagacaaataagatgaagattggcaggtgtccatggagtctggcaagttgttggtgaccttggcaagagcagtttcaatagactggtgggagaaaagccaaattgcagtggagttaagaaatgtgtgggattgaggaaatccatgaagaacccccctcccagcccaaaagaaatgtgggctacagaaaaaaaggagtgagaggtagggagggagagagccctcctggaagggctttgcttttattgttcatttctacatgggagtagctggatccattgagaagttatccagatccctgatgaatggaaaagttgaaggtataggaaggaggaagtggtagaaggaacacaaccccttaggggatgggtagcttgagcttgacatgaacgtgcatctccttccctaagacagacaggaggacagtaaggatgggaagtctgtagagaaattctagggcataatgatgaggacaggaagttgagggagctcctgccttagcatttcttttctctgtgaagtgagaagaattaaaaagcagctgtgcttatttactggagcaccaaagaccaataacatttattctattaaaaccactcatttattcatttatctaatatttgtctcacacctattatgcattaggcactgttctgggtgctcggagtgtcagtgatgaacaaatcaagtcccagaggaaccgggtaataacctcatacacaaacaatcggacgcagtaattgcagactgaaagttttttctggggttacacctttaggggaggcctcgtactgatcacagagggatccaatttctgccttcagagagttgcaccagttggaggagacaaattcaattctcaaaggtgcagaagaagcagtgatggaatttaatttggacacaggctcaggattaagctgggagggaactgggtggagaagtgaaagttgcacagacactgttgttttactccaccgagctttactcatcacaggctgctccagtggggctgccagtcactgccccctgctgcttgaagagagaagtaggttcatgactcaggccttgccattcacagcatctcattcctctggccacagtgattggcccagggatgggcatgtgactcaagtgaggccaatcatcatccttctctggaattttatagtcactatgagaaaaaagctcttttccctgggatcccagcaaggtcctcactgggctggaatgatgaaagcttgagctagctgtctgtggccatgtttccacatctcaattgccctctgcaaggaggaagcgtgcttatcatgggagagactgaggctttgggagactggaggacaaaagagagaatggagagaagaaacacaaagagagagggagccagaaagacatctgatggtgatactggtatctctgaagcaggttctatggagctgacagttatgtgaatcaataaatctcttcttttacacaaactaatttgagctgggattctgtcccttatgaccaagatcacgctgacgaaaagcacaaggccttccaggatctgaacaactagtatgagctaaagtacagaagtaggcctggaacattcaggacaccaccagggagtagtgggcaggctcatgtggctgaagagctggggtttgtgggaatgtgaagagaagtgactggaaaggaagagtagggctagattatagggttccctgatagtttttctaaggggtatatagggtgccaagtcaggagagcctaccagtaggaggccagagatgaggctttagagcaaagagatttctgtagtctgacctaaggaattggtaggaaaggcaatgagaagttggatgggggagagattttggaggcaggagagatgacccctggtgtctagttgaatgaacatgagaaggagagagtatatcagagaactcctccccattttgaacctgtgagatgggatttagttatgccatcaagttaggaaacacaggagcagggaagagatagcagagaggatatggcaggtgaacccataagcatgaatttcaggtccttacagggtaacaggaaatgttgagttgtttgcttgggaggtagttctggcatttagaagagagatctgggctagaaggaaaagtgggcttagctgcccttgtggtcgggccatgagagtggatgtggtgtccctggggtgagcatacatatggccaggagagggagggcccagggaaggggtgcaccattgtggcagtgaggaagggaaccttccttcagtagacccacaggtagctccaactggcaaaaggagccagagagcagagtagcaggaggcaaacccagagcgccctgccacagtggatccccaggaagggaatgtgcttcaggaattctgggtggcgagcagggttctgtttcatggcattgccaagttagatagtactgaggaaagaccattgtatttgaagctattgcgggcttttaaaagtgcagtttcagtggagggagagggataaaagccaaactcaaaaaatttttatggtagaaataggtctggactgggagtcaagaacccaagttctcatcccagctctgttcctgtttagcttgatggtccccaggcgagttccttaacttccttaggacttagtatcctcacatataaaattaggaaactggatcgcgtgatctataagcttctactcaagtcttgaggtcataatttatatctttctctccagcaaaacagatgttcttgtggcaaaggaattcccctccttctcccttggccacccccaactgacataataaattataaaaaaaattaagctttcagaactctagtgctaattgagaaagaaaactgggacatcagctcagggaattgtggacaccagtgcatgttgtgtccatatgtactctccactgagaatgtggggccctgcgatgtaggaatttgtcttgtaatactgtcagagttatgagacctggatggtttgacgctgttccacagggagaagtgctgaaggtggttccacagtacaaagacaaaacaactcctggggtccctctctgaattcacgtggaaagaaaaaggaaggctgtgaatctgagctggctgtgtgcaggagctccagccagggcagacaacaagagctggagggacccatgcattaggagatggacaagcctgagggcaccagtgggcaagggcaggagaggcacccactctatctccctggtactctgtggcctcattggtgggaggaccttggggaagggatggtagaatggtgatgtgtggagagcctagttctgagctgtggccattcttcctactcttaattccccatgtgctatggaaggcctgtttcttctttgaatcctttccttagagtttcgaccacatggcccttgctattccctgtcttctttggtgtgggtttgttcattctgtgaaggccattggaagaccagccatagtttggcactttctcagtttctaggaatagattctttactaagatagacaagctccctgcctcaaggaccttacagttttagagaaggaagatggtacaggaataattgaaggcaaaggtcatttcatatagtcatgcgttctaaaggaggaaactgggattaaataatggagagggattggaggacatgaggggtaaaaaagcagatcaggaaagatctgaggaagagggaacagcagatccaaaggctgtggcacagacatgagcagaaagaaggccagtggagctctagaccacagggagggaaaaatagcacacaatgaggttaaagaggcagttagggccgggcgtggtgcctcacacctgtaatcccagcactttgggaggctgaggtgggcggatcacaaagtcaggagatccagaccatcctggataacacggtgaaacctcgtctttacaaaaaatacaaaacattagctgggcatggtggtgggcgactgtagtcacagctactcgggaggctgaggcaggagaatcacttgaacccggtaggcagaggttgcagtgagccgagatcacgccattgcactccagcctgggcgacagcgtgagactccatctcaatttaaaaaaaaaaaaaaaaaaaaagaggcagttaggagccaatgttcaaggaaggcctgttggctatggaaggacatttgggtttcattttgaatgccgtgggagattgacaacttgacctgacttatacattaaaagatacctctgcatcctggaaaaggcaaaaccacagggatggaaattacatcagtggtttccagggaattgggtgtggatggagcttgcaaaggggcacaagggaacttttgtgggtgatgtaaatattttctctcgtaattgcggtgatggttacactactgtgtatgtttatcgaaagtcatcaaactgtatacctaaaaagggtgaattttactctaagtaaattatacttcaataaacctgacttacaaaatgcatattttttaatcaaaaaaagaattgcagtaaggcttaacagaatccctctggccgtcctgtggaaggtacatggcagggagcaagtctggaaacagggacggttgcacagtccaagccatacgccccttcaatgctgtgcttacaattcagcctgtattatttgctgatcccagtggcttccttacaccagcttattgatgtgtgttcctagttttcctgtttacctagcttttccttcaaaactggtttgaaacctcagtgtggatagaaaccatctgcttcttttgtatgtgcccatgggagatggcttattacatattactctccttacatttaagtagtctttaacatttgcaagcaattcatgatctcctttgagccttacaacatcaggctgcacatatgttaccatgttcccattttacagatgaagaaactgaggcgaaaataattcagtatagcagtgtgaaagaagcatgaactttggagattttggctttgccatttgttggctatcagtgtgatttgggaaaattattcagtctctctgaacctcagtttactgattgttaagaaaagaccaaaaaaataaataaataaacacactgcagatacactgtgaggagtaagtgagataacacagctaaaagcaggtagcagataattgaaattccctaaatggtagctatttgtatcatttttgctatcagagaaaacatgatttatttaaggtgatgtggccagtacgtggtagaactagagcctagtttttctgattctaggtgtgtttctctttccatcacaccactcagaacattcttaattgttatcaattaattgttccagggctaactactttttaccaacttggatgcttaaatacaattgttgattattcagcaaatatttattgagcactcaccatatgttcaacactgttgttgacacaggatataatagtaagtcaaaataggctccacctctgcccctacaggtaataaagcagaatggtgagggagcacctacctcggtgtggggtctgggaagacttcctaggggaggtaacattgacactgtctttaaaagaaacatttttgttgtgatgtagatcaatatacatgcaaaatgtacattaatcttatatgttttacagatttttagaaagcaagcactcaggtaaccatcactaggtaaaaaagtaggacattgctagtgcccaagaatgtccctaaatatccctttttgatcacagctccctgcctcactccttactaccttaactttcgtggtaagtttcatgggtccttgcctttctttagagtttaccacctacatatgcatcctctaatcatttagtctagtttctcctggttttgatataattggaatcatgctatttgtatcttttcttcagtattacattcataatatcccagttgtatgtagctggagttgattttcattgctatatagtattctatggtattcattttatgaatatttttaattttcctatgtagcattcataaatattagtgaatattcatgaatatgctatatattattcttcacctcattgctatatagtattctttgttacacaccagctgtgactatactgtaatttatttatccattctactgttgatgtggcattttatcattttgagtttggagcagttataaaagatgctgctatcaatgtgtgtgtgtgtgtgtgtgtgtgtgtgtgcgcgcgcgcgcacgtgtgtgtgtgtgtattctggggcacatgcatttgtgaagggttctttgaagaggaattgctgggaatcttcaactgcattagataatatacagtgttttccgaagtggtaattccatctttatattcacggtagcagaaagaatttctgttattataaattcttgctgccaatatttggtactgtccaattttttcaattttaccaaaccaataggcaagtagtagatctcattgtggttttactttacatagtctagattgctaaagaggttgaacagcttttcctatatttattggacatttggatttcctcttttgtgaggtacctgttcttttgccactttttaaattaggttgtaattttctcattaatttgtaggtgttctttatgtgttgtaaatactagtcttttttgtttttttgttttttgttttcattgcaaatattacctcccattccctggcttgtcttttcactttgttaatggtgttttatgctaaacagatatttctcttttttaatgtagtcattctttcagtctccctctttttggttagtgttttttttgtgtgtgtcctatttaagaagaagtctttccttatcttgaagctcaaaggctaccctctatttcccgcctctttaaaaagctttggagatttattttattttctatttaactgtttaatttacttgtagttgattcttgtgtatgatgtaagttgttttttctctaatggatactcattggttccagctttctgtcactgtttctgtggggccaccactgtcataggttaaacatgtatgtgataagcatgcagggacctgtttcttagctcatatagcatcccattggactctattcttatgacagtgccacactgtcttgattatgatagctttgtaacatgtcttgatatttggtttagcaaatcccactccccttggtcttcatgagtgtcttggctgttctcagctctttgtgcttgcatgtaaatgttagaatcagtttttgtgatgcatgcacacacacacatccctattaggatattaggatctgttgattagtatttattcgaatccactactctgagtagaattgacatctctaaatcttgagtcttcctgatccatgagcatgatatgtttcaccattatttatcataatttcttttaagaaatatttataatttttcccatgaagagctcatgtactttttgttagatttataactagatacttaatgtttacaatggtcttgtaattgcttcttttttttaagagcagttttagattcacagcagaattgagaaaggggtacagaaaattcccatacgtccctccccacacacatgcccagcctcccccttatcagcagttctcaccagagggcacagttattccagttgatgaacctatactggcgcattataatcacccaaagttcatggtttaccttaggctttactcttggtggtgtacattctatgggtttggacaaatatgtaatgacatgtatccatcattttggtatcatacagagtattttcactgccttaaaaatcctctgtgctccacctgttctttgttcttcccccaactcctggctaccaggaatgtttttactgtcgctatagctttgccttttccagaaatgtcacatagttggaatcatacagttggactcaaaagacttctaatatgtagccttttcagattggctttttctcttagtaatatatatgtaaggcccctccatgtgttttcatggcttgacaacttattttcttttagcactgaataatattccactgtctggatataccacagttgtttatccatgcacctactggagaacatcttggttgcttccaagttttgggaattatgaataaacctgctgtaaacattcacgtgcaggtttttgtgtggacataagtttttaaatcctttgggtaaataccaaggagcacaattgctggattgtgtggtaagaacaggtttagttttgtaggaaactgccaaattgtcttccaaaatatatagatatatcatcttgcatttctaccagcaacaaatgcgagttcctgttgtctgcaacgtcaccagcatttggtgttgtccgtttttggattttgtccattctaatatgtatgttgtggtatctcgttgttagagaaatttggatttctctaatgataaatgatgcggagcatcttttcatatgcttatttgccatctgtatatctcctttggtgaggtgtctgttaagggctttggcccactttttaattgggtcatttgtgttcttattgttgaattttaagagttctttctatattttggataacagccttttatctggtcttttgcaaatattttctcctaacctgtggtttgtcttctcagtctctggttaattgcttcattttttgaattgcattttgtatctgtttctggtatatagaaatacagttgacttttgtgtattgatttttaaattgatccaccttaattgttgtataattctaatagttaatttgtagattctaaggcccagagaggggagtgatctgactaggttcctatggctagctagtagcagagcaagcatgaatgtggtcctatttctgctgacttccaaggagagaatattcaggaagggttagggaaagccaggtggggagtaggaaataacatttattgaacacctgttatttacaatgcttaatatgcagatcagcttaactctcattggaggcagattattgataacccctttttatagatgaggaaagtaagattcagagagatgatgaaataaacgtgttcaggcacatcactgaaagaacagtctacggttggaggagtgctgttgctctatcaagcatacaccagactacatgccttctgcatttgagcatagacacccccagaactccctgggcctcctacctccagctatgccgtcctccagggtcccctcccagcccagctctggggctgcctctattaaggctctgctagcatctctagacttgtgcaggcctggttactgtcaactcttgggttgagtttctgcccaaagttctgaggtcagtctccacccctgcccttctacatagttccctcccaaccaaggaaatgagttcacaacttgttgagttctaggaaccaaattaggagttgctctgggcatcttgtttcagtcgcgacttgaaaatgcggttgaggttttatgactgctttgttatacagtggcctagagagaatttatggtcgcagtgcttcccagcaccccctcccgcttctcgttgattgtccagagctggctgcatacaaggagagggtttgcttctgctggctgtgcaaaggcatggggaaatgctctgtgtgtgaacacagcccagcagtgctctattcagcgtgacaacttcctactttggaacacatggctcttcacagggtgactgtaaattatgcaactccagagtcaaagaatgaggaataatgggggaaaggaagggacaaactgcaaacttcagcctggatctgaaatgtgagtgtggagacccaggctgcttggcaattgatgggaggagagtcttcaacgactgagaaaaaccaggaagtcctgtcgggactacttgtgagagtggcttttactgtttaaaaaatgtaaatgttcttttcaaactctgtttatcaattcagggagagttttagaaacttggagggacatttacaaaagaaagtagtcacatgcgttaccaaaagtaattgaatgccatacatggtatgtaacctttgtcccgatggctccaactcgtccttttttattattgcttcatgctaaaaattggtgctcctaagggcaattgtacagattctcaccttctcctccacccgcaatggtcctggaatgcagtgaactctgcttcgataagctttgtggaatgttcctgtctcttggctgactgtcatctctcatgacttgctgctttcagtggtcccacctcaagcattattccccttctcttgttctgctctgaatctgcgatggcccagaaaactaaacgaccagatttgtcacaatagtgtgtagagcaagaatgaataggatataattgaggacctgaggaactcttctagaagtagagtgtttgtgctttagtgcttggacttgtctgcatttctgcctatctatgacacaggattaagtatgtaaaaatgaattggcagttactatacagatgtaagtgatggtgacaaggtcgctgttgtgctatgtgggtgctcagagttcttcattgtgcttgtccttcctggctcctggtagggtttcgattcacagaaattactggacaggtagcttccagataagagtgatgaactatcatttctgacaaaagatgttggacaggctgtggcagcaaggaggtgatcagaagactccctagagcacaggggatctggcaggctttttctataaaatgacatggatacacacagggtcaggctgcctgtgggcagagacgtccccaggagccctgcccggtggccagcaccacggacatctgctcacctgtggcagaactcggagtctcacagctaagccaggccagacccagttgctactttttggtcaagacccgctctaggaattcttccagggaagagggaatgtgaatttgtctgttttcagatatgtgtagcctttacacaaaagtgtttgaaattatttggttaaaatgctttccatcgaggttattctttctttcttcttttttttttcccactctgcagatatccattgagcttctactctgtaccgagcaccatcttaagtgttgtaactgagcaagacacacaaaatctctgccctcctggagtgttctgacattcttgttaggggagacaggcaataaataaggaaaatacatagtagtattatacatcagctggtgacaagtgctatggagaagaataaagcaggcaaggggcatgagcgggagggaatgttagttttggttttgggggtgtttttctgagatgggatggcggaggatgagtcttgccatgttgtcaaggctggttttgaactcctgagcttaagtgatcctcccaagtggctgagattacaggtgcacaccaccatgcatgccttgatattacagttttttaagtcgtcagggagggccatactagaagatgaaattggagaaaagccttgatggaggtgaaggagccagccatgtgcacttgggggaagagtgctccaggcagccagaaatagacagtacagaggctccaagtcccgagtctgcccgtgtgcaaaccacaaggaggtttatatgtctggagtcacaaaaaaaaactggaacaatgggtgccctcatggagtcagtagtttctctgggtgtggtctcactaaagacaggggcgggaaagaaatccccatcacagactcgtgtagacctgtgacttgtgggcattcagactgtgttattccgctgccaggcctagggcttgggggtggtgtcctgtggatgtgtgtgtgtatcctgacaaaggagggacatggaagggaaggatcccttccatgaatgaagggggttgactctggcataatctaggaagaattctaggaagactcagttatttctggttggtttacaggagacaaacactgaacatgttgggctgccttgccttgctggtctcctagtggaggaggctctcattgctggggcttcccgttggccctagctctgcatctgctctcccatatcagcattaccagaccatgagcactgaggctgtcacaggacaaggagcctggccccagacctcattcagggctgctgacccagctttgggctccaccgtagacgtgctcagtaagcaagcctggggtctaggggcagacacctgggagcagagtcacaggggcaggtttccccaagtgtagcctgaaagtttagtggtatacaaatacacactttattttaatgtgttttaggacaaaaggttcctaacacatcaaaaccatagttttacagataattattgcttaggatgaagttaaagtaaacaggacgtttttaaaaagacactaaaaatcatgtgggtggcacaaaaatcctatctaagtagtgctaacctcaagtctgccctcagcatgggagtaccaatttctgtctaggggttcccatctcttagggatgagaatgccttggaagaagtcctcctctgccatcctgggaacacagtagctgtccctctgtcccaaccccaagcctgtgagctgtccacaattctcacttcttcccaacacttgcgtaccgggtgtttctgtcccatggcctgtgcctggcctgggccccctcactgccatcacctcccagccttcctctgggtccggtgcataaagtctcctcagctgccttctagaaatgctgtttctgcccttcactgccatgctaagtcaccctctgcattgggtctgggcattggcttggcttggaggacataccatggtgtagtgcaccacactgatcctgagttggctccccctactacagaacgccttctccctggcacccaccacctcctgcctccatacccatagctggtggctgccaaagcatgcttcctcctctttctctgtagatctggcctccaagggccgctcaagtctcatctggtccatggggtgttcctctggaagctgaaccacactggtctctccagttctgtaattcttttacacaggatgtctgtaccccaccattaagagtttttatatgccctcaaggtcccatagagatgacttctttgtctatctgagtttcgtagacacacgagcaaacacacacatgcactactaccagaacagaatagtcttgctcaccatgagcctgacacagagctctgtgcgggagccaattgaagagaagcggtttcagcacaatgaagggtaccagcctggcttgaatcctggcagtgctaccttctagttttgtggccttgggcaactaggtttgaggatgatatgaaacagtgtagaaattactgagcccagtactaggaacataataagataattgtggttgttattgttcactaattggcaaacatttgctatatgtacgtttggttccttgtctaggctgtaaacctcctgtggattcttggggcacagtgaatattcagggtacatttacataataagtagagtggtccatttacattgctgtgggttctctcataaattggctgttaggtgtagaagtttttgcaagcttatatgaaacttcagtatacatacatgatatgtatcatttgtgtgtttggttcacagtgggttaagaattgttgagcttatcaaaccacagttctgtattgagtacttactgtatacaggtgagagggaagtgtatacccccactctcttcctgatgagaagactgctgtctctgactgtcccatctcctttctccacagcttggatgtgtacctctgctccctatctctacagatcttggagtttttagctctccagcaggtgctaggaccaggtttcagcaatagaggagtgggtggcagggttgtagtgctaagtgcaccattctttacacttatttctactgctaggagcaaaaaaatccaaaggaaacatcatcttggtttaggcagtggttacacaggtgacacagctataaaaatccactaaaatgtacatttaagatgtgtatgttttactataggtaaataatatctccattttttaaaaggtgatcataatgctttttgttaagcaaaggaagtcccagggaattaagcattgcccctctgagttcaccagcctcaattccactgggagggccactcagccgggggaggtatttgaacccttaaaagtcaaggatacaccccaggcagcctagttttccctactcaactcttaggcattggccatccatgaaccttcttcattcttcacatttgcaccagggaagagatgccccagcacctgcttcaggccacagctctttctttggcacaaacctgcctgccattgtgaatcattaagtgttcaagtcttgtctctgccaccttggggttttttacccactataaaatggcgataagacctgatgtggctgttaggagtatcaaatgatataatggatgtgaaagtctcacaggactgtaaaatataagctgtcaacaaagtgcacctccaagcccagcttatttccacagtattcaagagccacaaggtttggaagagtagtaaagtctagtggttcagcaggtaggctctggaggcagacagcctgagttcattggtcctggccctgccacttaacagctgtgggacctcagccaagtgcttatccccttggtgcctcagtttcttacattgtcaaatgggaataatgatagcacttacccacaggattgtagtaaggattagatgagttaatccagataaagcacttggcttagggctcagctatgcagctaatattgctgggagcaagggtctctgctgagccttgagagaggacatctttattgggcagaaacagacaaaaactgaacagatctcatttggatataatgcttcatgtcctggctatattttccataatttggagctcaagattgattggtaagttttttcatgctgaaaccattcatctttcgagttttcctaataaataaaggtccctgtgacatgttcttgccttcagagttttgctgcaccatctatcgtgagccctctgatttacaattcagcaaaaaagtgacagactgggtattcttgttcaatccaaggtgattgctgcatagtcatttttaataagacatcagatttagctaaacgcttgcagtgaggtattgtgcatattaaattcaggatgctggttatacgggctgaggctctgcatctttctattgtgagttgtgagtttaaaaatcacataaaactgacatagtggattctttgctgcctaagggggcaagagacccttgttattagagtcaagtgttgactctttctccatctagtgaataaagtaagtgaagtgaagtattgaatgagtgtttgtgaggccctgggtaagggggttacatttgttgaagggctggtgagtgacaggtgttttagatgtaagattatttaatcatcaggcattataacatgagttaggtattatgactccctgtctacagatgggaaaactaaaactagagaggttaagtcaggtgtccaagttcactctcttagggttgagccaggatgtgatcctgagagctttcctaaagccccatattgcactattttagggttaccattaacagtatgttatgtatgaacgatcttattcctgagtagcttaaaatcaaataggagagacaaaacatgtaagcaaattaacagcaatgcatggtaaagtcccataagggacagagaatgtgctgtgtatgttcctaggaggaaagaggcatttgttcagatggaggcaaggaagatgccaaacaactcaccatctgaaattcattttgttgggcctagcatttttatcctaatgtccaagtatgtatttctgatattctaagaattgccaaaaataattatgaagctgtgcctagccccaggtgggcgagagatcctctcaaatgtcccactgtagcatgtctctttatttcctttctgtcctttgctgaaaatgaaaaatgtcccattgtactgagtagagctgctctctccctaagctcaatggccatctggctcacaccttcctgaacaaagaggtgagttgtatctgggcctccactgccttgtgtagtagttgaggacagaccatcacccaccagtcttttggttcttgcagggatgttgaggtgacagtatcggtggagaaaacccaagtggagcacacgtgccctgctgcagcaggctcggcaggagagattttcggcagataaaatgagagatgacgagacctggtgaacttggggcccaactataccatcaccgtgatacttggctcggtgggccaccagcacttgagcagggcatgtactctgcccctgtgagagcttgacagcaacccgctgcccagtacttcctgcctggtgtgaccctgcctgcccccacccagcttcttcccttgcccattgccatgtctctctctatgctggaaccacactggtcttccatccgtgtttgtaagattttgtgtgtgatctctcactcatctccaggcctttgtccatggtgtgccctattcctggaggcatcttcaccctgctttttgcttggccaaaggctactcacagcccatgcctcagcatagatgtcacctcacggaagccttctttgaacccatagaccgctggtgtttcaattgcacattgaacagaccgcccctcactttacactgctccttctattatcttttcattgtgggcatgcacccacacattttttaaaatgtgaaacacaccactttaggggaatatgctcagttggagctgttcttgccctcaccacacccaccccccaacccagctgctcttctgagttggcccattgtggaaagaagccattgcaccctaggaatatcatggggcatgaccacctaatgtcaaggacacgtgccaacggacatgttagtgcaccccgggagtgtactggtgcccaatgaccataccttttccatcccactgggtcttgtttgaaaccaccacattgggtttaggtctgctattgttaacccttcctattgccctgccttcttggagctccaaagaccttctggcagtgagttctcacctagccctcccctctctggcaagaccctaggtcagggaggaaggtcctgtgtggcaagaaagcctgtcaggcttgggaagtcaaggcaccccattgcatctcttctcctgcttaccattctcacagcagaaagcttcttgggggagtccttagtttgtcagctcatcatgactgtatgtcctccagaaaaaccagggtttttaaaagagttttttttctttggtatcggatattaggaaatgtatccttcacctaccctctgccccttctcccagaaaaagagactaatgcacagagtggaactttagattttcttaaggtgtacagcaaaccagaggtcaagacttgaacccacatcttttgacccttgatacaggccctgtccattgtcccattccactttttgtgtggctccttcatggctctgacctcccccattctcgggaagaagcctgaaacccccggcctgcaaaatagcccttgagagagaagcatctggaagtgtgtgctaaagctcccagagcaatggggggattctgccacatggctgctgtcagtagggtaaggttctggactctctaaagtctgagaatttgaattcctagaactagagaaggcccatgtcagttcaaaagtcagagcagaggaaaattaggaatcttgtttttaatgcagaggaacaaaaggagtggaaccatagccccagaaatgtcaacagaaagggcagaggtgaaggtggcccctgacaaaacttctccatacctattatttttgtaaaatctccccatagctctttggacagccatgtgaacagatatctttggcctctttttgcaggtaaagaatctgaggttggaggcaggctgggacaaggctcctgagtcctagcctgggggtctgccatcatacctacctgcttacaaaaaaatcacctctatatcctacatataccctttcctcccacgtatgctgtttcctcccctctgaaaaaaagtacctcagaatgtgctttcagagatcattctttcaaaaattgttcactagagcctactgtggccaggttccctggtaagtccaggcttccagtataaaatgacatatggactttctcctgcaagcattcacagcattctggagaagtttggggtccaaaactgaggttcttaatgtcttttgggtcacaaacccctatgagaaactgatggaaactatgaagaatttccttagaaaaatgctcctgcattttttaatttaaaaaacaaatgtttgcgtatgggggttgctgtggtttgaatgtgcgtcccctacaaaattcatgtagaaacttaatctctaatgcaacagtatttagaggtgaggcctttaggaggtgcttaggtcacaagggttccaccctcgtggatgggattagcgtgggttttttgttgttgttgttgttgttgttgtttgagacagagtctcaccctgtcacccaggctggagtgcagtggcacaatcttggctcactgcaacctctgctgcccgggttcaagcaattcttctgcctcagccacctgagtacctgggattacaggtgcctgccaccgcgacctgctgatttttgtagttttagtagagacagggtttcaccatcttggccaggctggtcttgaactcctgacctcgtgatccacctgccttggcctcccaaagtgctgggattacaggcatgagccactgcacccagccttggattagcgttttaataaaagagctcaagggggcaagttcaccccttccatgcccttttgcccttctaccttctgccatgggaggatgcttcaagaaggccccactagacactgaatgccagtgcctcaacgttggactccccaacctctacaactgcgagaaaataagtctctcttctttataaatgcctaatctcaggtattttttttatagcagcatggacagactatgacaggggttagcagtctcccagaggcagtctggggacccaccacaccctgcctcaagtgttcaccgatttcagatgaagaagtcatggggccaggtgcagtggttcaagcctgtaataccaacactttgggaagccaaagtgggtggatcccttgaggtcaggagttcatgaccagcctggccaacatggtgaaaccccatctctactaaaaatacaaaaattagctgggtgtggtggtgtacacttgtaatcccagctactcaggaggctgaggcaggagaatcgcttgaacccaggaggcagaggttgcagtgagccgagatcgcgccactgcactctgcagcctgggtgacaaaaggagactgcatctcaaaaaaaaaaaaaaaaaaaaaaacatgggaccagatgatgcagatgatgaaattatagtcttgttcttgagaacagttgttaattctccaaaggaagcttgtaccacggggtacaaggataaaagcatgggtatgatttttctggtcatcgtcatcattgtttcaggagtcaaagttgtacacatgtcaatgtcctgtggtctttgattttttcccaggttggaggggaaaccaaggcaggaggggtagccagcaccagagccagtaatggtgtctggagagaatgtagccatccaaccccagtgctctgcttctatgcagggatggcaagaggctaggtgggatgttgagggaaacttaggaaaagagctggaagtcaagcacagaagttttgcaatggagtttacaagagtttttaagataactcaactttgagatgaacaggagattgagaaagcctttataaggtcttcctaagtgatgctgacagctaagagtggcatgcccctgagagtctatgattatctcgcaggagagatctttatgggagccttattaagaacagagcatgtcagtgggagggagggagggagcagcagcgtgttcacagctctggagggcaagtgaggcagcctccttgatttgcaaagtgctttgcagtcctttttcattatttctgcaacagacccatgagatgggtagagaaccaccctgctccccacaaattgtagaacactaggaggtagtgggctgtccatctaaaggtgtccttataataactggatggtccctgggtttgcccctctacaaccaacatgatgtgataacctagattagaatgcctccccactccccagaccttggagtcttgtgattgcttgtatcagtggcctcttcagaacaaaagcatacaagcttgtccttctatgagattgtaacccctcaagcatgctcactagttggaggaaattctgacagccctactccaggcttgaggctcgccctggagcctggtaacttgagcctccatcgtaggtgtgtgtgagaaaggaaatgcagaaatggagtgagccgaggaaaaacccaggggcgacagatcctcggagagcatttcatccagtcctttcccttgacacgtgggagagcaatgtgacacggctttgctgctagatggtgaagactggcgatgaggtgataatgatagctagcatgttttgagtgccatgtcccaggcatggtgcctgatatcacctgtgcaccctgcgagatgagctttgcagcgtggttgagtatctgtgttatatacagagaccctggtgctagagccccagcacccagctccagcaccttctgggtgtataactgggtttcttattgtggctgtttcaattggccacagattttgtggtttaaaacaataagatgtattgttttacagttctattggtcagaagccccattcaagttcaccagcctaaaatcaaggtgtcagcaggctgtgttcccttctggggcttctaggggggagaatccattccttgctcttggagattttggcagaattcaatgcctgccgttataagagcccccttttcatcctggctggaaaccgagggctgttcccaggttctagaggtggctgccacatatcttggcagaggcccctgctttcctctatcttaaaagccagcagtggcaagttgagtttttctcaggcacatctgactcttcctccattgttatatctctctctctttctctgatccagccaggaaaggttctctgcttttaaggactcatgtgattagattggacctacccggataatccaggataatctccacatctcataaccttaatggcatctgcaaagtccctttggccctgtaaagttccagggattaggatgtggacctctttgttgggagagggggcattattctgctcatcacagtgacctagggaaatttgcttgacttcttggtttaagtgggaaagatgatggtacccacctttgggttatgaggatgggatgtggaacccctcatagcacctggaatgttggtaaatacttagttggtgttagctgtgagggttgttatcaaacctgttttacggttgaggacactgagatttaagactttgagtaactcacctgaagaacaagatttaaactccttgcgagaaaggacaaactgcactgtattcatctctttcatcccccacagggctggcccacaaaagatgttcagtaaatggatgttgaatgaatgaggggaaccagaaagagtaaatgacttgtctgagtgctgttagagaaggtcagagatgaagggactctcagaagaggtcaagttcaagcctttcatcttatacctgggaatctgaggctcagtggggaagcggggcctgcctcagaagatgggcagtgcagagccccaggatgtggccagtgcctgtctggccagtacgtcttcctctggaccaggccgtattcatttccctggaggtctctagatcctgtggtctaagccaagccagaagctggtccagtgggatagaagtattgattctggcctggcccctggtacagcgtcaggcagaggagctcagtagaagagtgagaggtgagagtcctgcctttcttcctgcagtggcctttggagaagcctatctgaagcttgttctcaggcttctctagacctccttaggctgctacccggtaggatagcagccagatagatgcccatggcccactcatgcccatgttaataccttctgctctgacctaaggctgcatggcatagatgggggactggggttttatttttatttatttattttgaggcagagtctcactctgtcacccaggctggagtgcaatgttgtgatctcagctcactgcagctttgcctcccaggttcaagcaattcttgtgcctctgtcagcctcccaagtagctgtgactacagcgtgcatcaccacgtctggctaattttttgtatttttagtagagatggggtttcaccatgttagccaggctagtctcgaactcctgacctcaagtgatccaccaaagtgttgggattacaggcacgagccaccgtgcccggcccaggacttgggttttagtctgcccatttacacttacggctttgtggtatttagggcatttggctccttgggactaatttcatctgtagcccatctggacacttataaggtctcaaacaatcctcgtttcaggtgccctttagaggatggttcaaaaactttcacatcagcctcagggacagagctgtgctgtcattccaagggcttctggctccactgaggctgaacacaacttggcagccagtgaaatctttctggacagctgatagtgtcccccatctccatgggagccagctaaggtaggacagggtgctaaccagtaactttgctgtgctaggctgcccctgacacaaggcagccacaggaaaagccattatatctctgtagagcaggatgtggcatttatgctgtctcattggaatcagggcttcgttgtctgtttgtttgaggaggattgagcaaaatctggattggttttcctaggcaagaaatgccaagtgtcatgatgtcagggttaccaggtaactgagtagaggaatggaatatatgggtggtgcctggaaaggggagctaatacgtgttcctactacataccagctccaggcttggcacttttgtgcattgcttgccatggtttactgcaggtatgacttgcccagttttacagaagagaaaatggaggttgggaggtggtgactctccctgatcacccagagggaactagcagaaattgtttgggctctagctagttaaatatgagcttagttcagttgccaagtcaacatctgtgtgtgtgcactctgttgagatctgatggggctggagccatcttctctgccttctaatgggagggtggagttcattctggtggatagggaatcaataaaacaggggtataaaaatgatagccccatccattagtaagacagtaagcatttattgagtgtcttctgtgtgctctgttctagtcactggggacatacctcattcagggagctgccattctagtttcatgaagacggagaaacacacaaagttaactaaatgagatcgttgccagcactgagtgccatgaagaatgtgatagaggatagttgaggagctcctttagctaaagtaggcagggagagcttcctgaaggaatgaaatctcagccaggatgcaaatgatgagaatggggcagccatggaaaggtgtggggaaaaagctttccaagcagaaggaacaggagtacaaagacagtacaaagacagagccagtggtgagcctgagtgtgcagggaagccattggaaggagttaattaggagagagatgatctgacttctactttgagtttgctgtggctgctgtgtggaggacgggctgtggaggggcaagagagggagcagggagaccaaggagggggcatcatagcctttcagttgggtgaaagatggtggtaactgggaccaagtttgtggcagtagacagtgagaaattattagaatcaggcagtattttagagttagagtcaatagggcctacttatgattaggatagtggtgtgctggtaaaccagccaagggtgggagggaggcccttgttggtagagcttgccagtttctgtggtgtaatattcccaccacagctggtttcaagctacccatctggccagtgagtgatgcaacgttagctcttgtgagccagcacaactcactccagcacaccactgggtcaggccatggaagatagaagcaagaaggactgaagagcattccatggctttgctctgagcacctgggtagatggggatgccgtctactgaggtaggaaagactagaggtggaaagaaagatcctggggcagtggcaggaaaaaatggttttgctctggccatgttaatttttaaatgcacattagatatctattttataagttttgggcacttgcatcctttatgtcatttaagtgtcagtcctttcaataactatgagtttggtggtttcttctccattcacagaacaataaaccgaggatgcaagggaccaagaaacttaaccaaggttgtacaatcagtaaatgacagagctggatttgaacttgggtctgaccctgccccaagggccgaatcattgcccacactgccctccagaaagcatcccactcttagcttgatgctacatttttgggatttaaaaggggatctttaggaagttttgaacagcctttataccggagaagtaatcacagaatggttgctcagagaccagactctgccctttgatgtgttgtgtggttttgttttttaaggggtgtggcgggtagggaaaaagaggaaggtggggaggggaaactgtttgtttcattttgttttattggcccatgcagtttttttgtttttgtttttgttttttaaagaaaacaagaagaagaagaaagagagaaatgtaattgttttaggcaagtctgcgcgcccccgccactgctcctggcctcctccattccctgctgtctcaccacctgcccatttgacacacgtgacacttgcttggctcaggaggcatccagtgtcccgtgctctagaggagcccaggtgtagtggcctctgcaggcaggctcttggcttcatccttgcacctcagggagtgagcacctggttcccaccctgtctccaggcctgagccagtcactggggcctggggtgtgtttgatttgcactctctgctgctcccttcctgaccactgccagctacctaagacatcactgtgcttcaacggtaagagctgtggtctttggccaggcacagtggctcatgcctgtaatcccagcactttgggatgccaaggcaagacgatcacttaagcccaggaggtcaaggctatagtgagccatgacagtgccattatgctctagcctgagtgacagaggaagaccctgtctcaaaaaaaaaaaaaaaaaaaaaaaaagaattatggtctttctgattctatacatactaaagcaatcccacctctttccctggctttattggtattattttccctggtattattgttgttattttgctaacataatgaggctcggaggcatggtttttctgccttttggccttcttgctggtgatatgttcaatttaatggtgttcttcagtgtcactaggcgtggctggagctgagtggaagctgccatcaggtagtctgagaggagcacacaactgcgtaaatggctgtgtctgcctggctcccttggaccgagaagcctccattccctgcctgggcagtgctgggcttggttacctgaagaggcatagcaggattgacaggaagctctcaccccacggttggcatgaccagatagccctgagcatgatgccagggctggtggcactttgcagagccgaaaagggaggccagcctgcatccatctgcctccgtctgcacagttatgtgttccaagtgcaaccagaagaaggcttccccaggcttagccagggccaccaccaggccagactggaataggccgagacatacccagagagtggcagggttctcctggcatttccatgtatgtacctctttagtaaaagatgtttgagctggtaaccctgtgtatatgcatatgtatgtgtatatacgtgagtgtgtgtgtgtatatatgtgagtgtgtgtgtgtatatatgtgagtgtgtgtgtatatatatatacatatatatttatttatttatttagattatgtatattaaaatacataaagaaaaatagaaaatagaaaagttaactggaagttatcataactagaaatgtgatgttttcttctgtgcccctatggatcctgactcacaccttgagcttgccggccctgagccgggaccaggagctgtaagtaattgcatctctgcttcccaccagggcaatgggaagagcttcatgttcagaaaacttggctccaagccccagttctgctaactcacttgcagcatgctgtgggcacatctcctggccacactgccccacttctgtcaggtctgcatgaatgtcactttaagaccaccctatgtaaattagcatcccactgttaccgccccttcacttaccctgcttcatatatcttaaaagtgcgtagtgctactgacgtgtatatatagataaaagtttattcataggtttgttgttatacatgtttgttagttatctttactcgtgtatgctccatgagagcaaggattatcttttgttctctgctgtgtgtgtggtacatagtaggagctcagtatatatttgttgattgaatgaattaacttttgttttatataacccaatgctacttagtaaacttttgtaatggaggagaaatgaaaaagactttaatgcttgaaaggaggatttggaggctagaggtagaatcattttgaggaatatctgctttgtatagccgacaccattgctgtttttgtttttttgtttgtttgttttgagatggagtctcacttactctgtcacccaggctggagtgcagtggcataatctcagctcactgcgacttccacctcccaggttcaagtaattctcgtgcctcagcctcctgagtagctgtgattataggcacacaccacctcgcctgactaattttttttgtatttttagtagagacagggtttcaccatgttggccaggctggtctcaaactcctgacttcaagtgatccaccctccttggcctcccaaagtgctgggattacaggcgtgagccactgtgccctgcccccattgttgtttttacccatgtgaaaacaagtactggggaccaggagctataaataattggatctctgctgacaaccaggcactgttcatggatgggtgggtggatggatggatggatggatggatggatggatggatggatgaataaatagatagaatttaatcttcacaataacccattgagattaagtttcattgtctccatttcacagattaaaaaacaaaacaaaaatgcaaaaccttgaggcccagaaactcaagtgtatctaattccaaagtacctaaaaccatgactaaacagaatgcaggtacccagtgagtgtctgtggaatgaacgaaatcctagcttgttacactcttagaacttctcgagcttttccaccaagtagcttttgtggaagaagatggtgagtgtgtgcccaggagagtcgaagggcatcgcctgtagcagtccacctcaagccagagttgtgtttttttaacatctggctttttattttaaaaatccatgtgaatttctgtattatccttcatatggtgaaacaaactcctcctgtttgttttacaggaaaaatgatgcttttgatcatttggtcacttatgttccataactttaaaaaaaaaaaatgtcaatgaaagctgctgctctgcatgtactgcgggagtggcatgcttctggcatgaattctgtgcacctacgagctgcccagcctggtgtgcagtgaccacagtggaggctgctgtggggcctggtctcttccatgcccctcagtgggatcttgtgccattcgccccctgtgcaaacacagcttgtccagaggaagcgggacattcacctccaagccccagccatctgttgtttcaggcctggatgagggcttcatctgggtgaatgggccttcagcaaacagtgcctcgcctggtcccctgataaggggtttacctctccagcagattttatagctctgcccttcatccataatcagagcgtgggtggggagagacagagagtatgaaatatccctgaagctattggaatagcctttatggtttgttgtatataaacctgtgttctggtgtggtatgtgaaacggaccactgagactcagcccacaagactttgatgtcacatagctaagggccccttttctggttcatgtttcagtgactgggtttctgagcatcttctctaatataggggtccagactccaggatttccattgactcgcgataaggtttcttcattctttgtgtctttgctttcctcttcctggaaactgagttcaggcatgtccagagtcatgtgtggtttaaaactgaaaaggctcatagagaccatccagcccttgcatttctcagatggggaactgaggcccagagacagaaagggagggtgtgccccgttgtgctctgtcagtctgcaacctctcagcccgggtctgtggagttggtgccctgggtgtctgtccctgtcaggagacagctgaggctttgttcagcatttcttatctggttaatccccaccctgtgggtatgtcatatagccaggacccaaagacaggaagagatgaggagaatgaggatgtacaagtcccaaaacaggatgacaccattacctgggcagtgtggcttatgctttatgtgaaagactctgttggtccatgctcagactcagcccagcctactccatggccaggcccagaccttgactggcaactcacctcccagccctctgaaatccaccgtggggtaggctcagagcagactcacccttacccaagaaaagaactccattcaggtctctgcccatatgtcacctcttccaagaggccttccatgacaccctgtcttaaatagcagtcctcatcacttgccgtctccacgctctgcttaattcttcatttattaccacctttcctgtatttgtgtgttcattttttcttttccttttctagaatatatgttccctgagagccaggtccgagtctgttttgtccctagcacctagaagagtacctggcatgttctctgtgagcggggattagagagagagtggaacttggggaacaactgggagggactaaaagaactgggaaagtgggagggacgtggtcaaggaagagaatgagcacccttttctgaaccacttaaataaatctgaatgcagactgtgtttgaaaagagctgcttcaaggggctcatctgtgattccttgaaaaatcaccaggcttggtactaggcactggcacctgaagtcaggggtttttgattccctggcagtccaacctgtatttcccaagggccctctactcctctgaggctcagtattctctccacctggcaggatagggcccttggcaagatggagcctggtcccaggagaaggtgcacctctgtgacgatgtcgtccctgtggccacctgtcagtgcttttcccatctggttggcagatcagagagagaaagagaatgtgggggctggaggaggggggcccagaccatctgatccattcccatttattgcagatgggcaagtgggactgatgcctagagagggtaaaggacctacctaaggaaacacagcaaggcgttgacggatgtctgctttaaaaaaaaaaatgtttcctttactattgctcatcttttgatgcatcctccctcctgcagcctctcctacaaaaataaaaaaaattccacaaaagcttagcaagggcttcctaatgcttgctgtaacataattgaccctcttgagcctcgtagctctgagaagttcatggatcttcagaaatgcgcccagtaagacgaatagtgtttctgtctagagagagtggctctaatgagtcaggcatttcccaggttcatatcctttggaattcggttctgtgagctttaaacttgtgttctatacctcccctcagaagagttgtaaggtcaagcaagtgtagaaaatgctgcctgctacaaaaactcttggagagacacaatggactttagcatattaaagcctctgagaagttctataattaacaaaaatccaacagctctttttgtgtaattcagtttcccacacttgtttgacctcagaactctttttgcatgaaaaactattggcctctcacagagctggtcttcctccaaccacagacccaacagaccactcacacaagggagtactcagcacttacttttcattttatacagttatggctttttgttatttcagtataaaatacgttggaaaaaaaacatgacatataataggcctcctcaaaaggggttggggtgaagcgccctccaactaactttttacttcttataaccagaaagacaaaagacagcttcacgaagacatctcttcttctttatatccttgtgattctatttttattgctctaagagcctataggccatttccattttgtgagtacaataaaacatgccccttactcaaatggctttcaagacaggccggaaggacttcaccataaggaaaatgcatctatgacactcctgtagcttgggaggtggagtatcattgcactgaatggatttgaatcctgccatcaccaggcatcattacttaatctagctgtgtctgttttctcatctgtaaaatggagtgctcatagtacctggctaaagttgttttgaggattatatgagatctgtgtttaacatttagaatggggtccgatacaaagccgatacttacctgttactgctattatcatagaatgagagctctgtgtaggcagtgactttgttttgttcactatttacatgccccagtgtctagaacagggattagcacatagtaggtgcttagtaaagtttggttggatgaataagtgaatgaaaaaatgaatggaaggtcttctatgtatggagagcaatacacgtttctgagagtcagattctagcagagaaggcaccagattaaaagtgagctgcttgctgtaggccaaggcttttgcttcctctgccgtgtcctctctgtgtatgaatgagaagccagcacccataaggatgcaagtcatggtgtggaactcagaagcagagcgtgaggtgatttcctggaaggtggcagtgtcatctgaatgtttcaggcctcaagaatccaagcttgtggatttctattcctggttactacaggcaggtctgtgtctgcccagccagagagttgccaccatttacccttggagcctcccagcgaagatgctgcccatggagctgcttttgaagggggagtgcttctagctgtctgaggcaggctgagggccccttggccaccttgacactcttgttccccaaaggctccatgcccccttgtctgtgggttggcaccacataatgacatgttaacccttggcctgctgatgttgattttaccttctcttgagggaatataaccaaggcactggaccaaaataaacagcccagatgctgtgctgacccggctctgctgggaagcatggtattgatttgcccccagcctctctaccttcagtaacctcatctctgcctgaggctcctaagctgggaggttgattcacttctttccttggcagtgtattcacccaaacacccacacccactttgtttatattcctaaagaagccagcattagctatttttaaggactgtgagtggccctaggtgcccaaccctcctggtctggctgtaggcaggaggtgacaccccaaggagagtctacctgtctcaacctctctggtgggaaaacccagtagccaccagcctagggaatgccaaaggcctaagcaaacacttgtgcagccagccagcctcatggccttggccctctggccagaatgcccttaggctgagggtactcatggttggtggggtggggcagttcagactgatctccaaagaggggattgacagacatgctcggggcctgcagctgaatactgtctttagggaagtgcagctggaaagagggtttagctgtgattcagccaggcctgcagttcctcagccttgcccatgaggctctaatagccagtttaaggagagctcactgaaagtctgcatgaacccatgaactgtttcacagctgacccagcttcccagttctgcagcttccattttcccctgtccctgggtggtttgcttctcaaatccagggagtcttctccgagggtacaggagtttttgagggagtgtggttcagaatgggaccagccccttcccctctggttcccccccaactcctattccagtgaccacattgggcatgcagggggccctttccaactcaaagatcctccaagagaaaacattctagccttaaaaattgaggaaaacagtctacctctgtccccctggtcatctgcttgagccagagaatctgtttcactttgggggtgggcagtgtgtggccatcgggagctacactggctatttgcttgccccagtggctagttaatgttcagccaccagctgcctgtgaaaatgctgtttatgtctttcttaccccacagcccctcggggagtttaaataaggtgctgcggcacttgagttctgcaaaagacacctattcgctgaccagacaaagatgcttagccacaactcacaactctcagggtgcagttcgaagaggaggaagcagcatggcatataaagctcatgctcccttgaaggctggtgattgagacaagttatgtcttctagcatttgactccctcaaagagattgcaggacttccctctgattgcaggtggctcaatccactcagatcacctagaaacttgatagagatttagaatcttaaagaagacagaagcttagacagagcatgtagcccagcccatcaacagatgaagaagttgaatcctgcagggactacaaggaggtaggtagagctagcagaactgaaggccggcgggacactacgcagtccaggcaaggggctctgctgctgcagcctgtgcctgtctaccatttccctttggctcctggcacctgcctggtcagttctcctcgacatcccctgagagcacaaccagtctgacaattgttcctaaaggcagtgctcctaggggaatgcctgctgagagggaggctttcatttaacatgggacttgggtggaaatgcggagtgtgtcctatcctcccaggcctccctggataatctgtcaggactgtcctgctgtgcagccaacagcctctgtgtccttactctgctgggatcacccagccctgcctgggagctaagagagtggcccagccttgtaggtagccacttgccctttggattaagatgaatatgcatgattctggcaggagataagatatttatcttatttatttgacatgcatggatttcttggctctgtgtgaagtaggaagggaaatggagtggtggaagttggtagatgggcattttatgtacacgacttggacctttatcatttgaaattttcacaaagggggatcaaggctctcccgttttcactgagatggtgattctttgagtcatagcctattttgacttggagaagctgggtaccaggtctccactcaagttcaggcagtcattcttggtttcacttctcaggtaaagaggcatgttctcccattattgcttctgagatctttcctaaagatgatgaactggttgacctttgctgacaagtccacattagtctgctgtggggagaagaagtgagtggtgtgggcaattctggctgaagtttaaattgcagaattgaaccttagatatgagtttcatagtagatgtgttggagaaaagagagcctgggttaactgtatcttttctagtcccttcacaaaacacaggcacgcacacacatacagaaggagagagagacagagaaagagatcattcagtttgaatccatagaattgaccctgggaggtagattagaagagagaaagggaaagtggaggtggctttcttaggagctttagacatttccaggtatgacttccagataggtctggacctcagtgttccaggccaacccagtcaagttcatattggccaacatcagagagacgaagtaccagtcttaggtcaccctgcaaaaaaacctgactcccagtccagtgcccttttcactctactatgttacttctttcctagagtgacctttccaagctagtccatggctcaccagagcaaattggtctcgtggcattatagttacaccagcgctttgtttccaaacgcagtgatcctctgtaatcgccaaatacctatggctttgagggacttttgaacacaaaggcagactcaccaagagaaaacaaagtctcatcaccatttaaagttttcagattctgaatacattctgaaaatggcagttagaagtgctttagccaagggccgtgtcccaggaacgtgtaggattgtgcatttggatatctgtgtctagcttcatcacttattgctgggtgatcctggataagtttacttaatttatctgtgcctcagtagcctcatctgtaagagtagaattataatagaacttaggtcataaaatttttgtgaggattaagtggaatgctgtacatgaagtacttagcacattgcttagcacaaaatgagtactcaaaaatatttactatcagtattttattcttttgttttcaggtaagtctctcttataattgtacatgctatcaaccagtgcaaattaatatggtatcaagaatatgaagaatcaaaagactaaagagtaatgacattagctggtggggtttatgcagtcattcgttaaacagatatttgttaagcatcatctatgtacctgacatggagctgaatattggagctgagtaagatagatgtgatcttaccttcatgaacccctcctcttgtaggggagacagacatttaatgagtaactacggctgtgcagagcaatgccacaggatgcctgtatctgaaagagaaaggagaggaaggagagaggagaaaccatgcgttctggtggccaccccactgctgcaaccagaagaacacagccatctccctggaaatcattctgataaatttaactctaggggaaaaacacagccggtccatttccaaactggaattctccccccatgtgtttttgggaagcacagatgccttggcgttttccctctaacaataacagagattgttcacaattatgaatggttttggttgacttcagctccaacaaaaccatgaatcatttcataacttctgaaattgcaaagaaataacaaacactctggctccagaaaaaaaaaatggacacattatgaagcacaaagtcgtctaaatgaaaatgtgaattcttttttgtttgtttagcagctgcacgttgcaaggccagctggcaacggataaaagacccaagttagtgtctaggttcctggggtaccacttgtatagtctcatctgtgggatccgtaaccagctatgatataaacttcgttctccatctttctcaaaactttgggccagcagcattatttcatacattttacaatattctgagaaagcgagagtgaaaggaggtgcttgggctgaggctcgtgacagagggtctccatcatgggtcccatcacagatccccccccgcccgccccacacacatttgtgggacgactttttttcagcaggcctgctgcatcctcctgatatctagccacaagaggaggttttcaaaacgtgggaccaagaggatcaggcttcccccagtctgacagcctctgaggtaccaacaaggcctggcattggagcaaggttggctactcctcttctctcttaatccagaaaactgcatcctttcctaaaggctggagacacacagctatccttgattgcagtccagtcttgcctgtgcacgtggccagaggcacagcgggttctaacaccttggggctgagaccagattggagagtgggggacaagcacatgaccacagcaccacagtcacagagtcttcctccccaccttgttgactttcttttttcatgttaataatgtcaacatagtggtggccatcccactgctgcaagaacatttgttggaaagatacttcttttggaaaacaggctcaggggagcaattgttccccctcaagtctgcctgcactcctgatctctttccacgctgcagggtacacagcagacagcagtagactcaggcccattggcatagcatgtgcttcccacacacgcattttttaaagtaataattttgttacacaattaatgcttatttctcatagataatgtaggatatacagactttaaaatggaagaaaataaatatagcctatatttctattactcagagcgaatcataatttgcgtttgggtatatatgtttctagacttctttcaatgcatgtgtatgtgtttttaaacaaaagctagtatcaaactgaacacataattttattggccctctttactctcactgtacactctgaacattttcccatatctacatatatgattgcatatcactttatgccctgcagacatctctgtaaatctctggaagatttttccttttgtgtccttctccctaccatcagagatggagacaatagaaaatacacttcagtgtcacatcacagactcacatcttgagcactgatgtaagttttgcactagcccatcacaggcactctgcctgagacccttcctgctttagctgtgattatgagtgcccagttcatcagccaattcattgccaaggtagagcctagctctgtaaaatgcccacaagctttggcagcatgaaaaccatgcaaagttgcattgatgctactcacaagccccaaataggtggtctcaaaagagaaaaaagacttatgttttaataaaactccctttaataattaggtgctttaataaaaggccacttgggtcactgtctgcctcctcagcctagacttcctgcagttggaaaaaaccttccaaggacagagagggttctagggacatactggacaggccctgttcccagccgctgagcccacagggactgacaaggcaccaccccataagaatgtctgtacccttttggagcctacatctgtaggtgctgaggcatcacattcttcaggttctaatgaagaattattgcagtgatgagttgtagaaataatcatttaatgtttattattctgaggaaaatttaagaatttctgtattcagagcagattgacaaatatggcaaccacttcacataatccacacgctagatccttataaatgtcattgttatcactggagcctcagctatggttgtctttcccaagctggatgaataggactgccagttattcactaaagatagagacagcacatggcttctcttaggcctggttgctgggcagaggctatagcattgccttggggtagggggtgcaggtctcagcaactatccttgagcccttcaacagggagtcctgtctccacaaagatgtttataggtcaggcttttgagtcagaagaacaacttgcagttgttttctggggccacaggagttgattgggtaggtggtctggaaaatgaagaagcaggaggcttcacataacacaccctggatttagggtggggacacagccagccccagtgtaatcttacaatggagatgggatctcttcctcaggtgtgtctgaaagccacctcagcagcctccagggaagtgtcctctcattggtctcagctcagtgtgtggagggctcgggagtggttagaggcaggctcatgcagacaccattccctggaatgtgcttgtctgtatggtcatggaaggattttttctgcctcctcacatccaaattcagcttagtagactgttattgggcacccgtgctggtgccttgcctctggtgtctggctggggaggcagtgtgaacaccagggacttcacatcccagggtgatagcagttttcaaccactttcctagaactgcttggtttttgaaccatggtgctgtttaatgcttttattgagtggtgggtcccatatgtgtatacatttgagcatgtcagtttgacagcatttcttctcttgtcttgaacttttatctgagcctcatatcagaatcgaatttttcccatttctctcaacctttgccaagtcctccatgtaatgcctacacaggacctgaagaggaactccatggtctgatttgggtttaattggttggtcttagatttcccctccctctccaggctcagggtgcctcatagctgggcacttagggtgacaagcttatgagctatagagcaggctggggtgtttatcctcgtgcacagtcacgaggagaaggatgcttataaaactagaacaggatgagactctgtgggatatggtttgatttgcctcagctcaggaagcccaccccgatggagaaggagaaggcaggtagaagccaagggaatgacagtcaaggccaggatgcctccacagggaagagtgctccttccaggaggtggcatcagcaccgtccagctctctctagggctccgtactctctgtgtacatggtggcccaggctttacttcctgctttttggagtgggacctcgagaaccaagcagtcctgccactgcagcccaagcggagcatgcagttctttgccacaggccttacagcgctctgacgctgctcccatggaacttttcccaaccaattcagagcactttgagggccacagtgatgctgggagcctgtgttgtgagtcccactgctatccagggaaggccagtgtgaatgagtagcagtgctggggagtaaagcatcacttctcaagccctgtcctcaggctcatgtgcagcactagcgatgcagcactgactgcacacagcatgccactcagtcactgaggaggggaagtgagccccttttagttctcttccagtgcttcccatcgagttgaggagagtccattgggcactagaacagcttaatatccctctaaagcttgccaatcttttgaaacaaatagtctgttataggtttgtttgcattgtatttgtttccatggttatctcctatttaaagcaggtgataccatttaaggcaacaatgtaaaatttcctttttaaataataacaaataataataatatttgtttgcagtgtatagaattaaactaccaagcaaatgaagcataatggtataggctatggccaaaaatcatgagggtaatggagtgactcaagtttgagaaatgctgaaccagacctgctgctttccttatcctgcagtccagtgtcccttcgtgacaaggcatttgagaaggtattttgattgagtgtatgtttataccactcacaaggaggtcccagttacgagcctgtgggagctgggcatgagcagaagctgtgctgcttgctggcagaaactggcctgagctgcaatgggaagctacactgggaagatgaaaagccctggcctcagaagccctgtacctggaaaagggctaaatcccagggtggtcactgctagttagggggtgctgtgtcattcattcatcccactctcctgccagcccaggacagtctctggggcacagcagtgatagcagaaatgctaatagcaaacatgcattggactctcactgcattctggcacttcacctgagtcatttacttctcataatgctgaaaggtaacagtggtagtggtagtaataaggggaggagaagaaggaagatgaaaaaaatgttaatatttattgaatattcacccccaaatcatttatagattgaacataatccctatcaaaatcccaggtgccttctttgtagaaattgacaagctgattctaaaattcaaatggaatttcaagagattcagaatagccaaaacaatcctgaaagagaagaataaggtaggactcacacctcccaatttcaaaacttgctacaaagcaatgataatcagtacaacatggtactagcaaaagaataggcatctagatcaatggagtagaattgagagtccaggaataaacttatacatctatgaccaactgatctttgacaaggatgtcaagatcattcagtgaggaaagaatagtgttttcaacaaatggtattgggacaactggatagccacagggaaaagaataaatttggatccttatctcacaccatatacaaaaattaattcaaaatggatcaaagacttaaacaaaagaacaaaaactaaaacataggggtaaatcttcatgactttggcaaagcattcttaaataaaacatcataaacaacaaaagaaaaacaatagataaattagactttatcaaaatttaaaaattgtatgctttagagcagtggtccccaacccctgggccacagactggtgggaacccaccaggccatacagcaggaagtgagtagcaggtgagtgagcaaagcttcatctgtatttacagccgctccctatcgctcacattactgcctcagctctgcctcctgttagatcagaaggagcattagattcttataggaatgggaacgctgttgtgaactgtacatgcaagggatctaggttgcatgcttcttataagaatctaatgcctgatgatctgtcactgtctcccatcacccctagacgggaccatctagttgcaggaaaacaagctcagggctcccactgattctacattatggtgagttatataattatttcattatatatagcaatgtaataataatagaaataaagtacacaataaatgtaatgtacttgagtcatcctgaaaccactccatcccccacaaccccagtccatggaaaattgtctcccatgaaattggcccctggttccaaaaaggttggggactgctgctttagaggatattgtcagtaaagtacaaagacaacccacagagtgggaaaaaatatttgcaactcatatgtctgatcagggatttgtgcccaaaatatataaagaactcttacaactcaataataaaaaaacaacctaacttaaaaatgggcaaaggatctgaatacacacgcctccaaagacaatatacaaatgaccaatagcacatgaaaagatgcttgacgttattggccatcagggaaatggatggagaaaaaaagtagattactggttgccaaggaattggagggagcccaggagggtagggggtgacagctagaggctacagggttattttttttttagcagatatatgttccagaattgactatagtgatggttgtacatatctgtgactgtaccaaaacaaactaaattgtatactctaaataggcaaattatatgatgtgtgaattttatctcagtgaagctgttgaaaacatttattgagctccaggcacagttcttaagcattttacgtgcattaactcatttgcggtcacccagtgaggtaggccctgttatacaaatgtcaccattttgcagctgaggaaactgaggcagagttgcccagggcactattaatatctccttctagtgcataaggaaaatgaggcacagagtttagagtttgtgttctgtctgtggtcacacagctggtacagcggaggcagaatcacagtgtgatcccagaccccactcttggccactcgccatgctatactacaggcaaagcaaagggttcctgcccatggggagctgtaatctacttgagtgtaggcacgtaaatgggaaagaggttgagaaactgtcaggatgaccacctactaattcgctctgagacttcagttaaggcacagaattcctgggcctcagtttcttcctcttttaaaccaagtcttaggctggataaaagagggccccatcctggggttcatgaaagtagtaatgctggtctatggataacacttagcataaaaaaaaaaaaaacctaacattatatttgcattcaggcctggagaccatagagcatctttgctcttggctgaaattacgtcccaccagggtagtaaccctggttacctccagctgatgagaagcttcgattagcagtcacgtatctgactctgcttgacaagaataagaaactggatccctcattgcttgttctgggaccacttgctggggaaggccaccctcaggtctaggggcttccgctgcgattctctaaggtcatttgaccccctgggacttgccctcccttggactccctggctttcctctagtctctagggtcccagctattttttccaccacacccagggttccctgtggcaggcccaagctaaggtggatgtgcagagtgtgggctggccagtatagccaagctgggcaaatgcacgtgctgtcaggagcatggacagagctcccggtgctcagagtccaccaccgcttctgctcttcctacaggcagaaggcaaaggcctgtttcccactgaatagcaccttctccagtcatgcctggggagctctgaaaataaaccagattgggaatagtcaggatgtgggctactgatggcccctcgggtctatccagtgcattttctctggcactaattttcaaagaaagtttcactaaaacattttccactgggcaaaatcatgcctttagaatcagcctacactagagtcttaggatagctgagccaggagaaagcactagacaacatttatttattttatagataaaaaaaaaaactctgttaaagatgcttcatctacccttgttgttccagggagatgtggcctctgctaggctgttgcggctgagctgatgatcagggcaatttatccattcttagaaatctggtgagccctgcttcggctctgtgcaactgctaaattcagtttgtatggatttggcttggaatcacggccctgacgttccatttgattcagcttggctggggtaacgctcaggtcttttgtagaagagttcacaacactggccagttaaagggtggtgtgccctcaggcagtcagaaaatcttgtccactgactcattcattaacccacaaacagaacaggcattgccctaagtatttgggggtatgaaagaagctgatgtggatgtgttcctgtcccagaaggagctgatggttgtatctatgaaggtaagcatttttgtagatacgagcaccagccaccctaagcaaaggcagagaatgcttaggccagacagagggctagggcacttgaatagaaagagagcaattcttgggtacaagaagcccaagggaagttttctggaagaggtggcatttgagctggcccctatagaatcaataagattgggaaactgatatggtgtactttctctgtcaaaacatggcccatggagaacaaaaaacatagcaattgagacacagtaccaagtctggagggtagacttataaaaattgtgaaaagtgttgggaaaggaaaatgcaggccttttaggagagactaatgggaggtttataattcagattgggtgtgtaggggggtaaggggcaccaggattcaaactcggatcttaatgtttccagagcccacacccataattactgccctgcttcctcccagctgagatctctgcagggcccctgggtgaatcagagacagaagtcaggcctcccaactccctgggtcagccctctttcctcacagcctacctgctgcctgagctgctgcctcagggcacatgcctgtctgcctggctgatgtttcccatcagtggctgactccacactgtgctcttggaggtgaggtcagggacagcccaagcacccagactgcttagggcagacatgcaaggctcaggccctcctgaagcagtcgttaacctttcttcaaaggtcatgttgtggaaaacccctacttcagcctcccagctgtaatcacaaagggcatcagtgagaaagccttttcctgggaatgtctgttcttggtaacatgcccaggtcacaatctggaacatcagagtcccgttcacagaaacacggatcctgttgcaggcactctggccccaccatcgcccagtcctggagggtacttctggatactggacgatcaagttcagtgtctcctggctaaaggcagctcacgtaaacttcgcagctgcagcctgagaggcacgaggacccagtgtgtccacgaaccagaggtctttgtcctctgcctagggtttcccataaggaaaagctcacacggcaccgctgtccccacagcgccctgctgtggagcttgttctctgtgtgtccatgttccccgtcatgtgccctcccactccagtgatcattgctagtctgctgctgtcacttccctcctcctgtccctcttcctctctgacaaccctttcccagaatgcctctcctctcccctccctgggtgtcattctcttcaaaaaggttttttaaagagcgaatgtttaatttgtgtttgttgactaaatgaattaatcaagtagggctcttcattatgtaatgccttgtacatgcaaaagattatatgacatcaatagaaggtattaagaataaataaaatgcccactttaccaagttaaggcccctatctatgtggccctctgccagagtaacagcttccttaagtggcccttttttcctcttctccccgcagtctaatccactgtccacctgactgctggggccatctttgcccgcctcagctcccctccgttgctgtcaccagctacccaggtcagcatggcccgtcagcagagcacatgggctggcgccggccatccaggcagaacagaactgcgctagcctgtgccctgtaccctgctgtctccctgtcttggggtgcacagtttcctttacctggaataaccccacccacatgtcccatgtctctgcctgtcacacccacctttccttctaggccgcaaaatgtcatggttttcccaaagctgtacccaatttctccactcagctgtacttcctccttctctgagcccctttaaaacataggtggttttgcttttctcttgcagtgtatctgacattttgctaccttttattagggtgaggtttttttttttttttttttttcatttctaatctcacatactggattataagtgtcttgtggacagccacatgtctttgaatttgtagggcctagtagagcatcttgtgcatacataataggtcctcaacaaataattggattagaatggattgaacagtcctcccctaaagctcacctcacatctccttccctgaaatcctataaaaataagcacttgtctcccgagggagaagggcttcttggagcaggaatgtggttgatgcttaataaataatagctggatgaacaaatatttgcaaacatcctgcctaagatagaggattggactcagtgcttcctggggcagaaagttgtttaacctctatcacttcttgataaataatccctacattaggatatttggaattgccaactaggtatcatgtaaaggcaaaacaattatgatactgaatgtgcattctcacacacattggttgaggattacagctctcagaaggttgttcataaaggcatgatgtctctctgtaggtctctttggggacaggggattttgagggagattctgttggcccagtctcaactgttagtgcctttaagaaaacccaaactgattttctttagacaacactaagaaaagcatgcacaattctttgaaacaatttttaacagtaaaacatatttataccttttaattgtgctgtcttaacatttagagaaattaatatgcaaaaactttcaccactcttaactctcgtttctgttttccagtgctaccttccagtctttgtccatgtgtatgaaagaagctttcatttctgccagaaatgaaatcaaacttctgatgttttcctgttataaacatcaaatctaacaggcaaactttgtgaacacctactgtgtccaaagccatgtactgagaatggcgggagatacaaaaagagtttgttcactacacaagtatatactaaatgcttgccctgtgcctagagctgttctggtccatgataacagctgtgggtgagacaggtcctcagcttccaggatggaaagagaggcaccacacagaaaaataatatgtcaggggcagataggctatgaagaaaaataaacagggagggacttagagggggccattgttttatgagagtggtcagggacattctctccaagataacatttaagcagcctctgaaggaagtgtggaggtgagggaagagtgttctaggcagaagaaacagcaagtgcaaaggccctgaggtgggagtggtttttaagaaacagaagcctctatggcgggagggataggttggggaaatatgaagtcaagagagggagccagaggactgggctactttagaggctgcagaaggacttggacttttattccaggtgtgatgggagcccatgggaagtgttgatctcactgtggagaacagcccagagacaggaatagatgcagggagatcattaaggggctgctgaagtttctcaggagagaggctgtggtggcctatataaggtgctctactaggccgcacaaattcagagacatggggctgtccacaagaaactacggtggtagtgatttagggaggtagcagagcaatcaggtcctggatgtgttttgaaagtaaagccaacagatttcctttcatattgaatgtaggtgtgagagaaagagaggagtcaaggttgaatccaaggtttttggcctgagtaactgataaaatggaggtgatggtctctgagatacatggaatgggggggaacaagtttgggcagtgaagtcaggagttttgtttggattctcgaagctgcatatggctcctccgaagttcatggcaggtgctgctacgacaccgtttccttcagagccccagcatggcctcaccatctcaacacagtgctgcagaacccaatctagaatgaaaaccatcgcactttcctggcattgacagacaatccaggcatatccactggggaggggagaggagtgctggggaggaggctgttctgtggacaactggcatgatcagggaaagcaccaagggggagaggagctggaacagagcttttgtgtcaaggagccactggctgcaagtaacagaaaacccaattcagaagggcttaaaccataccggaaattatgaacacatatatcaagaagtctggaaattaagcaggcccacggttgcccaatgaagctatcagggacccaagtcttttctctctattcattgtgcctgcctcagcacaccagctggctcctccctgcagcagctccaggcattatggtttcaccacctaaatcaagggaaatgacagggtcgagcctctccctattttagaagccctgctgggagactggcccttacgctggacagatttagccctcattgcacagatttgggtcccatgtctcttcttaaaccaatcactggttagggcagtgggtttacatgatgtgcttctgccaatcaagaggagatagggacaccaggacacagctcagacttggccaacagggaagagagagaacaatggtggatggcttggccaccaacagtgtctgctccagccccaaaccatcaggaagaattggtactgagaagtaagaagggagggcgttctaggtggggagaaaagcatgagcagaggcacagaagcatgaagatacaaggtatgtccctcagacaagttggcggggttgatgagttgtatacagtgtggcatggaatgaaggccagaaagaaaccgtaattgctaaccttatttggggatcttcttggcttaccaggggtcttcagaccagtacttaaaaaccacagatctagaaggccaaccatctcaaggaaggaattcttgaagaactgtaagccttggccaattagactagataaagccactgttaatattcctctgagcacttccactttgggggaagatggaatgtcctcagcttagtccctgtgctgatgccaggtttagttgggtggctcttgggtagaaaaaagagcatgcaagacagagctttcctttggaaaacatagccagaagctgatcctgagtatcagtcatcctgctttcattgagattgcgtatcaaaccctttcaggtacaaatggcagaaatcctgcccaatgacttaaaaaataagcttagccacctctctcactgaaaagtctggctcctggggctgtaaggatgttatcaggacctagtggctcctctctaggctctgctttcctccatgttaacttcactctcaggtggattcacccctcagcctcagctccaaatccccatgcaaagtgtttctttactggatatcccaggaagagtcttaatgcttctcactgattctgattgacttatgttccatccctgaaccaaccattgtggttttggggaatggaatatgttgacttagtccccaccttaatgacatttggccaagagctggggagaagtggctcttcgaacacttgatgttggcaaagaggtgaaagaatgaatataaggtggccccaagccacaaatgtctaatctatgattttacccccgagtctaagatctcacatttttcacttcagcatcagtttgtgtgttttacagtctacaacaggctatcataggcatcccacttaatcctaataacacccctataaaggaggctgggtggcaattatcctatttatagatgaggagactgagggttagagaaattcagttatttgtccaggaccatctcgatcgaaattggcaagtctggcctttgaacctgggacttgtaaccctcttccagtgaagttgcccattacactgatgacttacaatgcatctgcctgcatattcgaggagagaagttcttaaaacttctacaagtgaaatcaagttcacttctgtaagtgaaatcaagttgaagagtcagctcaaggagtgcaatatgtaaatggtaaaataaacaacatcattaagctcaagggcatgttttaataacagttaaataacttttacaaaatagcaaatattttcccattctgctgaaatgggtcttaggaaaaaggattgtaatatagaaccccaggtggtcaagtgcacattggattttcctaacagcctcctttataaagaagagcttgcctgtggctttgtttccttactctccagcctcaccttcctccccttgcctatgctcaaaccattgcccactaatagttctgcagatcccaggatagaagttaatctgcttggaaggttggtccacttagcttttccccacaggtgtcattttggtacctggtgagagggtctgcctgtctccctctcactctgcactccagcaccagtcagcgaggctgccatcttccctgatcaagagctggctccagagtgaactgtaaagcacccctgttagatttcctggcatttgtaaggaccttttctggggcccagacagaaccagaggcctccagccagaggcaccaatcctctgaggccctggtgcatgggcaacaaatgagactttttgcctccagaaggagctataagcagaaattataggaagtataataaatcatcctcccgccctcaaagtagggccacaccaaggaaggtagagggaattctgtatcaaatgagctgatcaggccaaaatgtgtgtttacttctcattgagaacatatctgcaggtacatggtaaactacaagtactatactgtgttcctcttggttattagtctctggatggcacagccaattgcagtacaaggtgggatggcccctgtgaacccaagtcttctgactccaagtccccaaggctggccccctagatgccaggctgctggacaggaccctcagacaaggctagggaaagcagtaagtgctgtgcttcctgggccagcctcagcagggcactgggttgcaaggagagcagttcagatgaggtgggcactctagtgccttgctcagagcacaagcttccaagtaacacagaagctcagttctgccactcaccacctgagtgaccttgagcaagcgagttgatctctcttggcctgcatttcctcctctgaggaatcttctaatagtacctttcttggagagtcgtgaggatgaaatggggaggtgcacacaaaccacccagcacgacgtctggcacagggtatttgcttgatactttcgcatagtgaggctgacataggaagaacttctcatcacagctcatccacacccccacatcaggaatgctcaagtagacccttctcccctcccaaccttcctcctggccccggccccatccagctgttccttcttgtgggcagtggggtgggccctgtcttcagtgcagacatgccctgttgcccttgagtgcattggcctgtcccccccaccaaccccaacagctcacagggcctcttggtatgggaagtgcaagtcaccctgaggaggtgccgtccatgctggagccagattctgaggctgcaatggaactttgggctgatgcactcacattgcttgccttctgccaagagttctgctggggagctgccctcggctaacctctgagtgtctgactagatagcagcagcggcagcagcagccatctctggagccaagcatttgagcagagaacagctgctcctggtcctgggccccctcttgcctggcccaggttccagtcagctctgcctaaaagactccccagggcagcctggctctggtgccaggacccttcaccctcctcgttcctccatctcacccgcaacagtgtgtgactgatcgactcctcctgccactttgtcttatcacgaagattagcagggaggaagctgggatgtggagtcagaagacctgggttggagccccagcccggctacttgctggcctgtgaccttgagcaggtcccatcctttccacacttctggaagatgggagaagagaatctttattctttcttcttaattgggcaagtgtgattaattgtaatgcaatgcagagttgcctgatgagaagcttttaaagcaagccagaggtgtgtttgagtgaaagatgaaaatattctttacagccctgtggggcgggtgttggtcactcttcatctgtttggtgttggtaggtgaaagcaggccagctcactgggccactcttcagcctccatgctgagccctgttacctactgggtccctctcaagttcagtccctgtgggaggtatgcacagacatgtgtagccaggatttgacccgatgggccatgcactttgccatcacatggaagcagagtgggggacatgtggcagcttgtgggatgaaggggccagacctgggccctgccttctccccagcctggggtagcagggagatgccaactcttcctgggattgagcttctacttaaaaaacaaacaaaaaaaagtgttgaaattctaattaaaagttgtattaagttccagtgtacacggggcattttttataatgttaaatgttcccatttaagaacatatgccttttcttcaaatctggttttatgcccttccataaaatttttttttattaaacatacattgtttgtttggggaagataaaattttgtttaattaaaaaaataaacatatcttgtgaaatttattaagtttatatctgtgatcaagttttgtaagtgattcaggtcccaacaaatgatctattccagattcaaggaatgcagggccctatatatttctagtaattcaaattatattttttattttctctgttatcttaatttttgcctatatgtctatttttgaaatagacatctttgaaatttcacactaaaattttatttattccatttctaataatggatgcttcatatatttagcttctgtgtttaatgcattaaagtttctgatggtcattaatgtcttcataaaataagtgttccttttatcatcacaaacatctgtatcctctgcagcatttttttaaactaaaattctcccttatctaattaattttgacacttctccctccttttgtttgcacttgcctagtatctgcttgcctatgcatttattttcaacatttctgtatacctttattttaatcagttttcttataaacagcatgcacctggagcttggtttttgttttaatttcttaacccaatctggcatcttctgtttttaatgagtaatctaatctgttgactgatgtactggattttatttcttccatctacagtatgtttataatttctttctgtcgtattttgtttcccttgcttgtgctggtttaatgtagttgcttcaaatttcatcttttccccatattctctatgttcccatagagaacacagggaaagttctctacttttccctttcattaaaggttacattctttttcccttaattcataattaaacacatattgctttaatgttatttgaacacaagataacatgaaataactgttcctccctccaagatgttccattctctccctgctcttccctgcttcagtgggatgagacgttaaaattgtttccctgtccctacttaagatgagaccttggaacacttttcctcccatcctcttcaactccttgattctgttaggaacatttaatatttttagctttgagctgttggtggaatttcccttgtagtatgtcccttctattttcagagtccttctttagcagttccattcccagaacatctaccattctccatttagatttaggagaaaagggaggggcaggtgtgtggcaatcttccttactcctcacggtttcctgaccagttcattttccccaggtcaaggaaaaatgttctgccacatttgttgtttgttgctttaagtattttccatagatgagatgtatgggtgataaactatgaattcttgtgtgtttcctctaaaaaatgatgggcaaactatttgaggtctttggttatcttttctgagtagtgtatacatggtattctgctctcttttagtttgtagtgtttcagatgagaagttcaatgtcagtcttactcttttttccttataggcaatatgttctttctgtctggaagcttttaagattttgtgttcatcttgaagtttagcagttgtaccaaggtaacctatgtgtatgtcttttcttgtcgtccttcctggaactgtgtgagccttttcaatctgtagagtcagttcttttttcagttcagggcaattgtcttctgtttgttatttaattattggctgtcctctctcagtttgtttttctacttctagaactcccaatatttttaagttagatccccctggatctgtcctccatgtctgttatcttttcccttataaattatatatctatatttttactgtatatttggagataggttttccattttgtcttccagaccaccaattcacatctcaacagggactcacctgcaatagttgggaagacattgttttaatatgtgagaaatcttttaagtctgccctgagttgctgtagggctcatgtgatgttctgcttgagttttcatttgtctcttggagcagctgcacttcactgggcttgtgcactgttcgttctgacagatcttcttctgccaggactttgaagcatgttgtgagtgttctttgttctttgtacctctggttatggagcccagagtggcagcagtccacagctggtgggagtggagctgtccttacccttggagccagtggtattgaggcaggtgagccaccagtctactcctgagacatctgtctcccttacttcccattcccctttggctacagggcagggggttgcagcccactggttcagccacttcttggtctgacctgggtcaatcaggcaaagccagtttctacctgcgctccattacgtgccaaattccacccacatacacacacacactagggatccactggtcttccttggccaagttctttccggcatccatggcttttgatccttgctccaaagctctctgaagctggtctctaataagggagatccccacaccagtttttcagccttgtttcccgcatgtacccccatctgcccaaaggcctcagcagttctctaatttaggattgaacagataggttagagatgataatctctttcaggttgccatgttctcaggatctgttgtcttttctcagttactgatggatcaactgagactggaggtcagtctctttctctctgtctctctctctctctctctctctctctctctctgtgtgtgtgtgtgtgtgtgtgtgtgtgtgtgtgtgtgtgtttgtctttttttctggataggctatccctatggctgcactcaggggccactaacactccccattactctttgtctagttgaatctgattagacactggactagcttccagaatcatatactccagagtgcctcaaattacaggacggacactgccagtggcccaagatgagttgcagtggtgcaaggacagtgtttgagaatgttgaatcccgtggtgggaaagttgtttgttcagttctcttttagttcttctaattatggcaaatagtctcgcgtttggcattactatgcctttgacacatctctagcactcattaaattcccttttaataaaacagagatcaaatgtcatgcccagtcttcagtaggcaacagtattttctgtggtggggaaggctgaaaggggactgggtttgggggggggaaattagaagttcagttaggagcccatttattctgccctgcctagtacatatttaagtggagatgttgagtcggcaatccatggtcttagccctggggcactccagtgtttagatattggattccttcccctttgccaaccaatgcagaaggtgcctttcctacttgttggctgaatgtctttgcatcggctagctcaggaggtttgtttcccatcactctgggccacttcttggcagccaaggccacgtgattgtcattagtgttccgtgtgtctgaccaagcagcccttaagtgcaaacatggaccgtggccaaccttccagctgtgtagagccttctggctgtgcatcttgttgggtccttgggggggtgtggtatcccccagtgaggcttcataaaaaggtggaagcaagctgaaccgttttcacaagtttgaacatggttcacactaatgattcactggacctgtcaaatttctgactacagcccgtatttattaggatgaaaaaaaaatcttccattagtttagcacttttccttcttaccaacatgcaggaaacatttattctacctgaaacgtgaggctgatgccattaactgactctgtgaaggagtcctaatgccaacagggccagcaggctggtagactgagggctgtgggcgtagactgacacctgatggggcgtgtggatcacgagagcaccagcctagcccacggcaggcagccaaactcaggcctcacctaaggaggcagaccagcatgtccgattcttcaggagaaccagaaatcagtgtccttttgtgacaattcttctgatttataaatgtttgcttaaaggaaaaaaataaaaagaaaagaaaaactcaaaactactgcaggccaaacaaaatacatctccctggcccaaatccaggctgcagatggccagtttgagacctctgctacgtgactgcaggccagccaatcactctgattcttatacttcccaccattactgtgaaacagagccactaccaggcttgctgaggtggagattatgagtggggttctgttttagctcccagctctgctgcttactggctctgagatggtggccaagtagtcagttaacctccctaagcctcagtctccttatttgtaaaatgaggataactgggttattcattcctatcatgaggacttcatgagaaaatatataaaaatgtccagcacaaagttggtgttttgtcaagaggaactgttgttactgttcagtaacacgtgaaatgtttggaaaacctgaaagggagtgttgggcatttgacagttatgggtagtggcacaccacccagagcagaaaaccccttgcccatggttctgtcatagtgaggggcaacagggcctgatgatggtggatatattcctagagtcctggaacttgccattcaggaagagccctgttccccagcagcttccctgtggggtggtgtcagaagcaggcctagctgttctcccacaaatcggtctggacagacttgcagcctctgggcagcccctgcctgttacagagcgcttcccaagattgaaaggtgctgagaaggcaggggagagtttcctgcagctcctctgggagagacaggggattggggcaggcaatagctcttgggtgggagtaggcaggagaactttcagtctgaagttagacagggaagccctgtgcatttctgacctcaagagccccattgttattgcttctcattttgacacagatgtcccagtcaaggccactcctgtgcacagccctttgttctttatggaaagtgctgccaggcacacatacgcgtggctttagatggcgtatacattcttacatgaccagctgaagagccttagggacattttgtgatcagtgggcgtcagcaagtccatgttggagctggggacatgcaggagccagtgcaggaagaaagccttgtttcagagggtgtggatagcaccactttaggaagcccctcaggaatgagagcaacacacttgaaataggaccaaatgcatcttcagcctcacatgctgtgtgaatgccgcctccttgtcagggaacgtgatctgcaccagtcaaagaggcaaatgccaggccttgcactcaggaggtgttgggtaaatgtttactgaactgaattccattcttgggagccctatttgtgccacatctaatgctggaaattatgtgtattctaccccttctcaccatccttcctggtttccaactgccctgttccataccagcctgacccacatgcatgttggagcttgaagctcagtggatacagaagtgtcttgggacagttgtctcagcattgctggccgtggtgataataagcagatgtgactgtgatggtgatcccgacagtgtcagagctctccctagacagtcttcatccatgcatccattgttcattccttcagtagccatgcgtctggcactggccagggctgagcagacagtgctgggagtggtctgcagaaggggcagggcgggggttcatgtggtaaggattaagctagaaaactggaaaggcctttaaagaggggtaagagtttatgactcagggccagtgtgacaacagaaatcttctgattgttgggaccccttcttaatgtggacattgtttaatgcctttaccctttttcacagttggtcagaagtcttgactctcaccagcctggtctgcttcctctgaatgtgcctgaagtcatcagtattccttggatatttagtctgagggctgtccataaagtggagagctcttgagaacacccatgtttgatagccacataaccttgggaaagctcattaactttcttattaaccagtttcttcatcttcaaagtggagctagcactaacacttgcatagctttgactacagctgatgtcaggaggcaggggttattgggaggattcagtgtggcagtgtccatgaagcccttagcacagtgcctgcacctgaagggattcaacagaggctgccgctactctgttctcccaggcccagctctcgctactgtggcgtggctaagtgacaatgggcagtgtgggctgtgggccttttttctttttgtctctacctgaaatccagatgagagtctgagagagtggacagagtctcaggatggcagcttgaggggcctgttctccttagcctgcttgtcttcaacgtgcaccaattttaggcttgattcacactgaaaattcctcagctgccggctgctgggccagaagcaggcctttgtctcagagagacccagagaccatgatgaaggctgagcatacctgccctcctgctggcctctcagactgcagcagagcctctactgagcccgactctgagagggaacagctgggctctccacagggtctgccacccctacagccaagtatgtgctttggctttggcatccagaacacactgccccacccaaacatccctagagaggggatcgatgtggaagcccacaaagtgatctttgtggactctttttttgggggcatgacccgctatcatggttattaatgaggaacttccatatgcttgagaaggcctggagtgggaagcctgggagccgcggcggggctatttaaatccaccacacagagagtggcatcctttctgggccacgtctaccaccagaaaaggaagactggctgggctgggttttgctgtgtctctctgtgaatgtatttctctggcaagacatgctgtcacctggaattctcccctactcttgttcaaaggcccaacaaaggggtggcgcagagggaaccagaaggatgtggctcacgtccatgtagtcagagatgtttggggacctgacccaatgcagacatagccatctttgtccagcaaaagttggcgtggcaactgaccactgccgtttcatttgaggagacatgagttaccctggagaggaatgtgcattcagacttgcttttggcagactttaccataagcagtcctctcagaggacatgagaaatcatgatttccctgaggagcccccatttggggtgatctgtaccttttgccttgaactctcctaggcagggagctgagaagggcgtcttttgtctgtttcagaacactcacctaaaatggtccaccatctggggcaacgcttaggaggctctgtggcaaatctcaaaggcacgtgtgccaagcagcctgcactggagaatgagggattctgtccatgcccctttgtctcttcaggttgctggtggtgtattggtgtccttctctgcccaatcacatggcaaggagaagaaaaacaagtcttcatttaaaaagaacaggaagggaaaaatcaagagcctatgaaaagcattttccaggctggctaggtctgtaatgtagaagagacacaagggagtgaaattcctcatgttttggggttaggtggagtcgggggaggagtggacagtcctttgggatcagctgatccccgaaatgcccaaaagagaaaatgacctccagtatggcttgcttggctcagccgctgcaaaatgggatgggggcagctgctgtcctatggtggtgtaaccctcagagccctcagaacctgttcagtaaccaggcaccccctttcagatcagcaagtctgtgtgaccgtccgatgccctgctgccatctttccaaacaaacgtccaagggctatgcagcttcaatgccgtcaagactcctgactgctaagaacagaaacctgccctagagtgactgaaacgtgttgtctcatgtcactgactagcctaggggtacactagcttcaggcatggctggatccacatgtgtgtgatactaactgacaggtgtggatcaggaactcactcagccctgggacttaggctagaagtggggagaatcctcaaagtgtgagaaaggatggttcccccaaggaaagttgagctcctatctctcaaggaagggaggagttgcacaggcagccagcagatgtccactacagccctcatttgccatttgcagagctcaggctccctcaggtatattctgcagtgagtcaccaccgcgccccacagcaagtcgcaagggagccaggaggaacccagataggagccctcccacaggctgtcagagccccacctggtctgtttggatgacagagccttttggacttgcctggtgtcagaaaggacaatgtcttaggtaacctgggtttgtaaaagccttgtctgtgagctgtcagccaaagacagcagcttttgtggtcttttctctttcctgtggttcatgagaacacatctaggcgctaatgagcaggaacataaataatgaacaaacataccgtcaacaggaaggcaggaagtttttttttttccccaaagactgaacaagatgagcaaagctctgcagccgtacttgcgcattctccacaaaatataattaaaaagctatgcagactgctcccaatgtacagtattgtttatatactaaacataatgtactaataggaatacctcacttcattatgtcagcagaatacgaaagggagatctagcagctgcccttatcaggcagatgggagaccagaaatgttacttagatctaggcagtaaaattgacattgaaccaatttgcctcactcgtgccgcttttactgtgtttaacaaaagctcatgtctgcacataaggcattgtgaggaggactcagcagccataaagctctctgtcatgtctctgcaacataaccagtgaatttaaccgttgggtttcaaagaacagttttggattttcctggaaataagcctacagaggacagcataaggcagctgtgtgtcctgacccttagaaacctgtgagaaccaagacatcagggttgaaggaggggaacccatgccagtgaatgagggagcgagtctagttacaatcacaaggaaagggccacagactccgggcccaagggggaagactattcagtccgcaaggtggagatgggattggcagccagggctatgagtgggggatggtggagagagatatgtccatctggggccactgtttacaggctacccaccttcacagaaaggagttatatgtggagccctcattttagagccagaggtcccaagcaatcacctgtttcattcagccattcatccagcattgattgatcattcgccatgtaccaagctctgccctgggcactacagtctgtgaactcagtcctcatggagctcacgtcgatatgtggggaaacagatggtatacaaataaaaatatacataccaggtggtgatacatgtgatgaaggaaaataaggaagaataaaggcacagaataatgtagggaaggggccgtagtcagactggtctgaggaggtgacatccgagcagagccctgaatgcaatgaggtatgcaggtctctatttcagagctcctcaatcttttgtccaacaagaacccctttgattatttgccccccatgagtcactatgttttgtgagctggtgtatcccagaaaggatgcatttggcaaagatgtagacgtagacatagacatagatatgaccgtgacccttggtcaacctgagaaacggggcaaccacaggaagttgatgcaacccagccccaaagccaacacctgacctgtccaagaggctgggcaatatacatagaaaatgagtccagagtcccagtggcttgtccaagcttatgccagctggtcagcagcagagctaagacttagaccccgggtctcctgagtgatgaaattggggtggaagctgccacagtcagtggcagtatttcccaaacacacaggcatgaaaaaggcagtggctggaatctgagggtgggtcaggaggcctgaggtcttcccaagaggaggccgacagagctgccttgaaggacttcctccaccaccaagggggagccccaggccagggccgatgatgcaggcctgagaaggattcttctgccctcatcacctggggttgcagtgttgatggccaatctgcataagaatctgagtcttatatctccaaagttcaagtcacgatatctgtaatctagggccaggggccccagaccagcaatgctacccagaaggcgagaaggaacagagctctagcaggcagttctctgagcattacgctgccgctgccgtggactgacagctggcctgtgcagcccccacctccacccaccccagcactgtgagctgagggaaagggcagggttcatgttgtttttcagataatgacagcagaggctctgcactggaatcacaagtcctggccttgcccctggctctgtctggtgacaattggcagctgacatctttgcttctggccagagctaccccttattaaaaatggcatctttataatagatttctgcaagtcattgtcaacaggacatccttcttgttttgtaccaatcattcctctgggggactgattttgcctgttactattattttagaactctttagaatacccttttattctatattattctgatattagaatatcaagttttaatatagtattaaaaatatagtattaaatatagtattttaatatagtattattactaattaatatatttttatcgtatagtatatagtattaatatagtatatagtatagtatactaattatatagtattaattaataattaataattactaaagtggtcataattattttttaaataaatgttcgcataccatacagcttcaccccacaattaaacagctggatttttagctgagtcttctcttctttccaaatagccaagggatccatttgtgcccaagttattcatcctcactttgtaaggcctaggtgtcacccagcctctatcttgtcccatctaggttttgtggttttctgcctcccttgggagaagcaccctcgtggtcagacaagccccccagcccgagcagctgaatctgaagctggaaagagctctcattcgtgagcagcccaaatgtccaccgtgaggggtttggttgaatagctcatggcccattcagatgatgagactaagcagctaatagaaccccagggtcacatggagccacatcaatgacttcttcctgaagtcatctctggccatgctggatggagcctggtgcccctcttatgcatgtccacagctcctgggctagacagcagctccagaaggcaggcctggccatgcaggtcgggctcactgccctgtatccagtgcctggaatgaagaaagcacttcataaacagctgttaaaatgaatatacagttcagtgtagaaaacaacatgtacagtgggattccattttagggaaaataatactcgtgcggactcccaggtaaaaggactgaaatataccccaacatgtggacggtggttccctccagctggtgggttgatggctgaaatttttttcttcttttttgcttagctgtgtgggctataatctataagtgttccaagaacaggcctttcagtcagggctggagaagtcagggaaagaggagggaaagctgccatttaaaagtgatccacaattagagcagaaccactggtgggaggcaagatggtttggggacgaatgtgtttttttttaacaggtgagcatttgttttaatgtgtagctgagaaaaaattttgagtagtacattagccatagtactggtccctgctgctcctctggcctcatcccccactttccctatcactcactaggttcaagccctgctggttcctcatcattagaacactaaaggtgccccggggcctttgctcttgctgctccctctgcctgttgcgttcttcctcaccaatatgcaaggcccacttcttatcactgaggcctcagcttcatgccacctcatggctcttaactctacccttccccactaactactagttttgtgtttattactctgtaatatttgtttacttctttatgctttcccctattgagctgtgagtcctttgaaggcagggcctctgtctgtcctgttcgccagtctcctgggtgctgtgtgaactgcacctggtacatagcagtcagttctgttagatgagaagaggaggatgccgtcagtggggggattgaaggaggccataatctcagggatggctgagctctgccagtcaaggaagcagcctttatgcctggtaaagagcaaagcttctgacttcccatcaggggcctctacactcttggaattctgggaaatcagaaattaagacccagaataattgctttgcaaaacatacacatcttacttctgcccaaccagtggtccctctgagccagtcattcaaaacatggatactgtctggccccccagcaccacattcagttgagtcaaggcactgctgcaccagatggaaggagggcccgtggcttgggaaacaagactagtggtctagccctgctttggcactgaattgcctgagacttttaaataatattagcagctgacatttattgggccctactgagtgccagaccctccccacacattaatactgccagtgaccctgtgaaggacaagatcattgtccccattttacaggggagagacctagactcagggaggttgagaacttgcccacagtccaactgtcagtgaataggagactcagggtgtgccccactcttaacacgtgctcagtatatatatattcatggagggaatgaataaacaaaggaaagagtggtgttctctaggggatttgggctgctgcagttcctagaaagccctcccagtccccagccgccaccgtgtccacatcgtgtgccctctggaccactgcagaccactctgcttagtcctcagtcttgatggtatcccctgagtcaggaagccaggtccctcctgcagatccagcaccactggccacaagaccacattccagggaaaggaaatacaagagcagagttagtgggagctccaacaggtagaagaagagggaggagggtccaggcggggctctctctccccgttcccctggggtgcctgccctctgctgagcccacctccaagtaggtatgctgccagtgcctgccagtgcctctcaaccaggcggtgttggtgacatttcccccattgagtcagcttgctgttcatgccttctccttgagtcaatggaagcctccctcaggagggaacggcagacccgtgccagtgccagctccagggaagcctgctgactggggtctctggcttccggtcccaccggccagcacgtgagctgccttcatgcatttcacacacatttcccgagcactctgtgggacaaggggggctctgggaggtgcgaagggaccacacagcgttgtctccaggcaccggtgctgttctcttgtctggattgtcctaccttgtctgtccagccagcacctgctccgtggtcactgctgtttcctgagaggccggtcccaccctccaccatgcacctgtactgtaggtgctccttcaggtcgtattttccccttattcccattatgatttatagaaccatttgtgacattacttctttcatattgttcttccctattagaatgcaagctccacaagggcagggattgtgtctgtcgcttttatcccagcccatgatatggtggctggcacctagtaggtatgcaaataatatatgaaaaatgaattagggaatcaatgaatagagatgcttacagaatatacccctgccccccacccctacaggaacacctctaaattattgggagctggatcttttaagacagaaggtaaaaacatctttccattttgcatttgattagatgtttttctcacctggtgtcacccatcacctcccctctcccaggggagcatcaagggaggtaagacgcctgtagcacaatggaaaggcctctgggggttttgtccctgctctgccacaaactaaatgtgcctgtaggcacatctcttcctctccatatcacagttttccatctggaaaatgactatttctgtgtgggctctaagcagaaccatttatttggccagtcttcgtggcaaaggaggcagggaaaggaactcttcatgagaagggagtggctttcaggtggcagccagcacatccttcaactggcccttggcagatgccacttttttgttgttaattttcatttcttggcactagccttatcttaccatctagattgagaagctctggaagggagggaccaggcctcataggctttaagtcggaagagaccttccagcaggctgaacccaaatgtgtcactccaggagattcgtattgatcaatgactctaccccttttactcaagtattctctctaggtcaaaatggtccctagtaggttaaacacgaagtgtctgtctcccattggaaatgacttgttgttcttccagataacaagtatacatttttaaacatgaaacaaaacatacaaagaagaaagtttaaaaaaatcactgaatgccaccacccaaaagtgattattaatacatcttgttacacatcctcacataataactccctctccctccttctccctccataccacaccctacctcctgcccccacccacaaacagttttatgaaaacagctgcacaggacacacactgtaaccagcattttcactttaccgtcctgtccagatcctggtctcgtaggttctgtggagcccccaattcctggcatgtggcttcttccctcactgacatctgacagttgtttgattaaaaatgtgtcatatgaggccaggcaggtctgtccctacctccactggggaggcagatggcttcaggggccacgtcccattactgccgagatctccctgacggctggaaaccattggtgctgtgcatgggagtgaagcactgggccctgaccctaacccaggcagccacagcacagctctccgtcagtgttcagaaacatatttcatgacacgttaagacagcctcaaatcaggaaatccaccttctcatcccacaaccactcccaacgtgttcatttggtaaatggtaaatgagcagattctctgctttggtccggagaaaccccctctgccgctcttcttttctccactgtggcttgttaacccttgctgctgttgttgctgctcctcctcctcctcctcctcctgacaagcagtggtcctcccagccttccctccccgtggacccagttcacatcctcttcctcaagaggacagacgcgggacgcctgactgactgcacgttctcccccgtccctcgtaccaagtatggcaacaataataatagctagcactgattgactgccgactgtgctgggcactctacatggattcattcttttgatcctaaccatgaaccagctctgttaccacgcccatctcccaggaacagatgcggaaacaagcacccggtctcagctagagtctggctctagaagcccccgcttcctgtggatcattaaagggattgtgatggaggaggagcggcagtccagtcccagggcaggagccagggcgctgataaagggagcagacgaggggcatttaatctagctggagatgtagtgaaaaaccatgtatcccaacagcctagggcctctgagtttgtgaccctccagaagttgggggggaaactgtatgtgttggtacattgtcacactgtcagaggagtctatgattcagagaaggagaatggctgctgggccagatgagcctccaaggtcccttccagctcccaagcctgtggttctgtgaccatataaggccagcatgcctggggagtctcactgcagctaagtgcagtcctacactgcaagggggaagcagagagcaaagggagcccaagtccaggcctcctgcagggtccctaaggcagcagagagagaaatggaggtgcggggagaaccagggtttctccttggttgcctcttcccagaaagctcagacctgtgcaggcgggcttggttgccaccctctgtctctccccatacccacgtgagatctcctctcagcagcgttgccaggtttccagagtccagctggcggtttctgtccaaagtcaaacactccacagtcagtccttggttgttcagacctcctgttccttatggtgcttctggtttggtggcctggaacacccctgagcgtccctgagttttgggtggacatgaattcagaatctagcttgatctccctttgataccctggctttgcagtcataagaaatctagtaggtccccaccctgacacacacacacacacacacacacacataacacacacagggacacacacgtctgcctcctttagtgagtgctctggagagggacaggtctggtgcatctgtgtactcctgactcatgtagttatgtcccactttatccaagcactgtctggagctcaaccctatgccaggagatatgggaagaaagcagagataggtgagatgtggtgctttaattttaaaaattaaaaattagtaaacaagtcttctgggagatgatctctgattattattgttatcagggtacaaaatatgtaccttttagtcatgtctctgttggttctaagtggcagaagcccaaatcaaattagcttattcaaaattgagagggaattatttggctcatatcactcaaaagtatggggtgggcttcaggcatggttggacccaggggctcaaatgatgtttctgggacttgattctgcactcaatcgctcagctatgtagatgaacagcccacctggggctgctgcaatgtgagatgccactgactgttgctaaggtatctcgtggagcctcgctcctgatttccaaatcctggccttgtcacctccacaactcagacctgggctgtcacatgagactgaactctccagagctgtatctccaactccaacccagaggcctcctttccttgccagaacattgggcagatacaacagggtgagttccaatgcttgttttgtgggtgaaatctctggattctcctggatatagggactcagggcagaaggagaagccctgcctttcagcatttgccatttaccagctgtatgtcgagtaagtggcctaacctatctgagcctcagtttcctcatctgtaaagaggagataatttatctcctagaattgttttgaaggttaaatgaaatgacacatgtaaagcacttagcacagagggtaaaccctcaaacatgagctgcaattattctgcttatcttatactgcaaatgaaagaaattatgtttgcaggattttaactttagaatgaaaatgctattattttttttggttgagacagagtctcgctctgtcgcccaggctggagtgcagtggcgtgatcttggttcactgccacgtcctcctcctgggttgcagtgattctcctgcctcagcctcccaagtagctgggactacaggtgcatgccaccacaccaggctaatttttgtatttttcagtagagacggggtttcaccatgttagccaggctggtctcaaactcctgacctcgtgatctgcctgcctcagcctccgaaagtgctgggattacaggcatgagccactgcgtccggtggaaaatattaatagctaccatttgttttatacttactatatggtaggcactttacatttattcctcccaactcttttgcttatgaggaaaccgaggctcaggagattaaattgtttaccagggacacacagctcatcctgtccaatgcccaacctctaaccactgctctactcggcctttctaaaatggtgtggggaaatagaaaataaagagggtctttattgatacatttaaggatatttgcctcaaatcaatgctagcaagaaaaaaagaagaggaatgtggcatttaaaaaagccagagggatgacttaacatttaaaaattcagtgttcttctgagttttgggagtatgaataatatttcctgttgtcggtgaaaccccgtctctactaaaaatacaaaaaattagccaggcatggtggcgggcgcctgtagtcccagctacttgggaggctgaggcaggagaatggcatgaaccaaggaggcagagcttgcagtgagccgagattgcgccgctgcactccagcctgggcgacagacagagcgagactccatctgaaaaaaaaaaggatatttcttgttgttctgtatggaccaaattttctagtcttaagtatttattacattgtagtagaaggggatataaaattctacccagaaacaggaagcctatttttaacctaatataagccagtttgaacaacttatagggctaatcatgatttgagcaatttcccccaaattgcaacatttctgcaaactgcaaatgaagcttctttatcttgggacaccccaggcaacagattgagacctgccaggcagtattttcagcccatgaattgaagtgtgatagaaagtactgtgagcttggagacctgtatcctgttcttggcccaggctcttacctgctgagagatattggggcaattacttattctctctcagcctcagttttctcttctgtcaaatgggtataataaaatcccaccctttccacctgatcaagtgcatataaagattaatgatatcaataggtgtgaaataggttgaaggaagtcccagagccagccataggtctagagaacattcccaggagagtggtagggtctgctggtcccaaatgaagcatgagaaactcaatgcactggcttctggggaagcatatcatagcatggggaccagcaaatcctgcctgcaccactcaggtcacccaaagggtcccaccctcttaggggaatctaggtaccagttgcctttcttttctgttttttagtatttacgctagagtttacaatgtgtatcttgacttattacactttactttcaaataatattatattaatactacttttttcacatacaagaatctttctacagtatagagtatactttcattttatccctcccatcctttgtgctatggttgaagttttatttctatgtatgttataaacataatacatttttcagcttcttccctctctttgtttcaatttagatagtttttattgccatgttttcaagttcactcatcttctgtatgtctaatctgctgttaatcccatccagtgaaatttttattttagatattatattttcatcagttgatattcccttttgttctttttaatgtcttccatttctttcctcattatgttcataattcccttcaatttcttagaaatatttaaaatagatgttttaaaattcttattaattccatgatctctgtcactgctgggtctgtttctgttgactgcattttatcatagttatgggtcatgcttttctgcttctttgcatattcaggaattatttgtgtgatgctgatactatgaatattatattgttgaatgtctagattttgttgttctcatgtaaagactgttggactttattctccaggtagttaagttacttgtagatcagcttgatttttttttaactttgtttttaagcttcatgagggcaggtctaaagcagcctttactctggagctagctcagccccgttgctatggcatgagccttctggcgtctctgctgagtgccccaggcgttcaacaaggactcttcactctggctgtttggaacttgaatatctcccagccttgaatgagctctgggaagcgttcaactgataagctccctgatgcttgttctttctttagtaattgttccttgaccagctgtggaatcttaccctatccagccacagactccaaggagacccctgtgcactctctgaagcatctgaagtgctctctcttcgcagttttctcccctctggtacgctgcccttccagctacctcagctttcctgaactcactttttctcttcagctcagtgaaatggctgtgttctgcctgggttccctcctgcactgtggtctagtaaacacctaaaggcggacgcccaggccatcaccggactctcctccttggtctcccttctctcagggatcacagtcctgcactgtctattctccagtgtttgaagatgcttgtttcacatattttgtctggttttctagttgtttacagtgggagctagcaaagatccctttgagatctctctggggtggtgcaccagtggcctgtactggttatgtactccctcaagatacttttacaaaactggacttaggaataatgaaagtcgacagaaagttaatagggtcattctgatctgctttttagagaaattcagggtgaagacccgcaaaccagcaccaagtggaatttgcagcaggaatcattattgtacgtcaactgatgactggataaataaaatgtggtacatccatacagtggaatactattcagtaataaaaaggaatgagctactgatacatgctacaacatgaatgaatcttgaaaacattgtgctaagtgaaagaaaccagtcacaaaagaccatacattgtatggttccatttatatgaactgtccagaatagccgaatttatagaaacaaaatgtagatcagtggttgcttagggtaggggcagggcatggacagtaactgctaatggatacaaagttccttttggggagattgaaatgttctaaaattagattgtggtgatgattgaccaaccttgtgaatatactaaaaaccattgaattgtatactttaagtaggtagagtctatatatgaactatatctcaataaaactgttgtttttaaaaaaagaagaagaatctttagccattttctcctgcatgaaagtaatgaaggaattggaaggagccttggtatggtagaaaggaggtctcagttattatattggtgcgtgaacgtgtcacaagtagtgttctatctgggactgaaaatatgaccacagaagagtttacatagttcattgagggaggacaaatgtaggatgttaatcttaaaattcatttgctctttctggattactttagttataagaggattcttgtggttttggcgtgagcccctccttctagctttctctcctgcccggatccttgtcagcagtgagcacatgttgagtggctagcaggcagtgccacgtggcctctgaaagttgtgatgtcccctttatgtcttctttgtccctgttcagatccaccagaacgagggtggtatgtggttaaatcctagccaaggatgaaaaagtaggcaaacccttttattgacttttctgttgtcaaagataaagatggttatttgtttgtcttaagtgaatcattttaccttcattaaaagcggtgagttttctgtgaaagaaaaatgcatcatccatttgcagactttttacagggattttcaacaatatgcctctgggtgtacacctaagttgggaccccgaactttgcttaaaatactcatgactaacatacattgagtgcttaatgtatgcccttcctgttctaagtactttcaagtattatcacacctcattgacggatttttctttcattatgtagggaatgtgaaaagactgcatttcttttttccaagattctgttttccagtaatttaggtagctttttcctttagattttatgacattaatgtagcaactcagtaactcagcatctcggctggacctggcccacagtcagccagtgcgtctcatgcctgtgctctctgtgttgatgaggacaatgctctcatcaggtgtggtgtgtgtggtttttctctaggatcatccatgaagatggcttctccggagaagacgtgaaacagtacaagcctgttgtctacagcaacactatccagtccctggcagccatcgtccgggccatggacactttgggcatcgaatatggtgataaggagagaaaggtaggcccctgagcccataagcacagcaacaagaggttctgtctgtgttaccccactgcctcctctttatagtgctgggctgccttaaatgaacgagaagagactccgctatgtttgaaagatatatggtggcacagtcaccaacctaagccattgcatccacccctctggcaaactcccagcaaactcaccaactttgcaagttgcaggggctacaaaactcccggatttattttgcagatgaggaagagttggtgacagttctaaattggagctgccacaacactgtctaagtacctgtccttgggcaattaacttgtacagaaaaaaatatgtattaaacaaaacaagccttgtctggccaccatctcccctccttagaagaactttccttgccttgttgtggagtgaggatagccatttgaattgactgcctttcctcttttacaccaagggctatgttttctgcctcccctgggtaagtatgaggacctacagggctctccttcctgtagaaagtcagtgtcctagaacagggactgtttgggggtaacatttccagtcttctattaagtggtgaatggaataagtactatataaaagcctctaatttgcaaacatttatattaactgttaagactgaactatatacagctacactggcaaggctaaataaaaggagggagggagagagggagaggagaaaatagcctcagaattctttccagaagcagctctttgtccctgtttgggactgaatctcagtgatcctccctctgggacctggagattggagaagggggcggagggcaggtacagcctccaagcacctgggctctgcatctgagcctctggatggagagcattcatctctgattgctgtgtgatttgattgtctattatacacatgtcctgtctttgctaaaaatcatcttcctcacagaggaaaactgtcctggttgtctctgtgtctgataaatcatccatgatagacagctttaaatgtaaaatttgatatgtaatgcacaaaatcctaattccatggggcagagtcatccagcccaggcattggctcctccaggtactggggaattgggtgactgagggtatgtccgaggccagcctgcggtggagaagctgggcactagcagggggacctgggcccatctgccgctcctcctggaggccaagttgggaagtggattctgcaaaggaagcacttcttcctggaaggccggctttgggtttggtcacggagccagggcctgtggaaagagggaatgggggagtggatgggtccattcactgcaggcttatgatgtgcaaggctttgagctaggtgctgtggatacaggaatgagcacagcagggaatggtgtctggttgcagaaaacacctattcagatcgttagaactaacccagatgagtacagtgcttcattcttcttaataacaatagtaggaataaaaacagctaccatctgttgagcacctactggctgccaggcacatactaagcactttacacataatgactcgttttatttaactcattttattacagcccagagcaaggagtgcctcatcttcaggcatggcacaagccacaggcctctggtctgtctgtctccctttgactaagtggggagcgtgatatctgaatctcagccagatagcagacacagtacaaaaggcacaccccctacacacacacacacacacacacacacacacacacacacacacacacacacacacacacacacacacggtgtgtgagatcttccaggagcaaatgtattcatctcccagccagctcttcctaaaaatctcctatactgattataacccagcaaagtcagtgtggctttggaatacttttctccttccattttggaaaacattcattgttcccatgggatttttttttccattttattatcctgaatggagagatgattgcttgggaatcgctaggactatgatacgttaaggactgtactgcaggcccctgggaaacagggtcccttctctggctatttctcctccatggaatttcccagtcaagtcagccttcaagtaggaaggaggggaaggctccaatggaaggagagactgagagctaagcgggactccctggagagtccactggacacagtcgagtccaagcacagttccgttatggcaggtggcaccatggccagcacctggcccatccctagggcaacacagccttgtctggtgtgagcttcctggtgggcaaaggcctccctggcactcaggcacccccttcctgtattcttacacctgtgaggagcaggaaaggagtgaacccgagacccaggccacagcaagccagacaactggaaaaggcgttcccgggagtgggctggtgtggattcgcagcctgtggagctgggcagaagagagtggaagccaccacttggcatgaggagacatgccaggccagaaagggctgcagtacctgctggtgtgggggcagctcagagccaacatccttccctttccatgttctcatggagcttcctatctagcagtacaggcagcaaacaagcccacaagtaggtgactgcataatgtcagataatgctaagggctgcaaggaaaacaaaataaggtgatgtgagagcctgatctgggggtaggaggagcagataattcagagtgggaggacgaggggacagaaagttccagacaagcacccaggccctgagggaggaatgagcctggcgcagaggaatataaagctctgttcagctggagctacctgcagccaggcagctcctgatgtccagatgccctgagcccagtgctgggtccccatatttttctgtctctagggtccccagccactctccacctaggggatctgccatttggatgctggggaaaccaccttatgctgcaggagtccagatccgtgttttggtctctgaagaagagacctccttccctctcatgtttttttcacctctgccacccaccaccactcatcaggggatgtctggaggaagacaaccccactcccagcacctgccggggccagccagccttgcactctccacacagaaaagcgcctaagagcttccttgctgtacctcagtgtcagcccctagaacaggtaggtgtccctgagttcccccggcagctgactcaccacctgtcctgtctgtttcccccagaggaaagaggactggctggtttttccttcagcctctctggtgtggagtcacttggggccccgtgactgtgcgtgagcctgaacctgaaagagcctccgtgcagagcaaacagcagggacctccttacatccgtctgtggtttccacaccccaggccccagcctcagactacagacctctcccaggggccccatgtactctcactcctctgggccttcgctggggtgtgctctctgcctctagtgccgtcctcttttcttcccctcttccacgtggaactgccccactcagtaagggcccactatgcttcatcttgtccatgaagcctccttcccttttccttccctgaggaagaaactcagctcagggctttctccatgaagctcttatctcacacactggcatgaagatgaattgtttatgcttctttccatagagcagtgggccctaaagtgtagtcagagtcctttgagcagctcatgaaagccgcgagccttccctccagaacaggggacacagcacacatctaggagattctgcatgcaatttcaagggggcctggcccaccaatggagtccagcctaagaaccccttcatcatttaaggtcttctgatcaaggcgtatgtcgtttatctttgggtcacctcctcactccagcagccaacacagtgctcagcacttagtaggacttcaagacccatcccattaatggaatgacatttctaactttcccagttttcagagaaaaaaaggcaaagtgcctgtaactttgtcactacatcaacagctgttgattgagtacctaccatgtgtcgggctggtactaagccacgtgtgaagattcaaaggcatgtgagttggagcctttaaggagctggtcatcttcttgggaagatggagctcacaggcagagtgagcacagcccttgcacatggtgggcaggaagagctgcttagtgggagtgaagatggaactgtccctgaagcacaggtacagtttgacaggtgcagtataggtgagcaaaggcccttgaagccaggaaaaaaacatggttggtaatgagggaaaggagagttaattggcagaggaggccagtgggcagaacagaggactggggtctgagcaagatgtgggaaaactagaaggtccagttgggtccagatttggtgggccctggaaggtaggccatggagtttgggttttatcctgttagcagtaggcagccgtggagagattttgagctgggatgggatgaaagtgaaattttaggaaattatgatgatggcatgtgcagagtggacagggcagggagggggatggcagggggagactaaagatgggaggcaggtgaagaagctgcagcaacagaccacgaataaggtgcaaggggctaggtgaggggtcagaaaggcagtagagtgatgcgtagcaacaaaggaaatacaggggcctggtgattaattggctgttggaaaaggatgggcacaaggtagaacctcagccagaaagccaggaggccgggtggggccggaccacagagggtgagtccccttccaaacctaaggggtttccaggtgggggaggtccgcacatatcagatggatggattcagagaactgaagctctgggaattactgactccaggataataacggctttctatttttatgtttcagagcctttattggaaaagggtgggcctaatttgtcctgttatttaaaaaatattccttaatgcttaaattatttaatcctaacagctacctgtgctgtgggtgctattgttgtcctcattttataggttaaaaaaaaatgaggcatggagaggctaagtgacttgcccagggtcatgcaatacaaattatatatgtatacagtgtagacatggaagcctaacaagactagaacctgtgtggcctgggtccagagcagagtcccatttagataggcacagtatgatgaggtaaaacaaatcattcaaagaatcccatccttcatcctaagtctctctaagaatatgaaaagggaccagagacagctccccctgctgttctcaaacatcctctcctgcctcccacatctgtcccaccccactcccttgagctgccttacccccctgggttctccatggaccctcttctccaccccagcgagcaaggctggtcctctctttcccactaaaggggttcctgctctgcctctccttcactcctccctttttcttcatctccctttcccctccccttctatctctccctttcccgccttccctttttcccttttcctctgtcctcctccctccttctcagtccccttttcctcctccccttccctctctccctcccttcctcctcactccagctcattattatgtaaattgtcttcaccttctgagccaagctctccccctcctccttcctctagccttagcccagggcctacatctgcatcacaaaagcagagggccttgttctggctgagctggcctaaactctgacactggaagaaagggttgaggagaaactgaacaattacaggattagaagattcactggaccagtgggggggatggggaaagctttgaacaagcctgtattaatatagttcatcatacacacacatgtgtctatataaacatatgtaaaatatacgtgtgtatgtatgtacatccttgcatatgtaaaatatattgtaaacaaatggactagtagcagtcatgcattgaacttgtatgaggctttattcagttgaaaatactccagttttcattttttcactatttgtgcctatgcctgtttctctcaactataaactccttaagggcagagtgtagatcctgttcctctagcacaatgcctaatacaggaagtattgaatactaagtttaaaccccaattctaccaccagctatatggccctgggtaaattatgtaacctctctaagcctcagcattttggactgtaaaatagtaatgatcctgatacctccctcattcatatctgccgtaagagtaaatgagataatgcctgtagcgtgcataggatagtgcctgtcacatagcaacttctcaacatgtgttggcaattattctcatttatttgtctaaaatcattatttttgataaagtgttgatgaattctactcacagcaatctagtgaggaatgggcaaggttttatctgcacttttcaggttagaaacagaagcacaaggttcttaactggccacccaaggtcatattaccaagcctgggtctgctgaacctgtgccataaagccaaacaccaacactgaagtttacaacaagacaaaagactgcgtttatctgcaggaggctgagcaaggagagtcaggcagctcatgcttaacatctcacttcctcaatggccctacaagcaagggcttttaaaggcaagggtacattttaggaaagcagaagctacaggcaaaaccgtaaacctatacatggaggttatacattggtttggcccaaaaaagcaggatatcttgtggggcaggctttgaggtcatacgtagatccagagattctgtgatatgcagttgattaaggagcaagcctttgtctaaaaccttggggacagccaaaatgaatgttaaggtctggcctgtaggtatgagtctctccaggcccctcaggaagaaattgagaagaaagaccggcgatcagtgttctgtccttagttaccactcttctgaggtctacttgactgcaatgggcattttccatctggtgggggtccaggtttctgaaaaacaactcagggacatatgttaagatgttatctttagtttccatagggaaccaaacatcttgtggctctgacttacttgtgtggctattattttaagctattacaacctccttgcttctcaagttgctcatttacttctcaaggctacctaggtgcctggaatttcccttgaagagactcaagatttttctgtttccatgctttttcagggtgtggggggcagcacgaccctaacagggggctccctgctctatctcagtcacctacctaagcaggaggaaagatgggtgccagctgggcttgccgcccatgctcttgttccaccaggggccttcactggagctgtatcccctagagataatggtagctctttgggaggcagaatcagatttcacatttagttttcagaatgtcattggatctcctctggtaaaagaaatcttgacatttaagtcacacaatggagctcaggacactatgttttttaataatcatggaaatattgtggtgccacctctacagtgcagtgcggttcaccttgtggtttgcatgaattctgaaacagataaaaacaaggatgctatctggcctgtgtctccctgagtcccctggggcttagagatactttagtggtagttgttagatctgacgagggctggaggatgtaatagatgaaggcttcatactcccatagcccaaacacgaggccaggaagaggatgtagatgtgtcccatgctgggtgctgaggctctccacctacaacagccccagagcctgccctgaccctttgccagccaggtgaatagagcttgaaactgctccattcaagcccatctcattctgctgctccattttgcagatggaacataggtttcatctggtccaaactggaaagagacttacccaggggaatatgtggcagatccaggactagagcattcagcttcctgcatcacagctcagtcctctttccatctcagcaggctgcttccagttacccagccaatttggggactcattttctttcattcagttggtcaatcaatcattccacaaatacttatcactcaattacttattacttacaaatgcttacttcctggggaagtgcacaagatggcagaggtgggtacaaagatgcaaagatcaagaggctcccggtcttgggcagagatgccagccccagaatgagaaggtaaacgccttggtttccagggcttctcccagctctgaaattctagctctccagggctcagtgcagcatcagcacagctccctgatccaaggctggatcgggccgcaagctcctggtttgagggaaggcatccaccatctaagccctgccacaaggagcctgagacccggctactggtactttggcccaggatggcagcatcagtggctttccttgaccatcatctaaaaggaagaaccaacccaaaggaactgcagttttcagtatgggaaagaaagaaggactaaagtgtcagatttttgaaatgtctcttagctgctcctcctcattagagtcttgggtttccttagctaaaagtggtgccctcccccaagcccctcccagctgccccccagcagcacactctacttcatggttgtcttacccttggggccagacagcaggtctggaagaacaggtcagtcttgttcatcatgcccagtgctagcaggggtcagtgaatcctgtgcctgagtgattccattcatccaatgggtgtgtgcttctgggtcaagtgctggcttggtactagggatatgcatggcctgaacagatgtgtccagggaagaaaggatgaaagatgcagaatatgcttctttccatgccttcctgatccctccacagcgtttgccatgcgtgcttccattcatgtgttcccacagcggtggctcagcctggagcaggcactcagcctccagggctccagcacattggcccctgcagaggccccagccagcacctagccttcatctggcctggcctgccttctcttccgtggcgtgcagagttgagtggatgctcaaggctgggctgccatcagtctctacatgttcattgcctgtagaaaagggcatggaattttaaaaaggaaatttaaatgaaagacttcaacaaacagtaaacgaaaactgcaagcggtgatgccttgcgcttgtgtgctctctttctgtctttcacactccaaccccgccccccaccgccaccataagccctaatgactctgctctgatggtgggaaaatgttataaccacgtaaataaatattcctcggcatcaggactgaagtggcccccaccaatcttggatgtccaagagccaccccattgcagcccctcttctacccccaccaaacccccacctggcagctacacagggggaactgaccgcctcccctctggagaggggccattgtgtgagcatcctttgggcttgtggtacctgtttcaaggtggcaaaccagctgccaagcagacttcagccttagaagccataggccacagcagagaggggcctgcctggccagtgccctgtattttgggactcctggaatattgaaaattgaagaattcccaaaacaaggtcacaaaatcgtgttgtattttaaatgcatctacttaacaaatcagtactttgggcctaccacaaatgcaatggaatataattgtgctccctaaaaagacaattataggatttacaaaaatattaattgacagtgcagtgctggccctgtggtcctgtagtgggacacaagtcagagccctgtgctgagcactgtagctttcactgtgagagatctctctcccgactatgtctgggacctcatttggtccaagccccagaattgagccctttgtggatgtataatccctttctggccaccagatataccgtggagtagcctaggaaaccaggaaggtagattttagtttgctgaaggaagaggcgccagggactgagaaagggttaggtttgaggcagcagcaccacgtggggaaggctgtgtggggtggggacagccaaggtggtatctgcccctgccctgctgggagtgtagtgggggtcacagtcccacacatgtgagatggagatggcttccctaggaaaaccagagccactttccatcctcccgctacacacatctgcacacacgctcatcagcttctgctttactcagctccgttccctcttctttctttgccgggcaaccaacagtggtcttatgtcactgctgaagcccccactctgagtaagttaggacatgttggttgcaagtgatggaagatacaaccacactggcaaactggcttattcaaacaaaataaaacacaaaacagccacaggcccagagagtcagaaattcagacacacatgtggggagtgggggcttgatcagcagctcaggggacgtccctggcttcccccatctctccactctgccgcactgtgtggttttcaccctcgactccacagcatcactcctgcaccaaggaggaaaatggctccagcagctaagtcatcacttgtaaccttgtgtgcatcctaggacatcaccaagcacaaggtgcatctgagcaaccaccaagtcctgcaagtctctctctctctctcagtctctttctgtctctgtcgcctctgtgtgtgtgtgtgtgtgtgtgtgtgtgtgtgtgtgtatgtgtgtatctgtctgtctgtctgtctctctctctcattgcccctccttgacccaatcaccatgaccaagggggctgaggggttcctgggataagagtgaatcccccagaggaaaaccagaagctcctgaaaaaggaaatagaataggaggaaatgggtgctggggaggccaccagccgcccacagatctctccttgccattggggctaccagctgtgctgccccgtgcaggagatgactcatgtcgtagggtggagggccggccaggctgagtccactgcagcaggaccatgagatggctgagctcggcagcaagccagcactgctgctcccatggcagcctctcccctgaggtcccaggtggcaggacacatgggtgcacagcccccagcccaccactgaccaatggtctcgcctttccactgtggccgcagcagggggccagggaagagtgggaggtgaagaggggagataggctggtaacagaagaggcctccactagaagtcaggtcccttggagcctgccccagccagcaacagccttagagctagtcaacacctcgcttcaaagctggggaggcactgccccagagggcgggcagcaggagtcagagatgtgactttgaatcctggccctgccctctgccaggcagtggacttagcactagtcacctgactgactgaccctcaggttcctcatctgaaaactggagatcataataatacctactcacagggttgttgtggctaaaagaaatgatgcatgttaacagctaagcaaggtgcctggcaccaagtaagtgctcaggaaacagctactgccatctccctcctcttgcccatacctcactgcctgttagtgaagggccaggacaggagcctgggtgtgacaattgtttcagaaccagagcaaagggttggtgtcaaggcctcttagctattacaggtcaaagaggtggtgtcatcccctcccagaatcagctgtcccttctgatttcaggctggaagacagtatgcctcagcacctgccctcttgctggctttgcaggagtggagctgaggagagctgcttctgactcagggcccagcatggcctgagagagaaacccaaagagatagagacaaggagagagcaggagagatcacagagagggaggagagtggcagacactgtgtgactgagaaacactgagatggcgcgctgcatagaccgtgcaccagtgtccagtgtcgatggtgcactcagcatagcatctgcgcagagtaaatgctgctgaaatggctactgctccattccttttcattagggccgcctatgactctgtgaatgtcattccacagcccctccagccagacgtgtcttctttctccccctggatgccctcagcacctggctgtctcattcactcactggtttatttacttgagaaatatggacgtggccttctctgtgccagcagcatgctgagtgctttgtgcaccatggtgaactaatgcaagcaggtgtactgctgctcagagctcagctggcgagcaggtggacagcctcagtgattccagagagcagagtgtcctgacagtcggcctgtcctagcctgtgctgaggacggggtatctgacaaagagctgaagggattggcaccggtggggtctcaccagccaccaggataggagggtaaaaagactgctcccaagtgtccccatatggggcacgccaggaagtaagaccagagcacatacttgggctcctggctgtagaagttcccaagctatataaggagaggagaatcaggcctggcctctaaaaggaggctgcttcctcttggggaaaagtcagggaggtgggaaaatgcagccttcacagccctgtgtcttaagtcactcagctctgatagcaagagtggccagcgtgggggccggtcttccctttgcgttactttctggcctctggagagtcaggagctcaggtagcctggagtcccctggaactcagcagcaggggtggaggcgggtagggtctttgtcatgaaccggaagcataccaggccttcacttagaacactgacccctcacagaaagaccagcccctaggccctgcctcggctggcagggtgacctcaggcccatcccttaccctacagggtctccattttttcatccattagatctgaggaacgacaccgaagatcgcccctcccccaccctacctcctttttagttctataaattcccctggcagaacttaattgctaagtttaggtgattgccaagcacaaggttcttcctttgtatccaaaaaagggggggggagcggaaaaaagagaaaaaaacacagtttcaaagttagggcacctgtgttcaattgaagactgactttctcttaaggagggagttgatgttcccacagccgctgggctgttagcagcaaaagcagcctagcaggaggggcagccttggtgagcccccagtgcaggccacttgggccacttgccccacagtatccagcgcactggggggcagatcagcctgtcactgagaatgacacactcaagtttggagccgggacctcttttttgccatccatcaatgagagtggttcagggttgtcagtctaagacgggagtatagcccagggctggggactgtagaaatgggcatggtccccacccggtggggatggggacaccggtgtggactggcacacatgggccacggagccatcggggtgaagacactaaatcaggcagaaaaacactgtcaagtgttaacactgcagcatctgtgtcaagggtaaccatgtctcagggacgcaggagatgagcggccccatgcaaagctgtcagttttagtctgatcagtccaaaaggctcccggtgtggggagaggaaggatggatttcagtagcagcttgctagatgaggatgagatggcagagcatacggcgcaggcttgaggagggggtacggaggccagggaggcctttgggcagctggctgacagcactgttacaaacattttgcacacattttattgattggcccactcctcaaacccagagcacataaacaagtgtcccatggtaccattggggtacctggaacccagagcagtggggaatgtccctgccccagtcccccaaacaattgcaccagcctctccagcttcccactgcctctcttgcctcccaccccgtaatctgtgctccacacaacagccaaagtgagcttttaaaaatgcatatctaatcccctgcttaaaagcgctcagtggcatctttgctctcaggataaagccagccttatctcctgtagctcctgccacaggctctgctgctgactctttaaatgccacgacctcctggcctcagggctttttagtgagttatctcctccataggggacttctccaccactgcttccctcccccaggcctgggttccaccatcacttcccctcccttggaagcctttcctgactctccgaataggctgggcctcttgtcctgactctcagacccctggtatgtgtgctcacctgagtatttgatcaatgtttgtgccccctgacccaacaaggctgtaagggacagggacagggcctatatgacttcagttggagtcagtctccagcacccagcacagtgcctggcccagaattggtgggtgctctattgaagtctgcagctagtccgtggtagagctgttcttgatcccagatgtttgaacacctggcccattgctttctgtatggccccttgtaaaatcagagcaggtagttaaaatcagatcctggagacccagaatgagtttggaacctgagttctagaacccacttgttcataggccctcttgcaggcctcaattttttcacctgctgaattgaaaccacacctgcccacgcactgtgcaggaagcaaggagtaggggtcacacacgtgaggcatgtgagagggggtgcctcctgaaagctggctctgtgcatccactcctggaacccggcccctctccaggcaaggcacagaggcaagcacctccaaaagaaaccctatacccgttagcattccctccctacccctctgcctgcagcccctggcaaccactaatctgctctctgtctctatggatttgtctattctggacattttatataaatggaatcatacactatgtactcttttgcatcttgcttctttcacttggcataatgttttcaaggtttttccgtgttgtagctgaatcacatttcattgtatggatataccaaatttcattcatctattcatcatttgatggacattgaggttgtttccaccttttggctactatgaataatgctgctgtgaacattcatgtacaagttttgtacagactcatgttttcatttctcttgggtacataactaggggcaaaactgatggttcataaggtagttccatgtttgactttctgaggaaccatcaaactgttttccaaagtggctacaccgtcttacattcccattttccgcatatggaggttccagtgtctccccgttctcactaatacatgttattgttcatcgtttttattatagccatcctcgtggctataactcattgtggttttcatttgcatttccccagtgattaatgatattgagcatcttttcatgtgcttttggccattggtgtattttcttcagagaaatgtctattcagaattagcccatctctaaatggggttatttgtcttacggttaagttgtaagagtcctttattctggatacgagtcctttattagatatgcgatttgcaaatattttctccccttctgtgcattatctttcgaattttgtgatggtgccctttgaagtctcacctcattctgcccttgcctctgcccccttgccagagttcctcactcccccagacctactcatctgtctctgttcctttatgctgctgcaacaaaataccttagaatgggtaatttagaaacaacagaaatgaattgcccacatttctggaggatgagaagtccaacatcaagataccagcagatttgctgtctggtaagggtttcttctctgctccatagatggtgccctatcactgcatcctcaggtggcagaagggacaaaaggctccctcaagcctgtttataagggcactgatctcattcgagatggcaacactcttatgatctaattgcttcccaaaggccccacctcttaatatcattgccttggggattaggttttgagcacgcgaattgtggacggacacagatattctgaccatagcaccattgcctgccctgccttcgggacttacactcttttggagctgaaggaactggctctttcttgctccacattgctccacattccccatcagcgttccccagcaggctctttcctagcagacaatctgaactgcacccaggctgcagtcatccctgagtttgggggcttctaaggctgtgtgctgagttgtgcctgaagcaggaggagcctacaattcactgagcatctccctgtgcccacgtgctggatgcctcgcaggcatggatatatcccactgcatccccagaacaatctcaaaagatactggtatttttctaccctgtggataaaatggagtcagaatttaaatttggatttttttttaagacaaggtctagctttatcacccaggttggagtataatggcatgatcttggctcactgcaacctctgcctcccaggctcaaaccatcctcccacctcagtctcctaagtagctgggactacaggcacatatcaccatacccagctaatttttgtattttttgtagagatagggttacattatgttgcccaggctggtctcaaactcgtgagctcaagtgatccacccacctcagcctcccaaagtgctgggattacaagcatgagccactatgcctggccaaatttagaatttaaaatggagctgttcgctgtcttcctacacagcatgttcatggcttatgagctgcacgttcagctctgctgtcctgtttgataattgcctactctgaaaagtatttaaaaatactggagaaagtattaatacctccctaggtataagccctagtatggtagcaacagaagtttcttgacactctggaaaatgcccaactccacctgctgtaaccagcagccccgaaatctcagggcctcaacatagtgaacgttagttccttgctcccaccacagtctaatgtggaagtgctgggggttgccctgtcccacgtaggcccgagccaactcccctgtggtcagtggttcagcctcagctgagggtcttctgctggactcctggtatcaggccagtggactggggaaggtcacaaggggagtttttggggccgggccagaacttggtccctggtcacacctaactgcagggaagtctatgaaatgcctagctgtgaccttggaagaagagatgaaatacttttgtcaatagggagccagtctctggcatagtgctcaggtgtgaattttagccaaactgctgccaactggaagcagcacctctgctggggtgacaggtccattttcttggctctgttggctgttttctgctcctcacttgggcccagctgagcagttcaacagctttgcttctctgtgacatgacagagcccacctgaaaattcatttcttggtggctatggtggtggcttctcaccctgtctcctgtcccagctctaaaaatggattgcccttctgatatgaacatgcatgacatctctggaacatgagtcccatgttctgtgtgcagacagtgtgccagcagcttctcctgtgtgatgtcagtgtttccctggcatggcacacatactttggtggaatatgagattaaatggtacgtggataaaccttttattcctacttttgtagttgcatatcggttttaatatgtacttgaaaaaagatcacataacatatcaaacccataatttcatatctatgactgaagatgaggctaatttcagagctgtcctgatatcaggttggggaaagcgatgaatgaatgactgggtttgggaacgttgcctggggtgaaaaggctcagatgcccagccgcctcaccggacttgctagtgtgtgacctctctgcacctttcctcctctgtagcatgttcccacatgaacatagggtataggaaggttggtgtgtcaagtgattaacagcagtacctggcacatatttcatgcttagtaggtgatagctcctaatgttcttaggaaacaccaagtcatatcacttaactgtgccaacagtgttgagacagggttattactatactttatagatgagctgagaaaggttaagtcgcttgcccaactggcagcagagccatgtgctgacccccagtgtgcctgactcctacctaggccaggctctgcgaggggagtttacttgcaatcctggctctggcactaacttagcaggacactgcaggcaggccccgtcgctctctgggcttcaagcttcccataggcgggatgggggaccagcataactctttgtgcaggataagtctcacagaatgtgggggctgctctctttgctccaaccacagcagaaggctttgctttaaaaaaaaaaaaaaaaaaaagtggactgggtgtgagctaggtgtctgcatgcaatgcccctcccagatcctctgcttgtctctggattctttctgctgcctctcttgtcacacttctttatgaccaagcttccaacctaccccaagtgtaaacatcatttgtttgtccgtcatctggtgatggacatttcacttgtttccattctgggactcttatgaataatgctgccagaacattgatgtacaagtttttgtggggacatatgttttcatttcttgtggtaactacccaggaatagaattgctgggtcacgttgggagggtatgttaactgcataagaaacttccaaactacttccccaagtggtagtactgttgaaaattccaccagcaacatataaggattcctgttgtcctgcacactcactgacatttggattgccagcccttttcattagctgctcaagtttgtgcacagtggtatttcactgtggttttaatctgcctttccatggtgactaataatatttggcaccttttaacatacttttgggccatgcgtatatcttctcttgtaaagtaactgttcaggtcttttattcttcccttttattgggttgtttgtcttcttattaatgagttttaagatttttttaatatccctgatacaagttccttgtcagttatatgtactatttcatattttctcccagtctttggcttgcctttacaattagcatttttaaatggtaaatggtttgtttaatgaatgttgatttgtccaccagcttccacgtctagtccatacctccctttccagcattgggagccctttgctagttatttctatttggctgtgagaggttttcgtctgcagataaagaagtgatcatggtatcagaggttgaacttgtggactctggggtcagacagtcctgggtccaagtcccagctccgtggctcgcagatgggcaggtccttctcgtctgttctctgagccttgcttttctggtgtgtaatatgaggataataagtcacctacctccttgtgctgctgggaagattaaatgagatgatgatctcaggggcctagcacctatcaagggcacacaaaggctgggctgtacctgttaccactcctgttgctaaggcacgctagcaccccagggccagcccatgtgaaaccactctgcacaaagcaggcttcttctcccttccacctttaaatcgaaagcaccacctttctcccagttatccaagcagagaccctggactcctccttcccctccatgtctcgcttcctgttccagaatggctcttgaatcagcccttcctctcgctgcccaggccactgccccagtgaggcagccttccctcttcccagtgttcgtacggtgctcctcaccaaggtggtctccctgcctcttcctcccaatattccaccctgtttgccgctgacactgttgtcaaaggcttcctttctgaatcagaaacctggggctcctgggtagttgtttgggggagaccaccttgcacaggcaaggctcggctgtcactggcgtcttccttggttataaataacaggctctattcttagccaaacagcagttaattctcttcccgtaccttccagagcctctattagggaccttggccgtccttactggagacaggccattccttggcctttggcaggacccattcctttgatacgtgatcagaaaattcaattataaagccaattactgatttcctgagctttacaagggagactggaaagtttgattaagtttgaatttgtgtttggctgattgccagccaaaaccgaatgggcttgtgggagagttctgttgttgctgattctgttcctgttttgtggcagctctcttggggtgggggcaggcacactggtgttgtgttgtgggttttttttagacccccttacttgctgaatggctattcctctgttgtgatgcatgagatgtaaatcccccaaagactggttgccagagcgacgggctggaattgagctcagctaaacaaagtccttcagctttgaagggagaagcgcttgtttcccatgtggagttgagttatagtggccctcaacaaggctgcattcaaggatgcctgcatgaacaggcatgcagagggggtcgctgagcctgctggaggatcttaagcggcgtgtctgggctctaactgcctctaggacctacccagggggacacacagatgctgagcctgaggatcaaggctattcagggtgcctctgcccagctggtcaccctcaccctagaacctgcaggactggccttcaaacagtgacagcctgctgggctccagctagagcccagcacaggtggggattgaaaagcaaccctttgtctctagccaaagtacttgcttttttagatacttctgggaaaccaaacagagcccgtgatgggaccaggttggagttccaggtcagaatctgagttgtttctggagacccaagttccttccctagcaataaaatgagggaatcccagttctctggaagctgtagccatcccacaactcttcctacaaggtatacattattcaggagagatggtggggccccacttcaaagcgtctccctcatgcctaaaatctcccagttagagccctttgggtgttaaaggtttttaggtctctaagaatcctggttaaagtactaatactcctggaaggagaagcgtctaccagtagggattagccatcagctaactgagaaaaccgccctttgggagtaggacacgggattccctgtacccagggtggggtcagataaactccacctgcctcccagcttgcttgaggcaagatccaaatgtgacctcttgcaccagaaacattaatatctctaacattcgtatctggtgtgatgtaccagagctcacagaacactcacgccctgccctgtaccctcatccatacagcaagctcatgagccggcaccaccttgacccccggttgcagacaaggaagccaaggctcagggaggccaaccaccttgcccagcatcacacagctgggagtacagattttggactcagacctgggatttctaaatccaaacccaaacctgttttctgtgcgcacagccacccacccggtggatgacatggacactgcgcacctgttttgtctaactggtgtgtgtgtgtgtgtgtgtgtgtgtgtgtgtgtgtgtgtgtgtgtgtgtatgcatgtgtttaaaaggtgggaattttttgttaagtttgaatttcagttcttttcttttcttttttaaatgaaagtgttatagcatcctggtggagttgtaattaggaaattctgggttagtcagctaggcagaattgaaaaataacccggcagtgctggttggagtactttttcccctccttagaaattcaggttttgtcaaactagggaggagggagttgtgaagatggaaaaatgtgtgcagctgggctgggtcagggagtgtgtattctcttctttatgtagaactagacgattaaaaaaatagttatcgagtgggagtgctggctcacgcccataatcccagcactctgggaggcaaaggtgggcggatcacttgagcccaggagtttgagaccagcctgggaaacacagcaagaccctgtctctacaaaataaaaataaaaaattagccagccatggtggtgcgtgcctgtggtcccagctactggggaggccgaggtgggaggatcacttgagcccaggaggtcgaggctacggtaagccatgttcacgccactgcactccagcctgggcaacagggcgagaccctgtctcaaaaaataaaataaaatagttatctttgtgtaggatgatcttccgtatgtgcagacatgaggcagcctgtgaaagatggtaaggaaacaggtgaagaggaaccctggctgggtcccaggctttggcaggaagaggatgcgagccccagatgtgggttaagggctctcaaaccaggcgcatgcagagagactccattgtcacctcccttccagcttgcccttattgatcagcgacagtgatgatgacaagggcagtaacaacttcccccacacgtggggcatatatgccaggctctgagacactccgtcatttctgtgttaccctgacagtcttcattttaatagtgatatgcttattttaataagaatccaaaacatagcccatctagctcatgactgcccagatattagaatggggccaaagtatgggtttaactttttttaaaaaatgagttaattaggctgggcacgatggctcacacctgtaatcccagcactttaggaggccgaagcgggcagatcacgagatcaggagatcaagaccatcctggctaacacggtgaaaccccatgtctactaaaaaatacaaaaaaaattaactgggcatggtggcgggcacctgtagtcccagctacttaggaggctgaggcaggagaatggtgtgaacccggtaggcggagcttgcagtgagctgagatcatgccactgcactccagcctgggcgagagagtgagactctgtctcaaaaaaaaaaaaaaaagggttaattaaataaaacatatgaatataaggacggggtgtcatgtggattgggcagaaattgtgaaaacaagacagaaagatctggagtttgggaaggcttgcctcatccatatgagcaggtaaaatgattaacctcattttacagatcaggaaaccgaggctcagaaaggttgagtaacttgcctacagtcacacagctgacagatggcagagccagcaacaagacccaggcttgcctaactccaaaggcaaggcttggggctgccatccaggtgaacattcctaccttcactctccagatgaagccctcagcgctgggttagctagccttcctggggctgtccaaccctggagagagaaggcctttctcactgctttctgaagcatgaacagaggcggatcccactctagggaggtagggccctggggcctgcttcctccgatctgctgcgtctaactctctcaaataaaagccttttcagaaagggcctggcatgaggctgcatgtgactggcagggctgtgactgccaaggcttcactgtgcttcctcacccttgccccagccccacccagcccgaggcagcccccaccttcctttcttccctgatctctcttagctcttcctttctttcttttttgtctctgaatcattttttccaataagctgttgattgtctgttgaataattctctgaatgatttctaaaagcctcctgatcactgaaacctcagagttggaaacacatttatatttatgtggaactgagcttttagaacattattaaatttgcatggggaactagcagagtagccacttccacacaatccagatgatgaggaagcatcatcttcaggaggatggaaatagttccacaagccactctgcctggcttattactctgctgggagaaatcagcacagtctacctgggggtccagaggcagcattgacccagacaatctgagcaaatgctgtggcttagaaaccactcagatgcctgtgttttataattggccagcttcctaacctgggattctggagctgccacctcagaaatggaaggcagattggggttcgtgtgtgtgtgtgtgtgtgtgtgtgtgtgcgcgcgcgcgcgcgcacgcacatgtgcttgtgagtgtgtctgtgtccacgtgtagctggatgtgtagttcctgtgggtggtttagtgtgtgcatgactacatgccttctctctctaaggagagaggctgtagcttttgtcccatgtcaaaagggccacttgcactaatgacctactatgtaccagctgtgtaagctgctagctgaggcctctgagcaggataattctcatagaatttagagttgagaaaagagaaacaaacaggaaaggctgtagatagtggtcaggcggtacagagaatttaaataaatgagtggcttctctcagtcaaagtggtaccagctggcccctggctgcagctcaccacggccaactgtgtgacatagtaacagttaacctccactgactggtcaccgtgctccaggcactgtcttaagtggcttgtattcattcctttaatcctcataacaccctgagaagttgggactatttaaacagattagaatgctaaggttttgtgaggtcacacagagagcgagtgacagagtccagactgaatctggggttactcacctccaaatgcttccctgggtaaaatactggcctctccagactttatttttctcatctttaaaatgggttgattcttatttggcctatccctgaccaaaaaaaataatattttttaaaatataaacttttacacaaatcgatctgaaaatcagcatcctgctcccacttggctctggtgcccttgatggagctgaagtctgtctgggtggttcctgagttttctcagattccttcagggctgccagttgaaccaccaatgtgtggagttttacttaagcctcattttataaatcagaccatttgacttgtctcccactaacttgtcaaagttccagcgagcaagttttagttccagaagccagatgcttgccactgccagctccctgaggtgggcgttctcaccagccccattccctgctgagcagccacgggcccatctcccagcccagggcaaggccacatttcctcagacctctgagagctctgaagtcagcctgtgtggctggggtggatacaggccagctgaagtggacagaggataccggtgaacaataaaaataacagatagctatggcagtcaggtaaacagagtttgggcttacgctaacaatacgattgatggggtgggtttgacctttttttgtttcaagccataccaagaataccagtggaccgtgtcacatacctcagtcaaaacaaaagtgacttggatttgcttttgagggtcaaagaaaggccttacagaagggatgtgggggagccggaagcacagacttcgggggtcagaaagatctagactcaaaccccagctcttgcttccagctctgagccctgggccccctttttcctctgacttgctgtcagtgatttcttcagggcatgaagaggctgcaagaagggctttctctgtttgccctctaagcgcttaccacagaagcttggcatttttccattatttttatgtatgtgcatgtgtgtggagggagattgggtttttttaatttttcagttgcattttttttgttttgttttggtgagttcttctttaccaaaaccctgacgtgtgcttgttttattgtgcttctcttcccagtggaacacagctaaaccattctgcccggcggagtggctcagtcagagtgccagatgtgggtgattcataagcgtagtggccatcatgttgaattgttactattgtcactgagtgtgctgagcacctgactgcactaacttgtttagaactcagccgtctgtgaggtgcacactgtcaccacccccaatttacagacgaagatactgagaccctaataggcctgctcccaaatgactgctcacagcgttactcccttgatgtggaggtgtgggcagaaagtcctggggctctgaacgcccccgcccaggggtcctgcctgtgggtcatccagcagcagcacctctgtccagtcccacactgatgtgaacagtcttctctgatctacagctcacaatctacttcagccccactgtcaccctctccccacttgtgtgccgtgttcagtcctcagggaccccagaaccagcccaagcagactaaggttccctgggttctagaatcttgatagctcaaaccactggcctctccctgaagggtttcgacacacccccccaccacccacctcctctctagcctctgcttcccagccagccctacctccttcccaggatccaccagctaagccaccagtgaccctggaacagtgaactagccccgcctctctgtgcctcagtttcccaacttgtatgatgagggagcatagacagaagcagttctatgggcccctccagctcagacattctccaaacccccatcatctctcatttgacaactgcagtggcctccttggagtgctccctggagccactcttccaggcctcccagccccatctggctatacacagcagccagcatgagcttttgaaacaatattatttcattcccacctttaaaaccctccgtgacttcctaccacacatagaataaaagccaaactccttcccatggccaacagtaccctacatgactgggggtcacgcccgggctccctcttctcagaaggtgctttgaacacagccagcccgccagcccctggctgctaggagctgctgccgtgttgccaataccatcactgtgtgtattgatttctcacccaactggtgtccttaacttcatatttatggcttgccctgacatttcccttctcttacatgttccaaattattaaaaacagctgctttataattaattgagcaaatcacagaaaaacactttttttctgtctataaataattccaccttaacttttctgggaggataaaatgctgtgacaaggaaccagcacacacctggtatctactatctcctccccagcctggacttgaattcatctgaaccatctctggttctctccccggcctgaaacgggacctccacgcgcagccgaagtggggtcggtggagaagggtcgcaggattcctgagcagcttttgactgctcgttctgcctgcctgtggactgcttcccatgatttcaccactgccttttgtatgctgagctctgtgccctgtcccatgctggggtggggtgtgccaggggaagacatcactcctgccccagaggaatcacagtcttgttttccagatggacacttggagacccaagcaaccaagtggtgtgatgctgagctcagggtggggtcagaggagagccccatgtggaggctggcgggcagccttcccatagcaagacccccaccagcgaggcttgccacacaaaacgggtgaccagctgccccaagagtcagctctctgtgttccctgcaaggggctctgctgaggccagcattttctgtgtggacagaccctgacatgggagaggctgggaagcaccagagcatgagctggcatcttgggtgggcagtgacttcaccctctggagcagtagagcccctcgtgactgtcagacagtttatggacttacacccttgacaaagcatcacaaagcatgatggctgacagcgacctcagagatgatcacatctaaagggtgacacggatttgtcttgtgtgcttgctatcattgacccccagctcttgtccccggcagtcactgtatttcattcatggcactgaatctgccctcagagttctctcaggatagccattgccccaggcagccactaccggttggttgcagtcagccctcaagttgaagccagtttcccacctctgatctacccaatgcgacaccctcattttatagacgctggcaagggaaagggcactgaagagccacagcagaacacctatcttgcaccccgagctttctaaccccctacttcattgctttttagatctttccctaccaagccctaccaagttcattcacttggcaaatgtttactgagcacctactgtttgcccagtttgttggtacatcctggatacaagagggcgcctggtataggagcccagcatccagtggagagacttgtaaacacagaacacagaggctggtgggagccacactcactgccaccctcaccggggagagcagagaccctgctgccccagacttcagggagccccctgcgtctgcttttcttgatcctcagggctttgcccatggtactgagggcctgtgttctctttaatccttcctgccatcccaggcaggcagattgcaggtccctcttcaagctggtgctcttgaaatattgttcatcatttattcagcaggtccaggaagatgccattaatgaaacttgtttctttattgttcaaaatacgggatatattagatgtgctggacttaacataacactttaacattgttgggagctggctttcatgtccattgttcctaacaagagaagactggtgcctcacagcccctgaaaggacaagagcccataattacacaattaggctcaaacatcagtttacaactttttttttaatgtgggcaaacttcacttttctgtctagttcatgttttttcttgttttcattcacaacattccaaaccaggtaacttcttaggaggaatattagtgggtttgaaatttacataataaacaaatgcctccaccccagaagacagccctgtatcatccatgactcagtttcagagtttcaccgaccaaccacttcggctggctgagagctggtggcctggcccatgcctacacgtgcagtctgcacaggtggggttgtgttgatactcagctgaataggtgggtgacaaggaaggacactgtccacctccactggagtgcatcagcactcgtttctccagttgctctggaagcatccaggacaggtagggttagccggccccttattctgctccccctgtgacattgcagctaccctcatggctggtatgccccacagcctggctctcttggatctcctgttgaggtaagcagagaccttgagaacaggctctgggccatttctcctctgcttcctgaccccactttcagctcaccccgccagaccttgcaaggatgaggagatggtacctagtgcccatctcaacgtatagcctggagtccatttattccatgagcagcatcttgtaactgaacacaatagttaatgaagcagatgtaggccctgccctcacagagcttacaattcccctaggaagagaaacagtcatcaaggaaacaaacctgtctaattacaccttgcaataagtgctgttaaagaaaagaaaatcatgttaggatgagaaaaacttttgctttagattgggagatgggggtgatcagggaaagccttatcttgggggttaaagtgagactggaaaaataagaaggagacaatctggcaaagactcgagtccaggaggagccagtgcagaggcccctagtggaaatgaggctggtgtgtgtgcaaagcctagaaagggatgggcggagggcagtgggtgaggctcaggggaggaacgaccttgaccccacatggccttgtagatagagtttggaatgatggagagagaaccccaactcccagccccagggagagctccacctcaggggctgtatttgtttcccagggccgtcataacaaagcataatcacagttctgaaggctgggagtctgagatcagggtgctggcagggttggtttcttctgaggcctctgctccttggcttgtagatggctgttttctccccatcttcacatggccttccctccgtgtgagtctgtgtcttaatctctataaggacgccagtcctattggattagaacccatctaatcattttaacagaattgcctttttaaagaccctgtctctaaatacagtcacattctgaggtcctgggggttagaacttcaacctgtgagttttgggggaacacagttcagctcctaacagggagcttccctgccgtcctctgagatgaagctcgtggatcagcatattttgaatgctgcagcaggctgaggagcccagttccactgcttgctccctgctccctctttgttgaaaggaatgattcacaggtgttgatgggtgtcaaagataaaagggcaccaagcagcctttcttaccgaaggtcagtcagaagccttcctagcgtgagttagtggtgttaatgcagggtcccagaacaacctggaatcttcagcggcccacactctgggaaatccccttcatcgttgtggcggaatctgcagagtttaggcagggaagtgagttgactggccagggcgcaggagagctggccaagctgcccccgctccttcagggtttcctcccaacccctagcagaaccctttgctggagagaggcccagaaagggtagtgctgaattcagtgaggtggacttatgaccagctgtccccaagacccctgagatcagtgtttcttcagcctccagggctaacctgctgagggctgaggtgcctgcagacacacagaccagcctccagtcactgcctccaccttatgttaaagataaaaataactacaaggcgggaaatgtcctagagaaactaccttgaaattcagaaaacatgaagccaggcttcatctaattaagatgacattttaaaaggggggacggggggaggcttgggtggcattttaaattgcaagctgattgtgcagcctaattttggttctgagcaaagattccagttggaccagaaaacaggacttcaaaggcactgcctactgctggccaggcaaagggagtgaaaagggcagcgtggggcctcgggcacaatgtggccgggaactctgggcaaaggctgggggccgcggggggctgcagcccttgggagcctgctgtgcctctgaggagatcagtggagccgctcctgggaggagagctaattgaggtagcgacttctccttggagagtgagctttggtccaccccagcccatcttgggggcagtcactggacagaactctggcctggtggtcccaggcatgcccccacccaagtctcccccaggagctacagaaacaggcctggttcttatgcagagcgcccagtgccctccccaggagggggctgctcccttccggggacttctcctgccagcctctaagattcaccaggcgaagaaggccagctccctccttcccagaatcccgggaggggcagccccagtccctttcagattggagggcagcggctgggcctccgcgttggtagggagatatggcagccagctagcctgggaggtggagcatctgcccccagaggctcctgcatgtctctcctttttgtgcaccatagcttatctcacaaagccagcttcactcagcagattttgtagttattgttattattactcattctactgacatagatctgggcacatgcacacaccccacgatttaagtgctccacagtcagaaagcccattccccagactctgggttctctcacaggagccctgggaggagagcatggcatgaagaacaccatttacggttgaggaaactgagtcacaaggtgtcacatgactaacccagatcctctgaggccacaccctgacacttcccacaagtgttgtgaccttggtggagtcactgcttcccacttgacatttcctggtggagacaccatggtgtctgtcttccattccctctggccactgtctcactctctctcagcagaggtctttccccagctcctccataggaaggatggtgagatgagcatgagctaacagatgggaagagtcgaaggagctggtgggcaagggaccttggttcttccatggctgccagtggggagcacggagggttccactgtggcgccattgaaagactcagcggtggatgagagggagattaggaggccagtctggagtcgctgccctcatccatgcagggaggcaggggtgtccttggaaggtaagaagaagggacagattcacaccttcctgagggtaaatgaccttgggaatcagccagctgcaggaaaggaggaagagtggagccaactttggggtccccagcctgtgtcatgggaagcacagaaatgccattggaaagaggctgtgtgtccccaaagagtggtgtgcgctttcctggggcacacaaatgacctggcagtttttacagaccaacagctttggttttagtagttttattattttagtgtatattagaaaaattagcacacaaacctctggttctgtggatattgtggcctagggtaagctggcttttttaaatgagtccaatttaataacattttcaaaaatattgagtcagcagtgacggtgacttgctgatagggcagaaagctggagaatgaggcaggaaggaatgcgatgctggagccttggatgggaaaccaggaggggagtctaactggggacacattgagttgagtctgaaaggccagtgacccagaggttaggtaggggtaatccagttgttccctgcacagaggaaaatcaggcaggatctggctcagggagaaggtggctcgggaaagcaagaaggggtttgaggactgagtccttgggaacattggcacctaaatgttgggtggaggaacaggaccacagttggagacagaggagggatcacagtggactgaggtgaaccggcacccacggggctgggcgcccagagaagaggagaagtgggcgtgatggagagggcactgcgagccctcatggagtggagagggaggcagcaagacagaaggaggaggaaggggaggacagtggcttcacggggaggccagctcagaggacgggttaggatggaggggccagagacccccacccccaccttttcatcaggtcaagtctaacttggggtgaagggtacagactttccttttggggtttccctgaagttcatgtagctggatggggctttagaggcttgggaggaagcagccctggacttggtttctatggctccccgcaggccctctcccagtcacaggagacagcccccttcccacctgcttcactcaagctcaagtgctctcctagctgctgtggggacagacaggcagggtgggctccctcttgctccttcccagctcccttctacgaggacagtggccactaggagaccagaagttaccatgacaacaaagctccttcacagaacagagcccctgggctccctgcaactgtgtccgggatatttgaggtgatcttctctcaaaaaggatgaggccccaagttggcttttagagatggggagagatgataggaggaggtagggacagattcatgttgccagctctcccacccagccaaggaacgtgtgggtgccccttcccttcccataggatgccacacactccttggggagcccaccagtgggctcattccaccttgaaaccaagaccaaggaaccaagggtggggacaaggacagagaagggagcaggaggtctgcgggcttggaagcctggactcagtggcatgaccagatcactgccgcctgcctgcaagcactgtacattcccagccaatcagggttgttctcaggcctcacaggaccagaagccaaggcccttctgctaggagaagagggaggtgaagtgacctgtttccagtcccaccacccaggggccagacccggacccactgctcctgtgcgtgccgctctgctccctcatagctgaggaatgtgcagcagtgcctgctgtgctgggtgctggggcagtcctccccagagtggagaaaggacatcagttttagctggcatgatggattaacatgttgatttttatctcaatatttatgaattcattttcatggatattagaaaaagataaaagctagcatattaaatacatcctttcccagacattgttggtactaaatttccttttgcttgaaataaatttaagtagaaaaagtctgaaggaaaatattaggtcagatgcagtggcttatacctataatccaagtgctttgggaggccaaggcaggaggatcacttgaggccaagaagaccagcgtgggcaacatagtgagaccccatttctaaaaaacaaaaaaaagaaagaaaaaaaaaagaaaaaatcagcaggacattgtggtgtgctcccgtagtcctaggtactcgcaggaggctgaggcaggaggattgcttgagcctggggggttcgaggttgcagtgagctatgattttgccactgcactgcagcttgagtaacagagcaagaccccatctaagaaaaatattaagtaaattaaagtacaagttttatacaaacagcagaaatttaatgatcatttattgagcacctattatgtgctatagtgttctgtggatacagtggtgaacaaaaattatgcgagtaactgaggcttgggagatgctgctgtggagcatgacttttacccttcttagggggagtattggcacagcacagatctctaagactccagaaaactcacctgtgctctttcaccagcttacagtcttattgagagggcactctattgctcactgaagcattagaagagggaccgtactcagtaatccacaatgcaggataaacagaggtcagatgtcaaatagggaacaaaagccaggagaagaaggacaatggcagaatgtgttagtaagggtgccctagctgctataacaaatacacccaaaatgtttcgtggttcagatgcaataggttatttcttgctcatctactagtctggggcaggtgttcttggtgggtgggtggctctcctccacacagtgactcatggaccaacaccttccatcttatggcaccaccaccccctaggattttgtcatcatgtgcatacaggagacacactcacatcttaagagccttgacccagaagtggtatgcttcattttcacatttcattgatttcaacttagttacatggcaggttgtggcctacagaaaagttcccgactagcagaccatgagagggctgaaatccagtgcaccttcccttttctaagccttacaacctgcagaaaggaactccttttttctaattgtaccggctggcttctatctaccctggccagggtgtggggcttgggggtggagatgggggagagaggcatggaagggggtaagaggagtgacagggatgaaggaaagcaagaaatgccttggaggggagtggaacctgagcccaggtggcatttggtggccctgtagtttcagagagtgagtgccaacctgagctggttccccctgcccccactgggttaggagctgcagtgccaacctctcacccagtgagccctgtgcagctcttccccagcagagggcagagttgatacccttccccacccgggcctgaccccatacccagagtcacccagtgtctgtcagggaagatgaggatggcaggggctaagtagaggccatgcaccctgatcccagacctcagagaaaaactgttggggtgatggcgccttggctggagcaggccacccacctggccctgcgctgaactgagaacccgaggagcgcgtcccctccctcctccctccctgctgacatagcttggcagatgagtccccggaggcttggctcagcccctgaccccctgtaccccaggggccaggctctgggagtcagaggagctggcatccagccctggctccactgggctgtccacctcctgccccgcccagcacggcccgctgggacctccttgcctggcccagctgctgcatggccatgggtgccactctgcctcacctgtgttttagttgacaggagtatttgtcacccttgtttttacacctgtcaccatcccacctgccgcatgtaaacactaccagcatcaacacggtaatgccggttcccctgggtgggcaccagccaagccctctgggagctgagaagagcaggtgatagcagctggagaggtcccaggggccagccttccctgaccctgccctcggggagacagggctgccgggctctgggccagctctgcccctggcttgctgatggccccacctcctactcacgggcctccatttcctctcggaagaccaggccactaaatcacagggaagcagggctgcacggggctggcgatgtgggctccggagtcaggcggctggcgttcaatcccagctctaccacctactggctgagggaccgtcagcaagtctcataacccatctgatcttcggtttgtctgagtataaaatgggggaaacgataatacttgtgaacatcaaatggagtaagcctcctggtaagtgctcgacagatactggctgctgtcatgatctcttggggcctctctttgacaccaggcccctgagtgcatgtgtgggtgtttgtctgtctatctgagtcccaaggctcacagcaaacactgaggcggccacagcctgggcttgctgtatccttctggactggttggctcagccagctctgacccctgaacccagaggtccctcctcgaccccaactctgacaaccttcctgccaccactgactttttgcaaagactcataattctggatttcctacctgaggtggtggctgtggccgaaaggcccattctcacccatgagaaggtctcctgagaatgagccgcacctctgcaggtggaggccttgccatccagccctgggatgtgctgcatgggacggtctgcccagggccttccaagtggggcacgtgccaccgctctgtgagatgagatggctcagtgggacaaggctcacacatttaatagcatgggctcaccgagtcagaaagtggttccttctctctcagcttgtctgagagcctcaaaaagaaagtctcaggctggtgcttggaccttcataacacctctgaacctatctcctaggtcaacaaagagagcaaggcctcaagcccagagccttctacaggcaggggatccagagaatttagcatcctattctgctctcattgtagttattcttatgggtgttttctatttaaaatactttatacaagttcttcacttatcatagggatatgatgtttataaggtaaaaagatgtgtctaggaaaaatagtaagtattactcattcggtgatgcaggactttggcagaacttatgaagatattagggtatgatgcttgggaaagaatgctcttgtccagcagctcttaaacattttggtttatactcctaaaaattatcaaggaccccagtaagcattttgtttatgtaggttatatctatcaatttttattgtattagaaattaaaattaaggaaaatttaaaatatatatttatttgaaaataactataagtccattacacattaatataaataaaatttttatggaaaagtactgtatttttcaaaaatattttagtaaggagaatgtcattgttttacatttttgcaaatgtctttcatgtccagcctgatagaaaatggctcggttctcacacgtctctgccttctctctgttgtgatgtgttgtttggttgaagaaaaatttggccccacacgaacagggaaggagtattttactagccttttcagataattattctttgaaactcccaggacttggcaaatggtagtttattaaaggagagttgcaatgtggaatctgaaagtatatcaatgacccttctttttttactttttttgagacggtatctgtctcgcccaggctggagtgcagtggcacgatgacaactcactccagcctcaacctctgggctcaagcaatcctcccacctcagcctccccagtagctgggactacaagtacacaccactcccagggggccaccatgcctggctaattttttttaatttttatagagacggggtctcactgtgttgcctgtgctggtcaatgaccctttcctgttctgttacattaaaattcactggcctaccttgcactttgaatggatctcttactatgaatgatttttaacaccattttggtcatttggaaaatattggttcatgagttacacagatctgaatgttgacacatttcagcatattatatcaaaaactcacatttgttaatatcaacactgatctttgagaaaagctttaggtattgggaagttaccaagtttacagtggtaaacacaagtcttccacaattctgcattttcacttgaaagccagaattttataattttggtaacaaatatgtcagtggttttctttgaaatcgtggctcactggttcatttttgggagaacttctgccagagaccccagtctgaaatcctactgcttgccgctcaggcttttcaaggaaaagcagtgtcccatgaaggaagggatgagtccggcttgcaactcagcctttccccagtacagccgccacccttacatttgcagcacgtgttttgtgcttacttcccatgtcatcatctcacagaattctcagacgggtactcgagtggagttttttataagtcgtaatttttacttcttcaccaacgacattcttcagtccagccagcatttgctttcttggcatgcatggtggtagggagtgcaatggcagctctgcagcccggcgccgagtccagcgccggcgcctggcttctggctaaggagaccacgattgtatctgctgctgctacttttgcaccatccgtgcaaatgttaacactgttaggaaggcaagtgacatcttagttttgttatgaaaatagttttgatttcatggacccccttgaaaggatctcagagacccctcggggtccactgaccaccctttgagaaccgctgatctagccaatcccttccttatgcactagggacactaagaccccacaaggagaagagacttgcccagggtcccaaagccagtcagaggcagagtgacctgaagcccaaagctctgagatcctggaagcaacgtgatctgcaccttttctaacaaaacagtatgtgcccactctgatgaatggcacaggagccagtgtccccggggaaaggatgaggaggcaagagggatgaaccagcctggggataggcaccagttggccaaccctgtcaacttcaggacttgcctattcccaccctgcaccttatgtgtagcgctgcatcttccatcttttctcttccatagctgtgttgctaatgtctcccagccgaggcggctgtaattaaactattcaccatcgtcacttcgtgttctgaagagatgaggtcggccattatcatttttccttccctttgactgagctctgtgtgggtaatttcattctgccttgttcatttcttagaaattttgtctatccaattttagttcttttttcctcttagaacactgggctcaggggaaaggaggtggaggatgagggcatcatggatttggaaatttctgtcccattcaccttaaagcttttttgggacaggatagtgcctgcttggtggtgcagctatccagagagcccccatccaggagagatacccaggaggtgtagaacaggggtctggacccactgaggggagaagggcaccaagacaaagaggcaccacgtaaggctgtcccagaggggcagtggttggagctttggacagacagcgtccccacccctttcctggtggtcagaagccttgctgacataaaaacccccctgcctctgggggcccaggacaggcttctgttgctaatgaaagtgagcaggggccaggcacagtggatcacacctgtaatcccagcactttgagaggccaaggcgggcagatcacgaggtcaggagttcgagaccagcctggccaagagaccagcctggccaacatggagaaaccccatctctactaaaaatacaaaaattagccgggcatggtggcgggcacctgtaatcccagctactcgggaggctgaggcaggagaattgcttgaacccgggaggcggaggttgcagtaggccaaagatcttgccactgcactccagcctgggcaacaaagtgagactctgactcaaaaaaaaaaagagtgagcagggcctccatcctgcgtttcctctccccggcgtgccctgccaggcctccactagctcccctagggcccccatgcccactctacacagatgctggcagggctgacagctcccctgctcctgcaggaagaggccaggagcccacgccacacagaaaacgtgaatgtcccaggccccaacacatggaaggcctggcatttcctctgccaggctctatggggaagcattttctctccatcagggctgccccaggatggacactggcctgcccaccaggggtagggcaccccctcataggcatgaccagcaacctggccgagaggctgtctgtgcttgagcccctgagccatctgtgtgcccacaggtggctgtcctaagtttaaccttctagggctgcatgaccccactgctgtcctcaggccctgctgatggctgccagagcatctggtgcctccaggacccactcttgcccgtcaaggccctcagtgttgcctgggtctcgcctcacctctctttaattccctcctcacctcccgagaagccccatgtctcccaccatccacaaacctgttcctcctgaggcccagaccctgcctccctggggtggcctccccactccccagctggtgctgatggatctgacgcccctagtggactgcaggcacgggcagggcagggtccagttcctgctggcagttctgtccccagcactcagccctgggcttcacacagagacgtcctccaatctgtggggaaggaagattcttaggtctcgccctggctcctgcttaactgtggccagggccaggagtgggaaactgcaccagccactgacaggtggtttctgggtgaaaactttcaggtgtgcgggaaccagtgacagggcctcagaggacttgggccacagtcgccttcccaccccctggcccctggttctggaaggaacatagtaagcagtttctgtctaggaaaaacctgcttctcagtcattggaagatccctgagttctgaggctgaaaaggaaagaaagttaggatcaaaaaacccaagccttctttactccacaggagacatcctgggtccaggcagggaaggttctcagaaaggcttaggacaaatcctggggcatccagaaggtttgaactgctttctgaacccaggtggggacttcaggaacgccttgcttaacacagtcacagacccctgacacagaagggaccatgggacagaggcagggaaaacctcaggggctgctctccctccaccccgatgtgttcaaggcaccaactactgagctggggagattccctttgtcaaatgttaaagtccttaaggcccagaccccactcagtgtctgccacctagcaggtgtaaatggatacatagtagatgggtgaatggatgagtggatcaaggagagaatgaatgggtgggaggcgagttggatcaaacaggagtggatgagtaactaagggatagatagatgccagggaagagtggaggggatggtggtgggttggaagggatgtgagtggatggatgaactggggtggctgatgggtagatgatgtatagatgggtaggtgcacaaggtttgataggtaggtatcctgggtaggtggtgcaggatgtgtggctggctggctggagaagggatgatgggtggatttgaaagaagagagtgggaggatcatcatcctaaatggagaaggaaagcaagattagagatggcactgaatccttggttctgctgcaggatctttttgaggaaccaggaaggttcccttccctaaagcaatggtgagcccatgaggtcccctacctcctcaagagaccctgtgagctgaggacgttctgtaggcgcaggccttgctcagaatcctaagcccaagcgaggaaagagccccagccgccaaatgcctgcagcaccccagttgttgccactaccaaagactggtcacaaatgtctaacgtgcgcccggggtggcaatttggtaccacttccactgagagtcacaggcagagagccatctgccagcccaaggccaggaaagcagacccccgccccggaagggagtgctccccactgttctgacgcccagctgcagagagggaggggcggggggctctctcctgtgccggagagaacggagagaacgtgacggtgtttcctcagatgtgcaggcctgggtgggagcgctagttactaagtacccagaattcttcgccagctggaattgtagtggccaggctgggcccccccagcggctggggtctctctgccccttcgcgttgaagagcaagtcggcagcccaaggaaggcgcgatggccgccgggcccggccctgcaatgcctggtctctggctcggcgggtccagctcacgctccctctcccattggcctgtgcactcctgccccctggtgggtacagggacaactacagtacatggggcagggtggggccagatggaggtttttccctgcaactggaggactgggtttgtgtgtgtgtgtgcgtgcgcgtgcatgtctgcagactcacacttcacttggcctaaaagattagagatggaggaaagctctgaatgatccaaagcagctcctcaaatggaaggggttattattataattactatgattattgttatcaagattatcatgcttgcctagaaagtcttgtacaaagcaggcttattttgtgtcagcttgttgtttgtgtctgaggcatttcatctttgcttataataactaacattggcaggcttctttcatgttgcaaagctgtgtcacatcctcaccccgttttatctgcacaaacagccctgtgcagtggggagtagtgagagaacagaggctcagaggttcagtgttctgtccaaggtcacatggctaaaaagatgcagaagccaggatttgaacttgggtcacacaatgaaaatccctgttcatttccccatcatatccttggcacctcatcccttgagagggaagaggccttttattaagctttagctccaagcctctttgccactgatatttgctgaaaagcttacattgccatgaagagaagggaagggttttgaagactcaagtgttaaaagtgcagtttaccatcccagtttcacacaaagaatatacctgggcttttccaagtccctgcagtacctggggtgtgagtggagaatgaggtcttctatccttttcgctcaggttctcttggtcaccaccaccacccctggggtgtggcacaggacagacaggcatctgctacatctctgagaagcgcggaagaaggtgctatgacaggagaagctggtgcagggggactgtctgtgtcctggtgggtaggagctgggtacacagggggcagggccctgactgggctctgggagcctacgcccctccttggagcatgggttctatctccagggaccagctggctgactggagagagctttctggaagcagcacccctacctgctgcgcaccatgggctgttatactgattgtcaccagggtgctgcttccccagcacactcgtgaccagccgccagcagcacatgtcctcgtggcaggacacagggcctgtgtgccaggataagggaccccctgtgtaatgccagttccggagcatcactaccctaccacctcccaggcatcctgctccccagcaacagcccaaagcaacccacttctggggggtacctgtaccatgctccccacccctctcaatgctggaatgtcccctgggccctgtctccacaggcctcttcctctccttgcccacccctttctccagctgctgacaggtgccatgcaaaggtttacatagggggttctctggagccttgagcttccccaaaagtgcctcatctccactgtggcagctttgagccatttatttgtcaacattaagagtgagatatcatttaaccagaaagattgtactggttactatgataaaaatatgttcatgctgtctttaaatcattgatgtggaaaagagtcctgtaggtggccttgagaaatgacaacctctcctggcctcctgatcctaaacccataagaatggcatctcgcttactgttagcattcagaaatatacagtcccagccatgccccatagaagagtcccatcctcctcccgtgtgcccaatcatcatgagggtgggcgggttgctcttatctctatgtggcagccctgggcagcctatgacgtggagccgtgtatactcgtccactgggtggacagcagcgcagcccacccctcagggccatccctgtgctaagtgccctccgtttgctcacacaacagccttgcagagaaaatgatggtgctgtcatccccattttgcaggtgagaacactgagcctcagaaagatgataccccttgctcaagctggaagctaaagctggagctcaggtctgggtagctcctgaatttacagtctgaagcccgcagaaagctgcatggagcagcactaaaagtccaaggagggagtgagcaaaggaagctggcagaggaggctcctcgaagggtgtggggtggcaagagaatcagatgttggattccatggtgggttccagcaggtgcggaatgatgaggtgggggcattctgggcccttaatgattacaaaacccatcccacctgcacctatacatccgaggaaatgcagtcaggttttccctcacacacacagcagagagccccctcccttcctctctgtagctgggccttagaaccactgtaactgggacagtggtgggaagagggacccactccttcatgcctcaggcagacatgcatgtccatgaactccttacaggactgcctgctactgaatcccccagactgcctttagtgtgcagcatgtatgtggccagtgctcacaacacagctagtgccataccagtcccatgggagagagaggggccacccacacaggaaacaccacacggcatgtgggcactgtgcacggggtgtggtcagatagtaagagaggagcgggctcagaagccaggaaagccagtggcgctgcaggaatgggagggggtcttcctgcaggaggtaggccacacattagccttggccgactagggggcataataggactatttggggtacaagtgcaaaaataaaccaaccaaacaaacaaacaacatatcctccaatggatttttaaaagcaggggattgattgactcaagtaactagaaagcccagaggtctctgtggctgcaggcgcagctggatccaggcgttgacatattatgactcaggtgcctccctctcagctctgctttcctcagtgttggctgcacactcagagggggcctccctttgagagcctctctttcctaatagctgctacaagtgtcctggggctggctgggactagagactgattgttagtctcatttgacaaatagggattctttgtccaccccagactcttcacaggccagtgagatgggttggccaagcccagagcatgtgtccacccctagaatcaggggagatttagctcaacgcagaccactcagactgggctggagaagggtgcttcacttctgggaactggggctctgctgccgtaaaacaagagaaaaaagccacaaaggcagagagggcagctgcccaggagaacaggactgggcagagaggagcgggcaggccttcactgccacctggtagcggtcactgctgtctctcctgcagaactgcctgggcgggagcacgcagtgagttttctaaagaagtcagctctagccgtctgccccgcgtaaaatactcacaggccagacctggtatcttcatccattcaggctaccatagcagaataccataagctgggtggcttatacacaacagaaatttatttctcacagttctggaagctgggaagttcaagatgaaggtgctggcagatcactatcaggtgggggctactttctcttagacggccccttcttgctgcgtcctcacgtggtggaaggggtgtgggtctttggggcctctcttataagggcactaacccccttcctgagagctccacctttaagacctaatcacctcccaaaggccccatctccgaacgccagcatcttgggggttaggatttcagcataggaatcttagggggacataaacaatcagactacagcacctggtgagtctgcccagagaacatgcatgtgttttgtcacatctcatatggcctgggcacccaggcacgctctgaccagcaagaaacagcagtgtgatggggccgtagcagaaagaatggtgctagaaaatacccaccacacacaacccataggcccaggaggagccttggatgggaaattcaggctcagcctgagccccgtcccccagacccctaaaagcaggcagacaaaggagcagggtctcccctggctctagtaattgcttgtgaagcccaccatccttttttttgtgctggcaaagcccttccttcccctcaggcctggcccttctatcttatgcatctcccttccctctgcttgggggctgggctgggtacccgttagttctcagcttgggcctcaggtggccaggccttgtctgagatgtgaagtccagagctgctggctgtggcacaagaggaggtcgactttgagtccaggctctccttactggcgatgtgatctttagcaagctccctcgcctaagcaggatacccacctgccgtaatcattaaatgagacacaaactgacaagagctggaggatagataggattgagtgagaaactggggccaagcctcatattaaaatgccaaggatccatacatcctgcagacgtggctgagcaccaactctctaccaagcacggtgtgaggcccaggtaccatgagaaatcaggaaacgatccctgccctgaggaccaggctcatacagcaccagctgtaccatggtgttgctgtgcgctgtgggagcagggaggtgggcttccctaaggaggtgacatttgagatagggtgggactgagaccagagtgatctggacagatggagcacccagcttatttggggaacaggagtaaggctgtatggctggagccccgtgagagggggcaagttggaggatgtcaggacagagaggcagtcaggggctttgtaggccccaaggagtctggaatgcgggaatgatgggcagctgttgaaaggaagagctatacccattatgattaagtttaactgaataccagaaactctggaaattatgccttaaataagatagaaattgatttaagtattaagaaaacacacactgaagatagtgtgaggatgacttcagatagtgtggagtctgatccttgacctaggctgtttttggatcactattccactatccctagggtgttgaccttgtcttcatgatcccatttagttgctagagctccagccatcacatccaagttccaggcattaggaaagagggaatgagagaaaaagggtgccccttacctttaaaacaacctttcctgaggccttacttcacttcagcttacctttctttgtgcagaatttgtcacatggtcacaactagctgtaagcaaaaaaaaaaaaaaaatccagccttttagttggatatcagtgtgcccaaccaaaaatttctggattctttttgtaaagaagaaggggagaattgatgttaataggaaactaatggtctccttctgtgtggggagcaggctgaagaggagaaggaccgaggcagggagcccatgggagggaaccatggaggcctggacttagaagtcggggaggagatgaggaggagcagacagctgaaagcagatctgaaagaagaactgcagggcactgggcatgggaaggactcagtgaaatcaagcaggtctcctggtctttgaatttgagcagttgagccaatgtggaagacaggagagagcgggaagggcggggggccagggggtgttgctgccagcacaggacccctccccgtcccacaacaggaaggcctagacccctgggctatctgctggagaatcccaggaaatcatttatcccagatgtccccaaactgtagaatgcatcctactggagtgggacccattaaattccaggccacacatggaagctcaaacatgggagcacagtagctttgtggcctcggtttgtaaatcacaccgtcttgagtgtcctcctacaaagcctgttgtggctccagggcccccacattagcgtgtgatcctcaggtccagggaaggtcttgcctcgcaggcgtccccaaccctgctctcaggtcctgacttgttctgactcaggtgctccacagatctacagaaaccatgaaggtagggcccaaagaaggaagagttggaaaactcttgccaggtccaccacccgcattcctcagatgggaaagtaccccaagattgcccgaggtcagccaggcgtgaggagcaggatcgctgcaggtccctgactcataggccttgcactgtttttagccccaggtggaggcgccacccctgctcacccacctgctgctgccctgagtcatccctgcctgcctggggcacccaaagcccaggccccagggctggctttccaggtcactgctgccaggggggcccggacagccttcatgcccagtgagggcgaagtcagaccccacgggctgggttgttggcgatactgacccttggatgctgggtcaggtcagcatggggacttggccttccagcctctgcaccattgtagcttccttcccaggacaggcaatgggaggggcacagcttccagaactttctcactgcccttctgcagtggacaggctctgacatgtaaatagcactttagctggacagctcaattctggaagagctttggcctcacacttcttttgtacagacctttcgttggcgacaaaacttccagatgctgacctcattttctttgtgtctctcccatccccaaggatgcctgcagactttcagtacctcccactcacttctagagccacgtgccatgggctgggcagtcagtctctctcctccggcctaatcagagggttgggagttgaaggggtttgcggcagaaaaattatctaataataatactgcatgcagctgggcgctgtggctcacgcctgtaatcccaacactttgggaggccaaggcgggtggatcacctgaggttgggagttcgagaccagcctgaccaacatggagaaaccccatctctactaaaagtacaaaattagccgggcgtggtggcacatgcctgtaatcccagctactcaggaggttaagccaggagaatctcttgaacccaggaggcggaggttgtggtgagctgagatcatgccactgcattccagcctgggcaacaagagcaaaactccatctcaaattaataataataataataatgcacacatgaataaaatatcccaattctggagagcccgtgaaatcggggagatggtaggcctggtgtatgcgactctcagaccccagtggggtctcagtctctgttgggctccaggactcgtgcggtctgaaaccagggggaaggcggctggaggaaggaccccagctccctgcctccacctcctccagtgctgagcatcttgtcttgggcctggtagtagtcagggtctctgtgagtgcaagtggcagaaactaacgggatagggctcacaggacaggtcacatgaagggtaaagggacccagccttggggacctaaataccatgacacttccctgcttctttctggtagctttattctgagagtcttcttcatgggttgggggacgcttgtctcagtgatactagcgactctggggccacattctcctaagcttcccactttgaaaaatcccagggaaagactacaggtggcccagcatggtcacatgctcaccagccacctcctccactcatcgaccctcttccttgccttggcatcccacacctggttcccagggcctggcatggactggaagctggcctgggctccacaggactcagggtccagcacactcctgtcctggccctgtgttcccagccatgcctcttcctgtcgctgggacatctcgcagtgccactctgctggtgcacaccctgaggcgtggtgccccaggcgggcagtagtcactaggcaggggtgttctcaggacctgctaggattcagccaggaatagaggggccactcggatggtggttaccttgcattttggttaggagagtggtctgagcaaagtcctgtcagccacagagacatgtgaagagcaagaagacagggtatgtctggtgcctgggctgagacaggggcttgctgtcctcaagacagcttctagaggtttaggttcctttagaagcttatctgagaaaaggatttgggtgagacaaggagtttatttgggaggtcatttcaggaagcaccgaggaagtggggaagccacacaggaagggagggaagccatgaaggggagctcatgggtggcctgccacgttggctgctggggctccatcccatggggatcctgtctgaatgtgtagcttgtctcagaattgcctccctgggagggcaaggaagccgggttatttgcccattcctgtctgtccggggcaccgactcaaactgcagccagctatacacctgaggcagtgagctccatgggcagaggcaggagggcggcccggggcagcacctgctctgctctcacctactctgcgttggacattaaaggctgtggctgcctcagacggagcacatatcttcctgggcaaggccacttcagctgtggtctagacccctctaccaggccctgtcagccgtccagggagctctcggcacaggtgggtctgatcatagaggctgggcctggagtccgaaggcacctcatcttgagtcccacccctgccactcaccatcgggttgttaagtgagtgccttcctctctgtggccctcaatttccccactatgaagtggagatggtaatactacagcaactgctgtattagctgtgccacagcaatgctgtctactgagcctctcctaaacccagccacttagttctgcagatcagagacccagggcaggctccactctgtaccaggctccccgagtcctcttcccaggatgaatgacagagcccgggcgtattcatggcgatggcagggcccacgaggaccagcagaaacacggcctctcaaggagctggcacagtgccactgctgcaccattctgtgggccacggcgagtcctgtgccatactcaacatcaagcagacaggacatatactcagcctttagcaggaggagctgaagaggcgcagggcaaagggtgtgggcagaggaggggtgaaaggcccaacgacacagctcttgccactcgctcctgaggtgggggaggttctgaggacggagtgtgttcaccaaatcctttgtacgctaagtactactcccgtgtgcaaggtggcggtgacggtgcagtcctgggatgtctgcaggagccttcttatcttcaaagaccaccacactcctggttgtgatgttacatgcatgtgattgtagtctttgaaaaggcgaccccactttggtatccaggatgaggggaaggggaagaaacctgttaattatgcagtactttttctgtaatttcaagaaggctcagcctacacgtgtgcaccttaagcaaattcatctacacccactcagacaaggaggaagggaggaggcagaggaggagagtgctccaagctcattacctgtcctttcccatttccatgtttcacctgacctaggagcttcccctgcccccagagaaaggtaggccccaggtcacaaacaaatcaagaaaaattaataaaatggacttttggctttgagcagtccaagggccaaagttcttgagatttagtgttggcatgagatatttttgccatctgcactaacttggcaaccagcccctcccctcccccagtcctgaggcacagccccgctgtggcccatccctcagctaaccggaattctctaccgaaacgtctgctcctctacatagcccagttctagggactgcattccaccctgtgtaagaagtatagaaaattacagctcagccaagaacattgatttttttctcccccgaacaaaataaccgagttttcaggatgaaagcagagctgctggttgagttggagggtggagagcagagccaggcccactctgccttcctgctggttgagttggagagtggagaacagagccgggcccactctcccttcctgccccagaaaactctggggccccatgggctgcagcttggagctcctgctttaggacatccatgtggtagaaggccccacgggccccaggaaccccaactgtgcatgctcaggtcgtggccctccctggagcaggctgtgggctgagctgcggtcctgctgcactggctgggctctcatcacagtccccgctaggggagagcccttggctggcagaggtcttctgtccccaccaaagcgtcaaagcccaccatccacctctcctcacaggctgacgccaagatggtgtgtgatgtggtgagtcggatggaagacaccgagcccttctctgcagagctgctttctgccatgatgcggctctggggcgactcaggaatccaagagtgcttcaaccggtcccgggagtatcagctcaacgactctgccaaatagtgagtgtcccagcgggcgcatggcctggagccgggcagtgatgcgggagtggaagggactggtgatggggattggcagagcaaggaggattctcggctgaggtcacgcctgccgggagatgttctcccataggtagagggtgtcaggaaggaatgagaaggggcctctcttcctgcaccccaggaggagaaagaggccagaggaggcagaggacgcaagagacaaccaaacagtggaaattcccagagggccgggaccttgtcactggcttgtcctggagagtgcctggcactgcaaaaagacagctttcaagtgtagcagctttgtttttttatagggagcccctgaccgcataaatacaaaccaaaacaacagccatataggcagaaaagaaatggtgccattttgttttattttagaaaaaataataagctttccattccccatctttaaaattaagaataaggaatatgtaagtctaattaatataataaatgtatactttaatactatttataactaaataagggggatgacaggagggcaggaggacggaaggaagaaaggaaggggagagagggagaaagaagaggacagaagagaagacggagaggtgggaagtggtaaaagctggagctggttagaaggtgctcccggctcttcccatcacagcaggtcacaggtccactggctgcagctttatcactctaggcatctccaaggacatcctcactgcttccgtgcccttggcctctagattggaggctccagagccctgggatggtcagcgttggtcagggacatgtcttctgtcatggagatactgggattgcccccttggctttcgggaaatgcaccccacctttgcaattgcaatctggtacccatacattcagtgggggctttctgcaaggagcccttgagctttatcccactagctgggaagattctgacatgatccagtccagccattttcaccaggtctcagctggggcctttttgcctccaggggacattcagcaacatcgggagacatttttgatggctgcagctagagtggtgctcccggcagctagcaggtagaggccagagatgctgttaaacaccccatagtgtgcaggacggcccccacaacaaagagttacgtggccccaaacatccatagtgccaagattaagaaaccctgatctacgcaatgccaatggacagaggctgaggccaatgttcactcctggacatttccacgggccacatggcagccaacagactagggacttgagcaaggccgggagcggcttcccatttctgcacacctagattgtccagagggcaaatgccgaagtcctgtgagtcccaggtgatgactacctaggcccccgggcctgatgagctcccagggacaccctggtggtcagggcagtgagcccagaagctcagtgtccaccattccgtatgcacaaatcacagaccagagctaggcaggagagagtgactttcagctgccctcctcccttcttccactccctgtccctgccctggagtccagggcctcctccccgagggccagcaagaccctcaagggcctttagggccagctggcccaaatctgtcttctagtggctcagcaaattctgctctccacttacatttttacccatttcactaattataacatgaatccattaccaaaaaaaaattaaacaaatgcagagggatgtaaaatgagaagtaatcttcctactccccccaccagccctgcccctcccacttttacccacttccatttatttgtcccagtggcatccagaaaaacttgatcctctgactcaaaatagtatttactgccacccactctggaatcgagggagctcagctcaccttccttccttccatcgctctccaccttcacctccggctttttgctagttacaggattatttttagttcttccggtgcttacctttataactttaaataagaaacttgagtcagtatttgtcaactccccaccaagtaagctgaggaaattctcctccctgcagcctcatctctgccttctttcaaattttccacttcccaggttgatgatgttaccattctcttctgtcactgtggctgggccttccgtgtctcccctctgggagagggcaggaaagacaggggacacacaggtggccagggccggaagggcctggcacatttcctgtcttagcagttagacctcagcttctgacaaagtcttgggcccagtatagaaagcagatcagagtaggtttgttgtgctggaaaggagagggaggactcacagggctgccacagcacgtgcttccagggggtgccattgacaccctaatgccccaaccaccaaagcacttctctgcccagccctttacaggggagggaccagggcacaggctcctgagcaggctcttggtgcaccccggcctctgtgaacagggctggctctcccttctggataactacctagaggcaggtcccagaaaccctgggcacatccaaccaggggctgtgaaaggtgctctggggcctggttggcattggctttcctcaaatccagttccccactgagttgtccatgctggcgtccgacgtttcctctcctcaccttctctcttgaccccactcctatcgagctcttgctcctccgcctgctgagatggctcatagcccagtcctatcctgggggctgctccatcagcctcctcccactcagggttcagggttcagtcccctagtacctggtacctcctttcactcccagcccccgcctcctctcgggccgccctttccagactccctcgatgcctcctgcccacccacccaggcaactggtgatgggggaggtctgctgggggctgctgtatcccgtccccaagctccatcccagaagcacctcctctcaaggcctggtgcctggtgaccttctcctgtctcgttttaaacaccttgtacacttggacaactctcaaattcatatcgccagcccagccctccctcctgacttctgcctactcagtgcctgtttggacatcaaatgagtctcaagttaacatgagcccgtggaacccctggctcccatcctcccactagaagctgctctgtgtgctcctccctccctctaaatgtgtctcattccaccacgtggaggtatctctacttctgctcgtcctcctgtatcccacaccgaggccaccagcagatgcagctcccctggcaggtacatcagattctgaccactcacaccctccacagccacccccactgtgccagtgccatctggtgacgacagcagctctgcaggccccacccgctgacctgctctcatggcagcaacagggccgttgtcaacatgcttctggccagaaccctcgaggggctcccatctcactcagagcaaaagctcaagccctgacaatgacctcaagggcctgcttgccccagccggactctggccaccctcacctccaccaccttccccagcctcacccaccacctggcccctccacgtgtgcttcctgccgccatgcctgccagtgtttccactgggccactcgaggcccacttgctccctcattcccctcagtctcccctatccagacgccttccccaaccaccctgcatcaaatagcagcccccagcagctctcccccatcactaatagcctgattcgttctctcacactacctcctgacatatcatctctctgactcttctgtttaccacctcacacacgtgtgcacactcacttggaacacaggccctgggaaggtggggctgtgtcgactgccccatccccagctcctggaacagtggctaggtgggatggacagcaggtgcacagtcagccttcccgactgggttgttaagcagttctcccacaccttgcccaccctccacagccgtctccttgcatgaggctcggccagcacagagaggccagagggccaggttgcccatctaaaggaggtttgccctggctgggaaaggaagagcaggaccaaacgcttccaggctggtgtccagctgcagatgacagcagagggcgtcctcacagcttggaagcagaggtcatgggcgccagggcggggcaggcacagaggcttgggagaggctccttctggctgagaccagagcctgcccagatgccactggctggcgaggaggctgtgaggccgggggcgtgtacaggtctgctctgcagcctcggctctctcaccccatccccacaccgttcctgtccacggagggcagtcaggctcaggagaggaggccaggagtcctgtttaaattttttttctggatttttaaaatgctgatgatgtccagtttaagagcgtggggtctggagccagtcagaactgggctggaatcccagccaagtgcattttctttttttcttttttttttttttctccccgagacagagtcttgctctgtcacccaggctggagtacagtggcacgatctcaactcactgcaacctccgcctcctgggttgaagcgattctcctgcctcagcctcctgagtgctgggattataggcacctgccaccaggcccagctaatttttgcatttttagtagagatggggtttcaccatgttggccaggatggtctcaaaatcctgacctcatgatccgcccaccttggcctcccaaagtgctgggattacaggcgtgagccaccgcacccggctgccaagttcattttctcgcagtgtgacttcaagcttacctccctgagccttggaagccacccttctgttttcttttcttaggggcattctcacaaggattgtcactgggttctatcagtgaacaccctagctggcgaagtcatctgccctttccagccctgtggacatccatgagctggtcagcatgcccatctctcatgcagtggtaactgcaggtccagccagcaagctggcccccagcaggtcctggagcagatgcagcctgggaccccacatcgttctgtggttcagacacttggggctcctccctgtgggctgcttgtggtttgccccggcagcagggatgggtggcctggcaggctccatggatcactgagtcttccttcaggcctggcccagctccccacttcctgatttcccagatcctaccctggctttaggttcaaacttaacccacaatgaaccccaaagcccttgcaggcagcgtcctctgagtgcttggcctgaggcctgggcaggtgacttgcaaaagcctggtctgtccccacagcaggaggtagcaggggtaaagagccctgattccaaagaccgggtcccagggaggcccagccgctgtatggctgtgcagccctgagcctccaagagcatcaaattggaaggggcacacagaccccttggtaagtgagaaggaagtgtggagaaggcagggaactgctcaggggccgctgaagccccagacagtaataaaattatggcctctggagccaagggtccgggtcacagcctcaggcaaggtacttaccttcgatgagccccagttttagtacatttaactcagggaaattacacatgaaacatggttacacatgcaaagaatagaacctatctgttggccattattatcttttaaatgaaaaaatgacaaaacagtattataataaacatggtagtctcatataaaagcttgatcttgtctgagtgtcccgggagctgcatgcgtagcccttttggctgtgaatgagtgcgtgaggccaagacccctaagacccacttcctcagtcgcccccactccctatggcctggaatggaggtgatgtcttttccacagtgacctggaggggccctgaccgagactggactctgaagatgggtggcctggccagtcccgaacagtgtccaggcatttggtccatagtcccctgtttgttgccatcctcagctacctggacagcctggatcggattggggccgccgactaccagcccaccgagcaggacatcctccgaaccagggtcaaaaccactggcatcgtagaaacccacttcacattcaagaacctccacttcaggtgaggcccagagaggcccccaggccctggcgagggctaagatgggacatgcccagcctctcagcgcattgcgtttacagcgcccaaacatcatcctgccccagggaacctgcgggctggggcaggcagctagatactagaaggaacctgtctgtgtttctgccaaggttaggggctggagtgagcagggaggctttctggaagaagattcccagagtggggctgtgaggaacagggaggatttggacaaggaggggcagcctgtccctgaggtgacttccaaggaggaggaggaggtgggctaccagggggcccttccaaggtcaccttggggggaggagccaagagtggggctgggtaagcccaagctacctctgtgagaccctgaggacccaagtaatcccagagctggaaggagcagagagagctgacccaccctctcctagtacgcttgggaagctgaggcctgacaagagcagggcttttcccaggcacagagcacagctagaacccaggggctctggggcctcagagcaggggcctgacgggtgagctggttcccagggtcctgctgcagcgctgtgtccccacctgcagtaacatgcgtgcactgaggcctgctccgtcctgtggggaagagaggccagcagagaaggggagggcagggacccctgctgggagagctggattctaatattccctgcctcccatgtccccaactcctgcccgctcctgttcagactgaggggccgaggctctgggcccaggaacccctaggcctccgcagatctggggagcaaaaccttgggcagagcagccctgaggggcctctcttgccttcccaggctccttggtctctcctgctcccccactgggagcacaggatggggatctcagctcaacccagcccagcaaggcggggtctgagaataagcattctggaggggccacagaggccatctgccaacgcccctgcatttcagatggggaggtgggatccaggggaggatcccctgattgatggaatgagaaccagacccattccttgctctgagcccacactaatctctgcctgcagtcactccgttgtgtccggtgggaccagagatccttccctgtccccctctggcaggctgtgtgtcagcaggcatcccagatctaggaggctacaggactcctcgctctggggattggggtgggagactgaccttttacttccaggacgtaagtcccacctgcccacagtctcttccagaatttttgtgccccctcgggagtagagtctgagagggggaagaggccaggctctgatctgccagaaaggggccgtactgggcagaggtgagagcgccagctttgtccacagccagacccagctccaccacagctggactctcgccagcttgggcatgtcctaagcccatgggtggctcacttctgccatccacataacaggtgacatctcctgcctgcctccctcccaggctggtttggagtttgcccagagcaaacccaggaaggaatagactgagaggagggtcctcatgcgaggaggactctcagaggcacttcctgggggtggctcaggtgcgccctcttagtaaaatgctcctcagatgcaagggcaggtctttgagtcatgatctgtgagcacagccagtcccaggacagactccaggggtagtgcctggggatggcagtgatccagctgtctgtcatcacctggagtgacaaggtcttctagtgagggcttttagcaaggctctgagcaccatggcccccatcctctgcctctcagcgtgctcacagcttaatccccaggcagccctcacctgcctggaccctgcgcctaccagctccctgcctcctacaggctgtttgacgtcggaggccagcgatctgaacgcaagaagtggatccattgcttcgaggacgtcacggccatcattttctgtgtcgcgctcagcggctatgaccaggtgctccacgaagacgaaaccacggtgagtggcctgggccccccgggcagggggcagcgctgaggagacggccgcaggataggccagccctctgagcactgggcctcgggtgcccacaatggctctggggtccagccagctgttgtggttagaggtttccatcatggacaggccgtgccggcactccaccaattctgtattgccaaggcaaatgcctcatgatgccagtgtggcagagcctgtgtatgcaacctgatcacacagagccgtgcagaatgtgcctcttccataaacttggtggagtcacagaggccatcaggccatagcaaatttaagcaaaccctaaaaaaaccaggaggcagccaagcaagaatgtacaggcaacagaaatagcagtcttagcctgacagccatccctggggcactggcgtcagatgctgctgaagcagcatggggccggggatgctgagggagaggtggggagggcccaggatgctgcaggagagttgcgtggggttgggggtgctggggagcagtgtgtggggctgatgggccaggaagggcaatggggatgaggcatgctggtgagtgacagtcgtggctctgggctcctttgccaaatgccagaccaggctcctaccttctgtcttgcgtcacattcagcctagggcctcagtgaggggacattcccctgggagagtgcagccttcctctgggtctagtcctggctctgctactcactggcttgctgctgaatttaggcagcaccctttctggctcagttactattttccataaaagggagataataatagtacctgcctgtggggggctgttggcagtggggtgggtgatgcgtgtgcagcgctctggagctgtttctgggacagcagcgccaagctggtggttgtacagttgctggtgattgccctgagcctgcaggtccactgcgtggtccccttctgggctgcagcccgccaggcaccgagcatggcccacagggtcactggagacaagccccaacactcctgacagcggggcccataggctatggggtcacagcctggcgtctgtcatctccttctgtctggaacacatgcaaatcccccaccccacgcctctgaaggctggcaccgagggtttgaggttggaggtggggcttgttgtcatgctgggccttgagcgaggcctgtcctctctctgggtctgtttcctcgtcatttctggcccagctggtccactgggctttgtgaggatgggatcaactttggggtgtgggctacggggcacagtgctatagggaggaggagccgccgccctgaggggcttacacagagtgatggggctttgggctggtggtgtgggtagtctggacccgttccgtgtacaggcttacccacctgactcttcctatttcaggcccacctgtacccctgacttgggtttctgctgtaattgttctcaatggcatctgcaggcagtgatgtcagtcaccagcccagtcttgatgctgagtggggcaagggtggatgcgcttcctgggccgtgcttggacccagactcactgaccacccaaagcccaggtcagcttcctggccatgtgcccctcacagtgactacccagacatttcccactccccactgctagactctatgctattacggccactgctccaactcctggggtctgagctccacttggctcatcttttttcccccatgtccaccacggtttcaaagagagcaaaggagctagaagcaggaagccaggagggcccttccccctggaatccagcctctccctggacctgccctgccaggcctgtggatggcttcaacccaagtcccaggcccaccggccatggggctgggctctcgctcacctctggaagatggaagcaagggacgtctgggtgagcctagcagccacaggccctgagctctgcagcccatgggtccccagtgagcatgagcctggtgctgggcctggcactgggtgaccttccagcctgcgggccttgctgcctggagcacttgccctccggtcttctccaccttctctcacctccctttttccccatttcccccacccttccacacaagggctggagcagaggaccttggagaagccaaagcaaatggagccaaggtcacaggcaggctcttcctgtgtccttccttccccaaggctggccacctttgcagcccggggaagagtagcagctcgtgcagggaatggggatgactttgcaacctgacagcagccacaaaggcagctcattgccgtggtggcagcaagaacaatactggcgctgtagaactaagcagtcatcgccgtgcgctgggggcgcatgcagaggtggacagcttgggagtcagacagatctggtccagggtctagcatcacccctgccgcctgtgtgatcatgggcaaccgccccaccctgcccgggcctgcacctcctcctctgtagatggtgacaatggtagaatggaccaccgggctaaaagctgtaaaagtgcctgtacacaggaatcatcactcagtgaatagctcctgtggctacaacattcagatgccatggctagaggtcaggttctaggatgtgggagctctgtctgcctcagggaggcaagagccaggccccaggaactcaggccttggtcctcagccatcctctctggtcagcgctgtgcatccctctctggcctggggtgagagcctgcaacaaaggtgtctggaagcagcttctggagccaggccaggagagccctggggctagtggctgccactggccatccagccgccctgtccgctgcatcccgggagcccgagagcctggtcctggcctcgtacctgctctcagcaccgcccagccgggcctgcggctgccacagcttctccactaccacggtcgcctccactgcctgcagggccttatcttgccaaaccaaggccaaaaccagttctgagagaccctccaagcccggaaggtatgaagcacctccctccaactgaatccatcagctaagagttgaaagcagcaggttctcagggcaccgctgggtgactttgctgtgatgcctgcccagcccgcccctgcgcccacactcctctccagccacttggcctgggctcatcccacccatcctgcatctcttgccctgcaatccacaggcccaggatggccatggcccctgtgagcccgcaccgggctctctgcaggagctagccaggatgccctggccctgagactggttgaaccaatttttcagtatttttctctctttctcttgttgggtttttatcttctctgttttcatctgttttgctgtgtttcatcttggggttcctctggcccctctactgagaaaccagccccaacaaccagttctcccagagcctcccccgctccagcccaccaacgagaccaccaaccacaccaaggccacagcaagctcacccccgagacgctattccctggtgtctgcttccaactcgggattaattcgaggatctcttagtcctcagttaatgtttcccaactgaatgcgtgcacccttccaaccttgctgtcaaaaccgaatgagaccctggtagagaaatctgcatgagcagggttccgcgcagatgcgttcggtggtggttgcggcccctgcgctgtacgtgcatggtgcatgtcctctccgtgagctggagcctctccagtgacctcactgcccccacctggggccagctctctttggaagggggcagcatcccccaaccctgcccggccctgctccgccccgccctgcctgcgtgtggaatgaaacaggaccacgtcccgtctgtccttgtgggtcctcccgtctccgtcctggtggtctccgtcccggtggtgcatccagccacattggtggaccttccctttgcttgtcccgctgtgtcattggccgcggtgggtcagggccctggatgctgccgcccctcactcacccctccactctgttgcagaaccgcatgcacgaatccctgaagctttttgacagcatctgcaacaacaaatggttcacagacacgtccatcatcctgtttcttaacaagaaggacatatttgaagagaagatcaagaagtccccgctcaccatctgctttcctgaatatacaggtagagacccctccagggacagcaggcccccgagggagcgggccccgttcccaaagcccagtccacccttcctgtgctctgtggatgcccctgactctgccacagagaatccacacaaacggtcccccaccctgcccccagattgtgctctagagaggaggggcagctagccggggcttcctcatcagggaaagccggtagagccctggctctgccacttacgagctgtgtgaccatggcggcctctgggagcctgagctccactgtctgcgcacaggggctctctgtgacgagacgagcaaacgccgagaagatgaggggcggggcacagaggcttggagttaggcagcccaaggtttatgccccagctccgccactcacaagcagctcaggcaggtcatgcagcctctctgaacctcagtctctgggtctgtgagatggggtgatggctgtgattgccctcgcctccctcaccaggtgctatgaagagggaatgagctgatgggcacgcagagcttcgcgtggtgccgcacataggaagcgctccctgcctgtctgctcttgcctttagggttatgcctgtaactcacacggggctgctgcaagactcaaatcacagagctttgcaagcagcagagccctggccccctatatagggtgctggggatgagaggccagccctgccagtgctgtggtgggtttacctgaccatggggtgggcgggcagccaggagggcagcatgaccagggcccctgaggagctgcaggttggcagctctggtcagtgacaccagagcggttacagggccccagcatagctcgggtgcccatcagctcttctgagatggccagaccctgtccagagaagtgagtgggaggagaagtggggcaccctcagcccgacctgccctgaggccttggagggcacagagcaggggcagacagagtcccagtggggcatcccgggggcttggggccaggcaagcagcacagctctcctacctcctgcctccgcccatccccccatatcaggctgagtgcctggcaggccaggacccaggcatgtccagctggagttgagtagggctcagcctccctggaagctcccagccagcttcctctctagccatagttgagggcctgtggatcctgccctagtgacccgggcttgtggcctgtggggcagtggaaacaggtggggtcggtcagttaccaaggccagtgtgggcctggagtggggaaggaggaggggacaagggaggctgagtagtcagctgcagtcctaggacactccccaacctccagcccagattgagcaaagagctgaggtctggcaggccctccaggctttctgcacagcagcccactccagcttagagctgcggctctgaactccagctcccctccctgctgccccctccacagccctgcttgcacctggcatggattcctggaggctgagggccttcagtgcaaagctggggtcctgttcttctgccccttcccaaactagaagcttctctcctagactctcctctccctgagcctacctgagaaccagctcagtgtgttgccccctgaggaaggcagcatgtgagccaggcggttgttaatcccctgtgagtggacagcagaaacaagaagtttataggcttcttctcccatctggcccagcagtggccacaggaggtgatatcaaggcctgctctgtggactcccaaaggaaaaggcccacccacagggtgtgcatcgaccagggctacctgcatgagcccagtgccctcaaacttccttgctcatgacccatgataagatataacatttgccttaggagtccataaatggctgggcatggtggctcacacctgtaatcccagcactttgggaggccgaggagggtgggtcgcctgaggtcaggagttcgagaacagcctggccaacatggcgaaaacccatctctactaaaaatgcaaaaattagtggggcgtggcagcacgcacctataatcccagctacttgagaatcacttgaacctgggagtcggaggttgcggtgagctgagatcacaccactgcactccagcctgggcgacagaacaagactccatctccaaaaaaaaaaacaaacaaaaaagaaaaacaaaaagaggagtccataaatgcatgtataaaaggaaaatggaagtttcacaaaacgtgctccttttaatacaggtgattggccgggcacaatggctcacgcctataatcccagcactttgggaggctgagatgagaggatcacttgagcttaggaattcaggaccagcctggccaacatagtgagatcccatctgtattaaaaataataataataataataataagccaggtgtggtttccagctactcaggaggctgagaagagagtattagtcacttgagcccaggaggtagaggctgcagtgagccctgatcgtaccaccacactccagcttgagcaacagagcaagaccctatctcaaaaaaaaaaaaaaaagataaatacaagtgatatactgggagacctgatattttgtatctttcatgacttttacactggatctgtcccactgactggatccaggaccccctattaactttgctgacccctcaggtcccctccatcaggttttccctgtgcagttgtctctgagaggcccaaggccggatggccacacaggccaggctggggtcgtccatgccaagcagtcccatgggcctctcgcctcaccacaccttgcctgtttgctctgcaggccccagcgccttcacagaagccgtggcttacatccaggcccagtacgagagcaagaacaagtcagcccacaaagagatctacacccacgtcacctgcgccacggacaccaacaacatccagtttgtctttgatgctgtgacggacgtcatcatcgccaaaaacctgcggggctgtggactctactgagcccagccgccctgcccggcacccttgccctgcctggcctgccgccccccctcccctggaaccaggctccaccactctcagaccactctttgcacttgaggaagaagacctcagaggctggcaccaagggagggaggagggagcatcctccacccgcaccccccaacagaacttgtggtaacgcaggggcggggcggggctgctgagtgcatgctgcaaggccaggagactccacgctcacagcctctgtgtcatctctgagtgcttgatcgggaagctggggggacagggcagggcccagatgggcacaccctgcacctgatgactcactggaagcctcggagtgtcctcctgtcatcttgggtggtgcaggggcgcagatggccctgcagcagggtgctggcagggtggggtcataggagccatccttcagctttgcctggggtctctggtggagggcagttccgtcaacaaaagccagggtgggatcaggccaacttggtgtgggttggaggactcaggccttggcgatggcctccgtctccctgctccctcccctgggtctcagcccttccttctctgggtcatcctcccttgcctttgctctcccagagaactcccatccctgactcctccgagttctggaaatgcttcttgagactgatttatggctcagatagatggtggcgtggagcggggggagggagagatgggaggtgcggggaagggaggtggaagctcctgtgtcacctgggctggggcctcccgcccagtcctcgcaggccaaagggtgacccatttcttttttccagtcaccaggagctcggatggtcactctgaggtgtgaatagatatgtttttccttcagtccacactgaattcaactcaaaccagcaaaggcctttgggctggggattctgtggttgcagaggtctagagggggtggacttttgcagccagtgcctccgcctcaccgtcttggtgaagaaatcagcgagtttgttcacagccgttggtgtcttcccagcccctggggacagaggacagcagggggatggagctgacaccctggagtatttggacccaggccagcacaaacacacccccctgtccccaactctaaagggagagtcctaggactccttagaggaggcttcactgcggagatccctgagcagaagggggcggggtagcttctcccggtgacggtgacgcaggtctggctggccttgggcaaccaacacacctctcccactccaagatgcctccaggtggctgaggccaacgcccacacccaggccagtcgtgtgcttgtacagcaggctgtgcctggggacctagatgtgccatgggagggaggagggtacccactgacaggcctctgcctccctcctcaagccctctgttctccctgcccccactctggacactgcttagtccccagccaggcagggcccctgggtttccacttgcagcccccggactgccccagagccgggaagcaccagtgccaacagctctggacttgttggacccacaggcacagagctctgagtggtgcccaggagacccaggaaccttccctagtgccaaatgcctgcagggaccggtgcctggggagcctctggcagccggactgcaggagccaccccatcagcccaagtccacctctgttttgttcacctcggtcatgttttggaccttgcaccaggtgctgggacgtggcagaggacaggccctgggaaccaacagtgtcctaccatggacagccagggccagctaagctaagccatcccgcccaacacagaagacatggcagttatttctcagcagcaccacgctgggtgaggccagttgttccgcttactctgctccgaactgtaaccccaggctcagaagcagccggcaaaagggggatgctggccacgccccacctctaaggccatcaccctggaggtggaagtcactgggctggagggctctccatgtcccccagcagccgccctcagaacacagtggccagagcaccaggctgggtccaggcctccaatccaggccttccctgtccctagaactggggctggaggagtgggtgctcagcccttcctgccctccatccccagcctgcctttctcttcctttggatgctccatcctccttggtttcttgcactgctctcaatcctcccaccctagcctgggggtggtccttggtcctcaggggtatccggggagaaattctctccctgtgcatgacacctgtcatccatgtcgtaaccagcggctccatcttgtggggtggtgactgagggtgacaaatgagatttggctccgtcgtggatgtggatgtgggaggaatgttgcgagtgacacgtgtgggtttctaatccacagtggtcctgcgtgtgccctgaggggccatggtaacctctccgatggctcggatttagcaggccaagcagaaactgatttctacgaagagcgtctttgccaaactcatgaaaattgtgcctgccactttcatgcctatgggccagttttgtgacctgcgccgctgaccatcctaagaaccaggtcttggccttccctctgagcactgatagaggtccccaaggctctctggcctgaggagggtgtggggtctgcccagccccaagcagagagcacagtctgggcccctgaccaacagctttggcattctgggttccatggggaccctagagctcaggcacaagaacaacaccatacctgctgccaggacgcagctgtctcccaggccctccccacagcccagctcccactggcaggaactggacacatccctgccctccatggtctgcactggtcttctctgagtattcttaggagcagaggcagccccaagttccaacttgcaagccctgtaactaagctgtctataaaccccagcagggaaggccaagggatggtctcacccatgcccttccctttggccaacatgagtcctgcagtggggagcttagcccctgctcccacctaacactctacagttagcacccaggggttgattcaggaagttcttcctttttctagcctgcatccttcctggccaccccctttatttctcagtctgacctggtgcactcttggcaagtgagtccattgcagtcccaggtggatatttaatgagcactcggactgtttcctccaagtcagctagtggcctgccctcctccttttcaagaagtctggggcacagagcctcctctggctgcctcttctcttctctgagcctctgggagccttcaggcaaaacctggcagttctcaggaacccagacctgaggctccagctccgcggccaccagagattcagtgtgcagtgccgaaggcagtcacccccaggcagttcctgctgtcaggccgcaagcctagagcgcaggatcccagcagcccagggaacagggccggcgtgtgagctgctgccgtggggtctgtggtagggctccccatctcccacccctcagcaagaagagtcctgacccctgaccccaccctgcccagagaggagctggggcctccagacagaccccactgcagccagatgaaggcccctgtcaaagaaggggcaggctgggggaaaagcagaaagaatggcccccagtccaaactcctggatcccctccatgagagaggggctccccctggaacagaagctctcatccccaggcccagtgcacaagaccaccagcagagacccaccgcccttcctggcagagcaccacttcctggcagtgcagctccgaggcaccactactgtcctccccttccctccccacccctcccctccctttccctcctctcccctcccctccacacctgccctgttactcccacagctctgggcagccaggccctcccctcctgcctcctggtcttctctactccgctggttctgacccatcccctggctctgcccgccgtcccccaccctgcccctgctgagtatcttcttcctccccacgcacccccctcccccatctaggcgaggtgggctcgggcgtcccaggccctccttagaaaagccgtctctctcgagtgcagtggtcccacctcccaaccccatcactgctgcccaccccatattaactgtaattttgtaagaagagtgacttgttggtttaataaatctctagttattgtaataatttattggctgccataatgtatttattagtcgcctaccgttaataaaaagtgcccgctttcctagcgtgagtgtgatgtgttgtcagggcccagggagctcctgccaggtgcacttgcacgatgtgtgtcctcgggccctgccccatcctggtcccaggactgctggcagcctggcagagtgggcacactcctgctggggacagaggatcagggcgactgggcgccctgcccccctgtcaggatcgccatctggtgggaagttgctccgttctgcgccgagccaccttcctgtcctggagagcttggtggccacctggacactgctgtgggtgacgtggcagtggccatggttgcgctggcactgcttcctgctgctcctgggcctccactgcagcctggggcaggtggaggtctagggggttggctgtcagccatctatgatctctgacttctttctcttttctcaaatggtggtatctcttctttgaatgtaccccggcgtctgcttcctctggggagcttgtaaggatgagctgtgctctcagctccttggcaatgggttccaggcagcgtgccgagggagggcagtcaggcctggggggctggcaggggtctcagtgccggcgcctcccctgccctgcaggatctcccctcctcactgccctccccgagtctccaggatcagccgccttttggggctccctccaaggccctctccccataaaaccaggtttggttatgcctgtcctctgctccccaagtcctcccctgcactgccactcctgggaccacagactgtgatcatctttctccagctggactctgagctctcggagagcaggagcctgatgtggtcattcttacatcctcggggcagcccagcagagagccctgcacacagatgccaggcagtactgactggaggagcgagtgtggtgtgagtcgtgctctgtggccctgagatgtaggggctgtggcgggggctcagccttaaccagtggaactgtggagcctaaatgagccggacttgatttctcctccacacctaagctcagtggccaagggggcacagtccccactcccagctcaggtcactctagtggctgctcctggcagtgcctgggaagatgtgcagtggaggagggagcttggctctggctgtgggtttccagctctctgttaggcagctgcaggccaaggtggctctgtggagtggggagcatgttcctgtggaatccttggggtctcagagcctcaccactctggcctcataatgtggctcaatgagcttgagtgtggacagcccgaggccctggacacaggttcactgggcctcccagaagcctccggctgcccttttctgaacagatcccagtgaggtggctcagggcaagcgagacctgctcctccccggagggatcacacagatgacagggaaatgctcctggggaatcagaatgaaatttactgattgaggataggagagtgatgagatcatatgagtttactgaatctgtttagcagaatgaaagggcagtgccgtgtactacagctcctggggggtggggaataacgccatgccagctgtccaggtgcccctgagaggcagctgagaacgctgccctccgccgaccaacttcagctaataggaaccaggggctggggctggccgcctctacaggtcatggtagaatgatgtaggcacgggggagatactgaagggaggactggccgtaagacgcacggagcccgccatgctgctgttagtatcgattcctcgaaagccccacagcctgctgatatggactggagagacccattgcataagttctggatctggcccagctgtgtcaccgcggtgtcccctcaggccagatgaggttaagtgacatgggcagggagagcgctggcacagtgtgggcctcagtgactggtgtggtcacttcatcttcattgccctccttctgctcagaggggggcggtgtggcagtgggaccagcaattcctcagcacccacggtgtgctcacccctgggggaggaggtcatctccccgtagatgcccagtggcatctacaccagctgtcttctttttcttgttacttgtgtcactcttcttatttcagaggtagagtttagcctggttcacctctgggctttagatccagagagctgggtttacagtgagcaagttcccagggctaggacagggttcttggggaaaataagggaaactgtcccttcctcccactccctgtgcagaaatggattcgttcacagagaaagatgccctctgtgctgctgagagacagactctgcccaagtgaatgagctcagcgccccaaagcagagtttttgcccagggcaagaggctgcccccgttcggcatctgtggggcgcccatcacgttcatccatttgctaaacaggctcctgtgtgcagggcagccctccacatctgccttgcttagaacatcatgcagtgtcagatgcagctgagtaggacccagccagaggaggtgtggccagtcccccaggtgctcctggaggtggccctgccaggagcctctcccctgagtggtggcacccaggatgctggcaggacctggcatgccttcccctgagaccataggaagggcccggagtctctcaccactcccagagaacatccccctacccaggatgggcccaggaggagaggtctaggcaggaagggccaaagcccagctctccggctccggtccagactcccccaacgcccacacacacaggcacacacacaggcacgcacacacactcaagcacatggatgcacacaggcatgcacacacaggtgcacacacataggcacacatgcacacgaacacacacaggcacacataacaggtgcatgcacacacacacaggcacatgcacacagccacacacacgtgtgctgggagaccctcacatagctgggaactctgcagtggggagagcccgggtcaccctgtcctcagcctccccagagagccatggctggtgtccagtccagtctctgcctctggccccgacatgacgggttctccggaagcagggaatgagatgtgctgtgaggtgtaactgactcaggttccatctggcagcctctcggaggagctgccgagtagcccagtccctctctgtcaagcctaattctctccttctctttccctgtctctgtgtctccctcccgctgtctgtcctctctcctcccttcctgcggccgcagaaccgcatgcacgagtctctcatgctcttcgactccatctgtaacaacaagttcttcatcgatacctccatcattctcttcctcaacaagaaagatctctttggcgagaagatcaagaagtcacctttgaccatctgctttcctgaatacacaggtgggtgccaggcagtcctgtgcagggggaagcctgcccctgacagggacccatggctcagagaacaggctgctcggccagcactgctggggctagctggcgagcgggacccattgcaggagactggtggggcgcaaaagaaaaacagtgctgtgccaccaggtttgggcttcccaggacacagccctcagcgtggtggaaatggcccctcctaagatatatgtgttaggaccaagtgactcaggagtggtggggagcagggggcaggacaggatcacaggcttcccccttcctcctggtcaccctctagaagaggtctcaggacagcctcctgtaatctcagcagtggcctcccctcacccctgcccagagccccacagcacctttgcatgaaaccgaaaagtggacacgtggcctgtgaacagggcctggactgcctcttggccccacctgctttccctgctccctgctttggtgcccggaacatgcttcatctctgtgcagccgcccagccagaccactccacccatcccacatcgtgcctgccctccctccccaaccccagccccattgcgcctcctctctccccttcttccttcgtccctggtctttgccccaaatccaaccactccagctatctgcaagcctcctgtatcactgcctccctttcttctgccttctctggggctttcttcttgctctcaggggaatgtgtcacagaccttcccccccacccggctcaatgacgctctttccaaatggatggatgagggatggtggcttccgtggaatgggccaactctgggctactgctaatgcctaaaagcagcactgatgggatgccagagcccagccctggtccctctaggggctgggaagcttctaggggtccctggggtaggagttgcctttgcagactacagagtgcacagggccagcaccctgccatggaggaggaggtgtcctgtcatccgccaggtcagggcacaggttggctcggccaggaacccatgttctgacagccctggagtaaggctttgggcatgggctcagtctcagggccacacgggtccccaagctcagccacagggtgcctacatccagcataggtcgatgctggtctccccacccttccccacagctgggagcagtgtgtgaagaagggctgtcagcttgttctgagcacaaaccgtgtcctcactgatggtccgtgctaatgtgaatttgcaaggttcttgcccttcccaaggtgcagagcaggaggtggggccaggaactgtgccctgcactcgaggctctccagcaaagtcccaatagggcagagagcccaggtagcctctggagccagaccacctgcagctcagcaagttgctcagtcatctgtgcctcattctaatctggtcaacacaatgggtaatcatgcccaccccaagggtgactggaaggacagctgcttggtgccaggtctactgaagtgctggctgtggctgccattggtattattcagaggatggaaactaggggagggggaactggccacggagaaggtgccctctgcaggatggagtgagggcaggagggcacaggacaagccctgaaaggccagccccaggtggcccttgggcagagccaggctgtagcccactctggcagccactcctgacctctcccagccacaacgatggagtccagtaggccccctcaggccagggctaccctcagagacaggcccaaccctacggctctttcttgcccagtgtcccactggggcctgacttgggagtggccagtctcactgctgtggagtgcaagcactagatgccccagcgaagggcagttggaacctgagaaacaagttctccagggccttcagaggaatccagtttgaattcaggtatcatggatgacagatggtcaccagtgcagtggccccatggagtgcaaacctgtgagggcacaaaacaagcagcaggggtgggacgggaggtggccggctgtctaagggacgtgtgggccagcatggctgggtggcagcagggctgtgtgaggacgctgggctcggcagacacagcgaaggcacgaggcgctcctcccacctggacggcttcctgtggccaccttccaccctgggctgtgcccagttcggctctctccagacaggaagctcctgggcagggtccacacgggctgctttgtccaatccttaacagctgtgctgtgggcttggcatctctgcaccagtggatcaaggatgaggctttgcactgtgggtccaggcactcctgctgggctgcccagagctggtctcagccatgacaacccacccaaggctgtcccaaccccctgccccttgccccttgtacacccaaggaattggtggggacagagggcccccagttggcatcatacatgctgatgtccccttaaacttcccaccttggggacatcaatgccccaatgtcctggccactcgcttaagaaccacgcctactaatgatatgctgccagccctgccaagtggcctcttcttaaaggaaaccaatgaggaaggagtgcaggtccctctgagtgcccaccaccctcttgggcaggcccctctccagactttgttttcatggtttactggaatcagcaggattggtttagaccatggggcggtgcctcaatttgctcatctaggaagcaaaagcgttcatctgtggccactgctgtcccaggcggggcttccgggtggatctggtgtgaaaacagtaagagatcttgcaaagtccaaagccaggcaaatgctcagcctgtgtatggttggtgcaaaagtaattgcagtaattgcagttttgctatcaaaagtaatggcaaggccaggcgtggtggctcacgtctgtaatcccagcactttgggaggccgaggcaggtggatcacctgaggtcaggagttcgagaccaacctggccaacatggtgaaaccccgtctctactaaaaatacaaaaattagctgggcgtggtggcacgcgcctgtattaccagctactcaggaggctgaggcaggagaatcgcttgaacctgggaggcagaggttgcagtgagctgagatcgtgccattgcactccagcctgggcaataagagcaaaactctgtctcaaaaaaatagttctttaatttaaaatgcaactatggcttggaactgcccagcagttcctactgctcccttcctgtctcatcccacttcctgggacacgccacaacccacttcttgtcttcatgtccccagccctgtccacccacagcgctcatcagggcctctccccgttcttctgtgtcttgttacaggccccaatacctatgaagacgcagccgcctacatccaagcacaatttgaaagcaaaaaccgctcacccaacaaagaaatatattgtcacatgacttgtgccacagacacgaataacatccaggtggtgttcgacgccgtcaccgacatcatcattgccaacaacctccggggctgcggcttgtactgacctcttgtcctgtatagcaacctatttggtaatgattccagcacccacagaacagcttgcgtgcgcgcgcatacacacacacacacacacacacacacacaccactaacaaatgcaagttggtaaataaactttaaagaggcataacaaaaccttatatatatatatatatatacaaatatatatttaaaaaatctttttagtttgtactagaaagagctgcggacagaactgaccaccatcccatagctcatggaggttttcctgggacggcacgtgagcatgcacgtgtgtgtgtgtacacacactcacacatgtccagatgggagcttggtttgggagtccctccttttgaggatagccccggggtgttcctctcagccccatttctgagaacaggtgaatggcagaacagccctggccttggcccagccagctctctgtgttgcgcccttagagcctctgcgccctcagttccgtcctgctcttggcaaattccagaccctttcagaaatggccgaagccctaagcctctcctcactctgcactcccaaaaacagaacaatttaaggatgcttctctttcgggtggtggtggttgttaatttcaggaatttagaagaatcattgctccgaccaatccactgtctcctgagttttctttattcatgttaagatggcaagaatcagagaacagggagacttggtctgctttctaaaagcagctgacaggaggggactcaagttcacctgcagagttgaaaccagccccgctccaagagggcatgtgggaaggtggggagcgaggggaacaggcgtggcggggagggccggacttgtgggcctgacccgagtcagggtctcaggggggggccaggcttccccaggtgcccgggatgggcttcaatggggttcctgacccctcgtgctgctgccccatctcgcccaaccccagcagtagtcaaaatgttctagggttttttggttggttggttggtttttaaaatcaaagaaaatggtcagactggaccccttatctctctctctacagactgcttcacggactctttgctgttgacgttgatctcctggtagcatgaccttttggcctttgtaagacacacagcctttctgtatcaagcccctgtctaacctacgaccccagagtgactgacggctgtgtatttctgtagaatgctgtagaatccggttttagttgagtcttcacatttagaatttgaaaggaaaaacagaacatttctcatgtgctttgtagcttaaaaaaaggaaaactcaccatttcatccatatttctttttcttgcaaaacaaacatacccatctgcaccgacgcctgcccccgtcccacctcgcggcgcagcccctggagctcctgctggggggcagggcccatctgccgcctggggctccggtgcggtgcactggtccgaggagtgtgctcaggccgggctttccagaaggccacaggccactgcaaaccctgctgcctgccggccgcccagacaccacagacgccacctggcggccctaagccactcccgccacacgctcactccaggttcgtatagaaaaagcacagctctcactggccagtagctgccaaaaagaacacccatcgtataaggaaatccagccccatagaaaacaatctgcccaccgaccccctttctaaggatagcctttgtaggggttttttggttccttttttttttttttcagtttttgtttttacttttgtcccgccgagtactatgtattaccagccccccaccccacagatcagttttcctagtctttgggaaacgggttgtgttttttttcctttgccgtgttggatttccggtcccggctgacacctcccttcgtgtgtgcgcccctccccacccctgcctttgtttcggtgccctgtgtccgctctctcatgtggggatgtttgtgctgcagacaaaaagaacaaaaaaaaatttttaaataccacaagatggaaaaaaaaaacaaaaaaatttaaaaagatggaatgtagtgtttacattaaagccgccgttttcatgaccaatcctatgtcatttctactttgactaatacccaaaccctaaacctcttcacggtttcacttttaagacttaatctttgctgaagaagaccagtcacagccatttcaaataaa

SEQ ID NO: 36654 - DNA, 11185 bp, Homo sapiens
atctaccccaaatttctgaacaaaattaatattcagtattatatctagcctatagattctcttactcttggtgtaatgacagcattcccagtttaggaaactgttttaaaatcttgtgtcttggttgtggctgaggctttgggaaggccagagccccctttgccaccacccctagggtgtcagctccaagcctgggcctgagggtttgatggggagcgggtgagctggatcctgatcccagtggtcagtggccagatcctgggctgctggccagaaccctggctttgtgagtggctgcagcttggctctgctccagcccacaggggctaaaggggcgggtagggagtgtgtagggagcgtgtacgtggctttgtgtccttggctcctccagactctcacatgtgcgggcaccatatacttctgctgcccttgtgccccaatcattgcacaaacagaaacagctctgacagagaagggactgctagagttaggaaccctagggcctggaaggaaggtatggctctcagagtgacctggggtctattcagtcccctctggacctgtttccctggcaacgctgtgggaacaacagtctatgcaacacaggagacctgatgccactggtgtcctccaaattttaaggcgaaggcaggcattgtgaatgatgcagggatggccagaatggtttttgccttcgttctttccccaggggaaccaagcctgtgggtggggaaatcacactaaggctggacagtgactgaatctggcccaggagaaacttggctgcctgccttccagaccagggtttttcttccctgagatcctggaggggaagtacctggaacttgggagtgttgccctggtctggaagatctgatagacatagtatgcacacatttccctcgagcttcccatgactggggagtagatgagaaccctgagtgggtggctggtttcttgaggcatacatatacccgacacaccttacacctctgatttggctgcattttggaatcatctgggaagttttaaacaatactggtgcctaggtccaacctccagagactctgatttaattggtatggggtggggttttgcagttttcaaaccacaatatccagcaaagtttgagaaccactgccctacacagccctccttcttctttatcttatctggagtcaggggcaccttcagcttctccaatcacctggccagtggctcttgtttccagtcctgctgttccagggtggataggccttcaggcggagacccaggaatccagctccagactctgtcccaagcagcctcttcagtccgggacgggacaggaagtgtccggcggaggtgggggtggaggtgattggcagttggagtctccaatgggccaggagcccccctatttcactcctctccttccattggcgcctgggcggagccacccccgctgcgggggcccagggcgggagggagtagaggccggggcagagggcgagggcgagggcagagggcgctggcggcagcggccgcggaaggtgaggcctggtgtagacgccaaagtcttgtcaggagtgggcggggcagggtgatgtatgatctgaaaggccgggagtgactaacgactgtcagtgtgtatgtgcctgtgaggctgtgtctgtgtgacagtatcattgtgtgcgattctgagtgtcacttggtgcagctgtcagctaatgtgactgcgtgtgtcagtgtgcatggagctggaggtgcatgtggctgtgcaagtgtgggattatgtgtgtatctgtcaatgcacatttttggtgggactgggttgtgtgtttgtgtgagagggactgtgaccacatgagggaatgtgttttgggaaggtctctgtggggtttgagaccatgtctgccagcgtgagagtgggtggctggctttgtgtgtgccaatgtgtgacttcagcagtagcagagcaaaagtgaggtttgtgactatgtgtgtgtcctgggtcctaacttaaaccgtgtgggagtacagctgtattcatgtattgggggacctacctcaagagcccatgggactgacctttctcttaagtgtccagcattgacagacacacccacaacacacgtggcttcccctccttcctctgctcaagaatccccagcatcaggtctactgctccttattttctgtttccctgcttggctcagtttcccttacgtgccgttttctgtccctattgctgtcttactagagatacctctgtgtgtttcttcacagctttgttcccctggtctctctgtgtgggtgcatttccagttttgcctttcctttctctctgtctctctctgtgcccctatgcctgccttccctgctgatcttgatctctggctagttgggggcctgtaacagtgatgagatgcgggtctgccccggctaagagctccctgagagagggggcttagaccatgatgaagagttgcttttaggcggtgctgtgagccctggtaggggctgtgtgcgtgtgtgactgcgtgagtgtatgaatatgtgtaagtgtgtctgagtctgaggcggtgtggctgtgcccgtgtgactgtgagtgaccgcatgtgagagtgtatgagtctgagggtaactgtgggtcttgtgtatctggcaccaagggaccaaaggcatttcctggtgctggggcccaaagaatggagggggaggtgagaaatggctggaacttccaggggagggggaactggactctttggcctctccttatatcccccaacctggggcctcccttcccctggaagcacagccagctgtaccctaaggaaacatttggtgaggagtgaaaagagggggagtttgtatctgatttttcatttgattgtgtccacgtgtgttcaaaggcatgcccttttgttaactgtgcctcttgagtctgtgtgtgaatgtgactgtgtctggctgtgtgaaaacacagggcatctctcactgacagggacataagtattagccaccctcctttccctcttgctggccttggctgtgtctgtggcttcctttccagacttgggggaggcctcttcccttcccagggccttgggtgggagggaaggagggaggaggcaggagcagggagggggcctggctaggggcggcagagctccagggcttagagggggcggggcagggaaggggaaggaggggatggctctggggtcccagaactgagtggagtaggagacgggggctgtagctggtgagaggaagtcctagaggctatggacactctgctgctgggatcaccgaggtagggtggggctaagcagggtaagtgtggctgggtggccaggggtgagccaactggacacactcagacagacacacagacaggtggaggccctgctctgctctactcctactcctgaagggtccgtgctcttcctcttctggtcttgttcccagagccctttccccgcctgccccttcgttctccatccacttcaccactgccttcctccttctgctcccccttgtccagaatctctctctcctagcatcccccacctgccatatagacacactgttagctttttgagtttccgctgaccccaatccagtctttccaacacttcccacactgccccatcacctcctagtcctgatctctgagtatctcttggtgctgtggcccccatgcctgtccctgcaggctcccagttcctctcagcctctcatccccttccctcccctcccctccccgccaccctgtctccatttccatctgctggctcctcgcccacccccagcctctggcagcagccagggcatctggatctgcttaactacacagccccagcctgcaccctagccccatccagcttcacaaactggagaccaacgaagtgtcaagagccaggcccagctgagtggcccaagtagccagaccaaggagccaggttcaggcgagaagcctggcagccagggcaggggtgggcctcagggtgggagtgcaggatgggctcagatccatgatgacacccttcccccagggtgataaggtctgcctaggttaatcagaggcagtgataagccctggaccaggtgggggtaaataccagaattcccaacagctggactggaggggttaatgggagtggctgagctggtgccagtgcttggtgccaggggtgggcgccaagggcagtggagggggagttgctggcacagtctgttgcctccggcttttgttctgggccctaagcccaggactgagatggagggtgtgagggggtgtgtgtgtccgtgtgtgtgtgtgtgtgtgtgtgcgcgcgcacgcacatgcaaagcactgggtatacagtgggaaaggggacctcaggtcagttcccgcagtgatttctaacagccttaccccacttggtgcatcaatttttctcctaggaagcctcagttttggagaggaagagccaggctttagcctcccatctcaggggtcggggatttttgactctacctctccccacagatgagcagcagctgctcagggctgagcagggtcctggtggccgtggctacagccctggtgtctgcctcctccccctgcccccaggcctggggccccccaggtgagaagaaccctgctctacaacctcccaactctgacttgtgacttgccaccctcactgtggccccttcccatgcctaacttgtgacaccacccctgctcctgtcatccaacctgggtcctctctctaccctgttctctgacctctgtctccagattataacatgatgctttgatccagtgagccccccaccacccaggttttaacagtctgcttcttatctgtcattctcacaaagtggggaggggggtaaaggaagagccttacctcagaagtgccctccacaggggtccagtatgggcagccaggcaggtccgtgaagctgtgttgtcctggagtgactgccgggtaagtgccccacctgcctgttggtctgacactcatgaccctttcttgactctgcctagtcctcatgtcccgcccctcccatccttgcccgctctgtccgtaatcctcacctctctatctgtcctaaccgtctaactatccttattcaacagaaaattcaactggtatgttttgagcatctgccaagtgccaggtctattctaggctctgggatacagcagtgctaatgccaggcaaggtgcctgccttcaaagagcttacatcttagtggggaagacaataagcaaaggagaatcttgccagatagtaatacctgcagggcagaaaaaccaaagtgagggatgtcgaagaggacaactgagtggttactttttttttttttttttccgagagtctcactctgttgcccaggctggagtgcagtggtgcaatctgggctcactgcaacctctgcctcctgggttcaagcaattctcctgcctcagcctcccaagtagctgggattacaggtatgcgccaccaggcccggctaatttttttttgtatttttagtagagacggggttttaccatgttggtcaggctttgaactcctgacttcaagtaatccacccacctcagcctcccaaagtgctagattacaggcgtgagccaccgtgcctggcccgtggttaccttttaattggtagttaggaaaggtctctctgaggagatggtgttgaagctgatttctgaaggtcaggaaggaggcagccatgcacacattaaggtataagcgctcgtgacagagggagcagctagtgcaaaatgtcctgaggtgggaatgagctcaatacccccgaggaatagaaagaagaccaatgtagctggagttttcagtgggtgagggggagagagataggagctgaagaaggaaaggaaggcaagggctggctcacaaggggctttgaaagccagtaaaaggaatttgggttctattgcaaatgcagttagaagccaatggagagctgtggcatggtctgacttatgcttgacatcttgtctttgtccattgtcacctcatctcacttccagggacccagtgtcctggtttcgggatggggagccaaagctgctccagggacctgactctgggctagggcatgaactggtcctggcccaggcagacagcactgatgagggcacctacatctgccagaccctggatggtgcacttgggggcacagtgaccctgcagctgggctgtgagttggggagggtggcactgatgacacatagggatcctgagggagtatgggacctaagtaagccctctgggaccaggaggacctgaggactgctcagtctccaggtgtaccctctgcctctagaccctccagcccgccctgttgtctcctgccaagcagccgactatgagaacttctcttgcacttggagtcccagccagatcagcggtttacccacccgctacctcacctcctacaggtgtgtgtgtgattgggtgtggatgcctacacatttgggtatgctggtgcaatgtgggtgtgggaggcagggaggtaggttctgaggaaagcctcagagagggcagaaggccctcttttccttcctgacttcagatggccccctccccaccaggaagaagacagtcctaggagctgatagccagaggtaggacgtgagggagcatgtgggggctccagctgggtcccacagtaggcattttcaaagccaaagaccacatcctcccttctaggaggagtccatccacagggccctggccatgcccacaggatcccctaggggctgcccgctgtgttgtccacggggctgagttctggagccagtaccggattaatgtgactgaggtgaacccactgggtgccagcacacgcctgctggatgtgagcttgcagagcatctgtgagtacccaccccagacctcccccagacccccatcacagagaccccaaatggactcagatctctccactcccagagttcccagtttcctcccaacctagactccatttcacacagagaaggccctgtggagcctgagaaggcaaagggatcagagcccaggaggcatggttatttcagcacacactctagaggctgctgctgctacccacactgcctgattggctgcctagcctcagagcaggccctgtaccgaatgcagccatatgtcatgtcctcccttgctggcccctccttccttgacctgtgcatgggagtgggacactaaaactctagctggaatttgggccaattcatcttccttggatgaaaataggaattgctcttttattcactcaagaagcacttcaaaagtccacccgcagatctcaggtggtttctttttttctttctcttcctttttttgttgagatagggtctcactttgtgcccaggctggatgaagttcagtggtgtgatcttggctcactgaagcctgcaactcctgggctcaagctatcccctcacctcagcctcccaagtagctgggattacaggcatgtgccaccatgtctggttaatttttaaaattttttgtagagacagggttttgctacgttgcccacgctggtctcaaactcgtggcatcaagtgatcctcccgcctcagtcttccagagtgctgagattacaggcatgagccaccacacgcggcctcagcccatttcataatacagatgaccggtctgagtctaatggatgatcaagtttaagatttcccctcccctctcaggagtgtctggctaaggctcctttaaacacacactttgggaagtggtggggaagtgatggagacccatagcctaccctgactttgtgtcttgatgcccttagtgcgccctgacccaccccagggcctgcgggtagagtcagtaccaggttacccccgacgcctgcgagccagctggacataccctgcctcctggccgtgccagccccacttcctgctcaagttccgtttgcagtaccgtccggcgcagcatccagcctggtccacggtgaggcctggagtgcgtcccaacccacggctgtgggtcctgtctctgatttcacgatcctgggtgttctgtatagctttccagtgctggcaggtcactgaagacccaacacttccctgtgggccaggctttgtactgggtgctgggttgcagtggtgactgagagactgaatgtctgtcctgtggggctataactatgaggtaaagcacatctgtgggaagatagcaatggcttttaaaaaaataactttttttttttgagagggagtctcgctctgtcacctaggctggagtgcagtggtgcaatctcggctaactgcaacctccacctcctgggttcaagcaattcttctgtctcagcctcccgagtagctgggactacaggtgcccgccgccatgcctggctaatttttgtatttttagtagagatggggtttcaccatattgcccaggctggtctcgaactcatgacctcacgatctgcccacctcggcctcccaaagtgctgggattacaggtgtgagccacggcgcccggcctaaaaataactcttaggaaaaggagtgcctttcacctagaggcacattctcctacaaacactcatatacccagctgaggatagcagtgaatttgtgtctcaggagatgttaaagattggctggtatcaggactagggagcagcagcatcagataataactaatatttacttagtgctgcctgcctgtggggtacctggctacactttttgcatacattgttttgtttaggtagattcacctctattttacaaatgaagaaactgagtcacagagaggcccaaagggtcattcaatatgtggttcaccaaagatttgaacccaggctgcctgatgccacagcctctctaagtaatcactactgccgtcttacaaacactaggtgtagactcagctccaccagacacccaacatgagacctagacagctccactaggctttaggatgagactgggagcaaggggtgctctttgtagatggtggctgggaaggccctgcacttacaagctgggtaacagtgagtcatgtttacccccaggtggagccagctggactggaggaggtgatcacagatgctgtggctgggctgccccatgctgtacgagtcagtgcccgggactttctagatgctggcacctggagcacctggagcccggaggcctggggaactccgagcactggtgagagacaaagccaaagaaaagggcagaggccccatcccaaagcatctatcagctgaaccagttccaaaagacaggcaggtggcacatgccctgcccacacaggcacggcaattgctgtcccagacttcagacttgtttgcctacagccctgtcttagcttaagtcctgccccttggcctccacccctgcagttacaggctccacttctacaagcttggagcttgccatgctccctaggagctggccatgccctatcaggctcctcctcctaggtaccttgacttccaacctaggccttggccttgagcacaggacgtgacccccgtccccaccagcgtatggacacttattgggtcttgccttcctttagggaccataccaaaggagataccagcatggggccagctacacacgcagccagaggtggagcctcaggtggacagccctgctcctccaaggccctccctccaaccacaccctcggctacttggtgagcttgggcagatgggcaagacttgtaaaggactgaaaaccccagagaaaaggggacaccgagcttggtcaggcttgctctcagtgacatgtggccctccccctcagatcacagggactctgtggagcaggtagctgtgctggcgtctttgggaatcctttctttcctgggactggtggctggggccctggcactggggctctggtaagtgactgccattggtccctcagcctctgatcctcacacatgctctgatgcccatagaccacattcatctccacccttcatgactgcccgctgaacctgtctgattctggaactacctccccatacctccatcccccatgccccacttgattttaactgattcctctcctgaccctttactaataaaccctttggcggagactgagataacccacattgttggagagacagctgcctttctatgccccaggctgaggctgagacggggtgggaaggatggatccccaaagcctgggttcttggcctcagtgattccagtggacaggcgtccaggtgagtaggacatccagaagatttggacttggagatgtttgcccctattttgagtgtccagattaagagctggctgccctagtcattttaaaacatgctgggaatccaagttgggtctcctcattttaatgatgtctaggctgagggctgggcctttcattcttgagtccctgggctcagaagtgggtctctttccctcctctcagggtactgaggaaggaccccaggtggacttcccttcagggtattagtattagtactaatactcttccagggtattagactcagagctggatattcatccttttttttcaaggtgtcttggatcagtgctaggtcccctccttcattcttaatgtgcctgggcccagagctaggtccactcccgtatcttcagtgtgttgaagaggctccctcagagctgggctcctctactcatcttcagagtgttaagcttagaactgagtcacctccctcattctcagggtgtctgggccaagatccggtcttactgtctctcctgatttgcctcctgcttcttctaggagctccaaacctgtagaggacccaggagggcttcggcagattccacctataattctgtcttgctggtgtggatagaaaccaggcaggacagtagatccctatggttggatctcagctggaagttctgtttggagcccatttctgtgagaccctgtatttcaaatttgcagctgaaaggtgcttgtacctctgatttcaccccagagttggagttctgctcaaggaacgtgtgtaatgtgtacatctgtgtccatgtgtgaccatgtgtctgtgaggcagggaacatgtattctctgcatgcatgtatgtaggtgcctggggagtgtgtgtgggtccttggctcttggcctttccccttgcaggggttgtgcaggtgtgaataaagagaataaggaagttcttgg

SEQ ID NO: 36655 - DNA, 28307 bp, Homo sapiens
cccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttgtgagtggctcctggccggggaagggacggggtgggctgagccgtgcgctctctcgggcgcccagcacagctgtcggacgggatccgctagctgcgcaggttctgggagcatcggggcagcaggcgcagggcggggactaagccagggaagtcccctcccacctccggtcctttgtgcccttctagaccaacagaatgaggggaacagtctacaggactatggaggaaaaactgggttcccaactggggtcagatgtaggcagcggggcagggggggacggctcttggttcgctggtcccaaagctgcgcgcggggcccacttgacgcgcgcagcgccaccgaagctcccgccgcgctttgcgcggttgggtagaagtgcgcagcttttacaagggagaaggtttcgttaaaaaagaaaaaaaaatcagcaagagaaacattagtattaccaaccgagatttggagatgagagggagctgaatccggtttattttcttctggccttttaaagtttctggcgagggaacgtatttgcgaccaattcgatctggaaatgaggccatcgtttgcttggccgcagtccttctgccccgtgtgcggggtgggggtggaggagatggggggtggggggtggggggtggcggcgagagcgatccgcgcgcctcgactgaccttgggcaggcccggggcctctgcacctgcggtcggtcccgccttgcacgcacggtctctgcctgaggctgcaggaaagcgcttcctactgagaactcctgataagcgctcacggtgtcgcgaagccgaagtgacctccctcagcctcaactccccgggggccgctggccttcacctgggaggggtgtgccctgtatgtcctgtgggtgcggtccgtcaccgcctgagggacaccttttccggcaccccaccctcagaagtgtcagcgtggagagttgggcgggaaagaaaatgtcggagcctggctgtttaaaaattggaccccaggttgttattgcctgattggagggggagggtgtgaataccaaagggagcaggtcagttcatccaaagagggcttgcgggcagaggctaagagggctgcggcggcctgggagcagggctaccattgaacttagggtgaaagtccagtcgaacccaaacctgggtggaaccggtgacttgaaatcctagggataggcggaatcaaagcagttacatttagaagaaaccctggacgccaatgaacgcagccccaccgtttacagagagccagccccccgctggcctccttttagaagttcagcatacaagaaggagtgcccctgagagtaggaacagtccagttagacggggcgatctgatctgcgggaaaggtgaccggagactcccacccaacccgccaatgctgcagaaattacaggggcgtgggaaaccttggaaccatctactactggcagcttgctcttccagcgtggctttgtggcctgccggtagcggggcttccagaagaaacaactccccctcgcccagaacgcttctctcagctgacttagaaagtcacttctccacctcacccctgttccccacctcccttcctcacttcccaggagacccgcaatgcatagtcatctccaggcatcttccacatgctctagattaggggtgggctcgcaggtgcctgggagagaagaggagaaagctgaccccaagcctctcagttctcctctgcatggactgtaaatacgaagctgtatatatttgatgtgtggaaggagtggagaattaaagggcctgagaaggcgctggccaccccgggagagtttttgtttttgtttttgtttttgcttttgagacggagtctcgctctgtcgcccaggctggagtgcagtggcgcgatcttggctcactgcaggctccgcctcccgggttcacgccattctcctgcctcagcctcccagctactcgagaggtttttttaattatggaatattacaactcgacaacaaaaagacaacccaattagaaaatggacaatggacttgaacagaggtttctacaaagaagatacacaaatggccaatatgcacataaaaagatgcttaacatcatcaggcattaggaaaactaaattgaaaccacaatgaggccagttgcggtgactcacgcctgtaatcccagcactttgggaggctgaggtgggtggatcacctgaggtcaggagttcgagaccagactgaccaacatggtgaaaccccatctctactaaaaatacaaaaaaaaaaaaaaaaaaaaaaaacccggcttgggtggctcatgcctgtagtcccagctactcagcaggctaaggcatgagcatcgcttgaacctgggaggcagaggttgcagtaagccgagatcatgccgctgcactccagcctgggcaacagagtgagactcggtctcaaaaaaataaattaataagtaaataaattaaataaatagaaagaaagaaatcacaatgagataccacttcacacccattaggatggctactatccaaaaaacggaaaacatcaagtattggatgtggagaaattggaacccttggtatgccactggcgggaatgtgaaatggttcagccactgtggaaaacagtttggtgttccctcaaaaaattaccctctgacccagcaattccactcctgggtatataaccaaaggattccaagcagggactttagtattggcacatgcatgttcatagcagcagtcttcacaataacacacagcccagtggccatcagcaatgaactgaataacaaagtgcgacatatccaaacaatggatactacctgaccatagaaaggaatgaagtactgatacgtgctacaaagttgataaaccttgaaaactctatgctaagcaaaagacacaaggcacaaaatgtcatatagtgtatgattccgtttatataaaatactggaatagataaatccatagagacagaacacaaaccctggtggtttgccagggaccaaggggagcaattgtttaatcgctatgtggtttctttttgggggtaatgaaaatgctttggaattagattgagttggtgggtgcacaacaccatgaatgtactaaatgccactgaactgtcaacttaaaatgattggtttgatgatatgtgaatttcacctcaagtttaaaaaacaaaaaatagaaatatttcaaatgccacagaagaacatatacaatactttaacagacacctacataattattgcccaactttgtcaaatcttaatattttgccttgtttgctgttatgtattaaggaaatgaagctttcagatggcatctaagcctcctagacatccttctgttatcttattctctctctccctccgtcctcagggccacctgtaggctgaatgtggtgttcacttccaagcacaggttagacttttactgcacacatatgaactacacatggcattgttttacatgttttcgcactttatgaaaatgccagcatacagtacgtatccttctgcaacatgctttccaggcaacattatgttctgagatttatacatgttgactttgtttacccagtcttctgttaatagacactttggatagttccaatttgctgcctttagctattgcagacagcattgctaagaacattctcatatttgcctctgtagttacctgttggaaatgtctcccagagacacttggaggatgtgacttgttgggtcacaggggatatgcacattgtcattttcccaggtgttatcacattgccgtccaaaagagtaattccaatttacacaccccaggagcagatttactgggaagctgatgtttaattaagttcaagacccctacttactcaagccccttccaagactctgcctaattttgtattctcttataaagatggtcctcctgattgtttaagcttcaggctaaacctggaccttccccggcccctaccagcagcacatgaaagtcgccattgttcctcatcacttggtagcgtcagactttataattttctgctagtccaatgggtgtgaaatgcttgattattttttaaatctgtagtccactgagttgttgatgactcatagttcagattcccatgcctgacctcccaacagcctgggaggcgcagatgtccaagctgatccgggtggagcgccacttccatggtgaggggactgcccactggagcaagtgagggtggcagctcagggtggggcatagcaacctctccttggcccagcacccctatcccagacctcctgacctctgaaagctgcagagtcctcacaggaagaggaaggcaggcccaactaggaagtgagactgcctttccaaatacctccagagccacagaggctgtgcccctattgcaggtggtgtggtcatcagtgcagccccatataggccaagggtgaaatagccaatgctctcccctcctccaacaaaacccagggctttgcttctcgtctgctcccctgcaaaagtcccacccagtgaggaacttttccttttggagccactctctgtctctgtctccgtctccattctaagccagggacttccttgacactgggccaccattcagggaatgaaaggttcacagggaaggctttctgtctcagctggggcccccagatgcgaggtctcccacagagtgccaggagagaccccctacccattcaggacttgtgaaggaagtgcctgaagagggttgtgagatcatctactcagccccctcctccccaggccacaaaggaggcagggttgtgagtgagggtgtgaggaatgccgcccagccctccaggggcatgcccttcctcctctgtgcctcagaaacacgaacagaagtgcagtcacatcacgggttggggttggggtggggagacacccgcaatcagtttgcagttttgacagttacagtgaactggacagagtaatgactaaaatgacaccttttctgtgacccaaagtgactggactgttattaagagtgaccagagaggtctggggacttctgctagatttctacctggctggggaatagccagcccgacagagccgggactgggccatgggccagcgaggcagtttcgcattaggtggtccaagctgtggctgcactgagaaggtggcatgggaactcctaggagaccagagacgtagaatgacagaaacctcactttcagagctggcagggaactgaggctcagacagggagcaacttgcctgggtcaccgggtctccagggtccagtgagcacttctggcagtgagcagatcatgcccaggcttctcctttcacctaatcagccacacgagattttgcttgcactagaaggcacactgggatcctgagtaggcagccctgcccacctggcagctctgggcaaggcttggtcccttctctcccccaacaggaatgaagggacagctcaggaccactgggaagctcacacctcctctgggtctccttgtcaaaaacacaccctgcaggttctgagtcacgaggtccagggcaggttgaagaacccgcattgcactgcacaccctccactgactggctgagacttggagcggacatctcgaggccaggccaccctcttgatatttttatgggggatagaatagtgggaacagttctcagggagaggctggggcaagcagccaggtgctctgaggttctcacaagtcagaccagggacctcctctgttctggagaaagttccctgctgtgctagctaggagcctctcctacaggcaccagggagtggggcaggccccgcttggccagaatgggatggtggctgagttggccttctctgactgtgtccactggctcctggctctgtcccttctctgtagctatttagagagggctactgcctgatcttccgtgttttctcctctcttcctctctaaagggaggagaagtgttctagacagagatttcacaggggtttggtggagaagtgacttttctggtttttcaagaccagaggctggctttggtgaggactcagtaactttgagctgctccctggaaactgctaagtgtgatgatggggctcatctccacaggattgtcagacatgtgtcatcacacctgagctatattttaaaagattgccttttagcttttcataagtcactcccccacctcacagggatggggcaatgccagaactggtgcaaaggcaccctttctgtcccagtgctttcagaagtgagtaggaagccccacgatgctgctgccagcagcgctcacactcaggtcggccagggacaagggctgaattttgcacctatactcgccacaccagcaggcgaggggcagagcatattgtgctgccagcacagactagctctgcacagccttagcagtggcttggctttgtcctgggcccagacacattctccagagaaggggctgggagtagggactggaccacctgggacctgccttgacacaggacagagccagccagacttgaactagaaggggctgggggctgacttaagccactccagggcttcctcctggcccctccagtgtcagtgccggacatggtgctttggaccagcaggcctcagggacaggtgctgataggacaccccagagggtgtaccctcctggtgttgatgggtgtgaggacagtgggggactgtgccccttgtccttgaagcaggaacgttctggggtgtgtggccagctccttctcacagctttcagattgttcccaagggcatggagcatggagcaggtccctcgtggtctctcatcaatttggaaggctccaaattgcctttgacaccctggtgaaaggtttgatacccagtgagctcctagctgggcatgagcagtgtagccatttcccttcttggggtcatgaacgtgccacactctgcttctctgcagcacttctccccaggctctctgccgctgctacctcattcacagctagtgttctatgccaggattgggtgaatcattttaatgtacccgggccctgggtcctgcaaaacatatgtaggaaatcaaaggaaagcctgtcaccagccacagcacctccgcagcgggaagagaaggtgcagggtcgcacagccagcctcactgacctgcagttcctggccacagcctccagtccctgtgagaatgcagtgggctgggaggggaggggctggaagggcagggggaggagacagaaagtgaaggtcccagaaccaacttggagggaggcccacggggggcccgggaggtgggcactccaggaatagggccacggggaaggacagaagatgacgttccctgacctgtcagtggagtggggcgggtggggtctgcatggcagcccctccctcttcttcagactgaactacaggcctgcatctgccgaagagggagcgggatcctttggcatttcatcttgtgctgtatgtgtcttaaacacaaaccttgctattgttttcctctgaagaaacagaggatattgagactcattgtttcagtggcgggccagggagggagaagccggctgggagtggcctaaagactaagtggttattcgccacttagttaacatggaggaggctccatgttaacgcgcctgtaatcctggcactctgggaggtcaaggtgagaggatcacttgaggtcaggagtttgagatcagcctgggcaacatagcaagaccccatttctacaaaaaatgtaaacaattagccaactatgatggcttgcacccatagtcccagctactcaggaggctgggatgggaggattgcttgagcctggaggtcaaggctgtagtgagctgtgatcgcatcactgccctccagtgtgggtgacagagtgagaacctgtcatcaaaacaaaaatctcatggccatttccaaagctgaccctagacacaagaggtaactgtcacacccatgggggcctggatctgggcctcagccagctcatcaaaggagcacccggcagctgtgggaacgtgggcaggtaactgtgcctcagtttctgcatcagtaaaatttggacatagcagcacctgcctcacatagctactgccccatagctatcaagtgctgttattattagttgactaataatttaagcatctgctctgaaaccaactggccgacctgtgccgatggcagggtccgcaaggcccgcccccatcacctttgccataggtgccctctgttccattctcaggcaggtgctgcatgaggattgggattgggccaggctgtggagggcacacttgacttttccctggagtcaccgagtcctgcacagacaccaccttcctggggccttcccagtggctctcctctcaccaagaaggaacaactgagggcagaggtcagtgtgtcctcagctaagagcttgatggagcagccaaggggtggaggacagtgtggcagccccagcctgccttctgcccagggagcaggctgctttctaagcctctctgcatcaccctgccagcctggtgccaagatgggcaggcagagctttgtggattctgagtgtgacacatagctacatctgcccgcaggcgtaggaatgaattatcagcaggctcagattaaagctttcaaaagcgatttgtcatcagtgtcagtgtgtcggctgtatgcaagggcatcagttcagggagggggcagcctctggcaaaaacctgtgccctcacctcccccagcctccatcctggcccccagctgcttggcaggagggcatagttggattgaggggcctggcaggaaaggaaccgccgagcttatgggtctcaggactatttctaaaaccagccacagacctccttcatctccatctgtggtcaggttgggggcagcagtgggaatgcttctttgttggaggtgaccctttaggcccgagctaacccatcccctccaccgggaagcccacccttctagcaccctttcctggcactcagagcacatcctgcagacctttgcttattgtctgtctcgtgcctacaccctaagtctgcccacatccctggcacagatcaagaactctgaaacatttgttctcagcaagcatcggtagggaaggggctcgggtctcctctctcacctacctaacactgatgaatcataagatgagtccttgacctcaaaggcggacagagggtgaaactgacaaaggctgccagtccccaagagactctgggagttccatctcccttggaccctcccagaccctgggcgggcagccttctgtcgcctctggcaggtgtacacctgttttgttggtttgttcacattactaacctacctggtgactcccataaatcccttttgtttttcttgcatttaagccactcctgtctggtccagcatttccacggattttgccttttacaggtggcttacccagtattttcacagaacctcttggtttctgtttatcctgctgggtaaggccagcaggtgtagatgtggtaggcagaattttccattcaaatgaagacatgcctatcagaaagcccctagatttgtggatctgagaggagtttttgtgcattcaggaactagtgaccatcctctagctcatgagggaggtgggtgttaagtcagcagtcactttgtcctgctggcagcgtgtgctatgggagaggcttccctggggctcaaggggggtgagattgcaagcctgaacagggggctcttcccagtccaacttgccttgttaatataaactatggccctccactcagctcttagattttttttttttttttttttgagacagagtcttgctctgtcgcccaggctggagtgcagtggcatgatctcggctcactgcaacctctgcctcctgggctcacgccattctcctgcctcagcctcctgagtagctgggactacaggcgcccaccaccacacccggctaattttttgtatttttagtagagacggggtttcaccgtgttagccaggatagtctcaatctcctgacctcgtgatccgctcacctcagcctccccaagtgctgggattacaggcgtgagccaccgtgcccagcaacagctcttcgatcttttaatcccaaatctctatccccttcttcacaaactgatccaaacccgctgagtcctgctcttgccttcagattagataaggaacactgtctaaggctagctgggggtgatgatggcatgaggggtccctctgggaggaagaagcctgctaatgaagaggccaggaggggagagtgactggtgtaggtaaaccaagtcaggtcccagccccgctcccagggttctctttggtagcagtcccaggggtcagactcccaataatctgccttttcagttgatgcagggagagggtcaccacccagagaatctcggacccctcccccgatctctcctcatgggctcaggtggggatcttgtgccaactaccgggctctgtacctgtcctgtgtgacgtttggtatctggtcaccattgctcagacactgacactttcaccaggcctgaatccacccttggtggacccagaactgctccagtggggactgtggcaagactgcatgagagaggagaggaagggagagatgggctacgttcattaaagtgtgtctttgaatgagatccatttccctgggtgtgcctgccttagtgttgaccatgccactgtcagcatctgttaaatgcgtgagtgaatgaatgaatgaatgaccaagtgagtgagtcagtgagtgagtaagagagtgagtgactgagtgactaactgagtgactgagtgagtgagtgactgagtgagtgaccaagtgagtgagtgagtggctgagtgagtgaccgagtgagtgactgagtgagtgagtgactgagtgagtgactgagtgactgagtgtgtgagtgagtgacttagtgactgagtgagtgactgaatgggtgagtgagtgagtgagtgactgagtgactgagtgagtaactgagtgggtgagtgagtgactgagtgagtgactgagtgactgagtaggtgagtgactgagtgagtgactgagtgactgagtgaccgagtgagtgagtgactgagtgagtgaatgagtgactgagttactgagtgagtgaatgagtgactgagtgggtgagtgagtgactgagtgggtgagtgactgagtgggtgagtgaatgagtgagtgagtgggtgagtgagtgactgagtgggtgagtgagtgagtgagtgactgagtgagtaactgagtgggtgagtgagtgactgagtgagtgactgagtgactgagtaggtgagtgactgagtgactgagtgaccaagtgagtgagtgactgagtgagtgaatgagtgactgagtgggtgagtgagtgactgactgggtgaatgactgatgggtgagtgaatgagtgagtgagtggctgagtgagtgactgagtgggtgagtgagtgactgagtgagtgagtgactgagtgattgactgagtgagtgagtgactgagtgagtgactgagtgggtgagtgagtgactgagtgactgagtgagtgactgagtgactaactgagtgactgagtgactgagtgagtgactgagtgactgagtgagtgagtgagtgagcaagcgagtgagtgactgagtgagtgagtgagtgactgagtgagtgagtgactgagtgactgagtgagtgagtgggtgagtaacagagtgagtgagtgactaagtaagtgagtgagtgagcaagcgagtgagtgagtgactgactgagtgactgagtgagtgagtgagtgggtgagtgagtgactgagtgagtgactgagtcagtgagtgactgagtgggtgagtgagtgactgagtgagtgactgagtgagtgactgagtgactgtgtgagtgactaagtgagtgagtgagtgactcagtgagtgagtgactgagtgactgagtgtgtgagtgactgactgagtgagtgagagactgagtgaccgagtgggtgagtgagtgacttggtgagtgagtgactgagtgagtgagtgagtaactgagtgagtgagtgactgagtgagtgagtgagtgactgagtgagtgactgagtggatgagtgagtgactgagtgactgtgtgagtgactgagtgagtgagtgagtgactcagtgagtgagtgactgagtgattgagtgtgtgagtgactgactgagtgagtgagagactgagtgaccgagtgggtgagtgacttgatgagtgagtgactgagtggatgagtgagtgactgagtgactgtgtgagttactgagtgagtgagtgagtgactcagtgagtgagtgactgagtgactgagtgtgtgagtgactgactgagtgagtgagagactgagtgaccgagtgggtgagtgagtgacttggtgagtgagtgactgagtgagtgagtgactgagtgagtgagtaactgagtgagtgagtggctaagtgagtgagtgactaagtgagtgagtgagtgagcaagtgagtgagtgactgaatgagtgactgagtgactgagtgagtgactgagtgagtgactgagtgggtgagtgagtgactgagtgagtgagtgagtgactgagtgagtgagtgggtgagtgagtgactgagtgagtgactgagtgactgagtgagtgagtgagtgactgagtgactgagtgagtgactgagtgactgagtgggtgagtgactgagtgagtgagtgagtgactgagtgactgagtgagtgagtgactgtgtgactgagtgagtgactgactgagtgagtgactgagtgactgagtgggtgagtgactgactgagtaagagactgagtgagtaagtgactgactgactgagtgagtgactgagtgagtgagcaagtgagtgagtgactgagtgagtgaccgagtgactgagtgagtgagtgagcaagtgagtgaatgaccgagtgactgagtgagtgactgagtgggtgagtgagtgactgagtgggtgagtgagtgactaagtgagtgactgagtaggtgagtgagtgaccgagtgactgagtgagcaagtgagtgagtgactgagtgagtgaccgagtgactgagtgagtgactgagtgggtgagtcagtgactgagtgagtgagtgactgagtgactgagtgggtgagtgagtgagtgagtgactgattgagtgactgagtgagtgagtgagtaagtgtctgagtgactgagtgagtgagtgagtgagtgagtgactgagtgactgaatgggtgagtgagtgacttggtgagtgagtgagtgactgagtgagtgactgagtgagtgagtgagtgagtgactgagtgactgagtgagtaagtgtctgagtgactgagtgggtgagtgactgagtgagtgactgagtgactgagtgggtgagtgagtgagtgagtgactgagtgagtgagtgagtgagtgactgactgactgactgagtaactgagtgagtgagtgagtgagtgagtgactgagtgaatgggtgagtgagtgagtgactgagtgactgagtgagtgagtgagtgagtgagtgggtgagtgagtgagtaagtgactgagtgactgagtgggtgagtgactgagtgagtgactgagtgactgagtgggtgagtgagtgacttggtaagtgagtgactgagtgagtcagtgactgagtgggtgggtgagtgactgagtgagtgagtgacagtgggtgagtgagtgactgagtgagtgactgagtgaggactgagtgagtgaggactgagtgagtgactgagtgagtgactgagtgactgagtgaggactgagtgagtgactgagtgagtgagtgggtgagtgagcgagtgagtgactgagtgagtgagggaagcttccctctggcttgctgggactgagttccttcgtaccaggaggtaggtagggctaacacaaataaagaagccaaacggtgttactccttgcctctcagaactggaacagagtcccctatcctccctctcagatgcattttcttaggggaagagccgcaggactttgcggaagccttcagcatttaggggtcttgggtcttcccctgacctcctgctctgtgcatattcattctcctaccacctggtgctcggtgccctcttaacttcatccgggcatcaaagcctgttgtgccatttacttgctctacagtagctcatccttaacccagctctacctacctacacacacacacacacacacgtgcattcacatgcacacacatgcatgcacgtgcacacacatatacacaggcatacacaggcacatgcacacatacatatacacatgcatatgcggcaccatacacatacatacacatgcacagacatacacacatacatacatgaatacacacctgcacgcaaacacatacacatgcatacagagaagtacacacatgtgcatacatacacatacttataggcacatgcatgcacatatacacaagcatacatgtacacacacacacacatacacatacatacgcacagaaaaatgcttcctaccctctatctcactcttagaatgattagctttaaatcaatcaacccatagagctgggcaaagcctgctgagcctctcctgaaccacacagttgtttttctggtcagatgacctacacaaaatgtcctcctggcattgaaataacccttggctgctaagacgactcagtgagtgaatagattgccagaaacatgagtggggggtgctcctcctggtggccttgggaaagcacagaagggctgggagcttcccgcagtcctcccagcagacggggatgagtccacatgcctccctcgtctggcggggacatctcttcttttcctttctggggagatgatttttgccacttgacctaagtggcaggggagctcaacaatggtgcacagcctctgttctgtggctggtttcctttacacctcaagaattcaaggcacaaactgttgttcacatatgcctttaaaggcacacaccacgtgctcggtgctgttgggaattctgatgctgggctctggggaccacaccaccaggtgtgtagatggaaagccttgcctgggaagacctctttggttcatgtcttgatgtgtccttggaagaatttccgtttgtggaggccctaacagagtgaaatggagccccagaaaaatatccagagaatttgagcaagccctctgcattgcctctgttacccagccctgcagcggaaacactggggactgtggatgaagagttctttcagccacagggaatggaaactccagacgaatctcaagaatgtgccagagaatgcgtcttcccgtccttgatgaccaggcccgttgttggaaggaaggccggctcatatcttagtgccctttgtgcttccttgtgcgggtcaggcacatttttctcaacttttggtttctggagaccataggttttctctttttgattcttttgaggttgttttaaaattctggctctttttggacaagttttggagtagatgattgtgtgtattgagatcatattcagactgctgggatttttcacatagttacagaagaggctgcttcatctaatgacagttgtgacaacaagcgcttagtggcagccgggtgctggtcccctgcagatataacctgagtcacaactactgttatcactacttttcagatgaggggacagagagattcaataacttgcccagggacagcaggtcacccagctagtgacacagctcacttcaaactcgtcaaccctggctcccaagtgcacacccttaaccacctcttaagcaccctggctgcctcccatgattaatttggaaagaaaacatgagaagcttctccaagttcacacaagagctcccaggaagacaattcctgacagattttttttttcacaaacatcatttcattgggtagaccatggatgtgaactctggaaactttttgtccagttttgtacattaccccatgttcttagagaagctcaactctgctaaccccccgacaactggacagaattaaagatgggtggtttccagctctgtcataccagggttgggaggggcctccaaacgcccatgcaccctctcagtccccatcctgagacagtgaggctgcatctcagagttcagaggaaacccaaggacgagctagtctcatgttccaggcaagaaagggttccaagctcgaggagaagagaggagaggaggggaaaggagaggaaacactagggcgacattttgcactgagaggctgggcaggacctggaggggggcagtcggctggcatcgctggaaggcaggcagggccttgagacaggagccgtttcctcttctgtcttacaggagttacagagcatcgcccatggccttatgttacggcaacacatcacgaggccttggccaagagtctgggacatctgccccatcactctgcttctttcatgggaatcagactctgggcatgagccctgggctttggtggtttttttctaaaggtgccccaggtgacttaatgtatagtcagggctgaggaggatagagtgtttgctgaggccccactcccatcttctaactcaaggccctgggactcagagcactcaacccttatccctctgcagccacccaactggagacctttgagatcacccagccagctgtcccatctctattttgatggacagtaacagggtgcagctgtggggtcggaggaagtctggccagttggcagaaacaaaggggacacagcaccgtgcctccagggtgccaataatgttttcaaaataattgcctctttgcactgccacctggaggctgggagccacctggagtctccttgatgaaaggaaatgcttgaaccctcacatactcccttgctctggacaaatatttggccagcggggtcctgaggccaggctggaacagattgctctgtgcccaggagtgccttaactccctggtgtgggtgcccttcttactctgtttgctctctgtacatttagtaggtggagcagggcaggaaccagatttgactcatggtttacaacaaatctcagctttgcacacagcggggctggaggctcaccctccctggagccccaccttctgctactccttgacccaagcccggctgcccagccttcagcctccaaagccctcacagctgcttcagcatcctctgagcttggcatgtgccctttctgccctctggagagcccctcccagtcctttggcctggttaaccagttaggtccacctctctctccaaggctcgactgaccctatgcacctgtccaggctgctctgcccactcggggctggttgtccacctgcatgttaagtggctgcttatgcatctgtttccactgagctgtcagcctcctgcatgaacgacaacttattcccaggtattggtagtgctgggctcagtgccagaagcttcatactcacatctgtagttttagccagttcacaccagcccccagtgtggggagactgctgtgagttgccatttgcagagaggaagctggggccaagaggcagaatcacttgctgcagcgtcccacagtgacttcggaggacagctcctctgagaacgggagtcccctgccaaggggagggagctggcagggcgcctctgcattagaattctcccagagaagaccgcggcaaaggcctgtgctccaaaggcaaggggcatgactcagctgaggcaacagctgtttctgttccacagacacctagccgggaatgaaatctctcctgactcggctgtgcctttcccgtatcctcctcttcttctcaggattgctcttcaccctcctccgccctgtcccccagatggcccctgtgaccctgggctctgcagtcctccctgggcatctcctgggcagtgctgagcggaaggtcgaccgccccactgcccatcccctgggagcaaacccctggctttcatgatgtcatctgtgctgagacatctgtgactaccttcaccttcatatgtttctgggacaggcaaggactggtgtaagagcgtccctaggaacgtggttcctcagaggcttctgggttggaggctccagggacatgagacacactcacccagggccccctgaatggtggggtccaaaaggggcactgtgcagctgcaacggtagagatattctgtgtaagtccccttgagagagaatttctcacctgaagacattatactaaatgaaagaagtgagccacaaaagtccatatgttgaatgattccattcatatgaaagttcaaaatatggaagtttgtagagatagaaagtagattagtggttgcttggaatgggggcagggaagccacagctcatgggatttctttccaaggtgatgacaatgttccaagattgactgtggtgatggacgcacgtatctgcgaatattctgaaaaccagggaatcataccctttcaatgggggaactgcatgggctgtgaattatagctcataaagctgtttaagaaaagaaaaagataatgtctccccaccatctcactatgaaacatactgctataaatataccatgcaaaggaaaaaagtcggcctcattttttaaaggactcacttgcaaggtgatgcccccagaggctgggtggggtcctgagatctgtcaggagctggggttaaacccatagtgggctttgttctatggacaactgtggacaaggttcccactatagactgcaggaacctgcgagccagtgtggggagcatggaatttcccagggagctggaaaatagtcttcatcaggttggtaaaagcacacactggaacagggcagagtctggcctgacctcaaggccctccgcgcagctgccggaagctcagagcccaggctgtggctgcagccagcaaggtgcacacaggaggctgtgaccagctctccacacactgacttcccctcacttttcctgccattgattcctcacaccagtcacatcttaagccacgtgggaagaatggagtggagtgagatgactctgcagacaggagctgaggactaccttctcagatttgccatttccagctgccatctgtgcattaatttacctcatatgtattttacagttaatttttcccaaaataatgacattgcaaccataagcatagaaacaatgtcactatccggtttacctttgcctatccacgctattagagaactccagacacctggctccaccctgagcccttcttgccttcatcagaaaaaccaaagagagtaaaggaggaggaaaatcgtttcctcactgtgaaattcagtgttcctcgatagcatgtgtataggtcacccgtaagcgcctctggcccacggggtcccactgggattccataacggagtctcttcccaaccatgtgcaacccaagctgctcctttggggtttggttcataagtggctctagttcagccacacccaggtaccaggagaccaaggcccgttagctgacttggacaccgatgcatggctggatgggtcttctcctggtccccaccagtgaggcagctgtgagcaaggcagacctcaagcccaccatcacctggtcagggaaagcgccatgttatccctaacccaatatacctgtgtttgtgctgagtgctacagagaagacgtgcaggactccctgagactgtgtgaacgaggaagcaacttaaattggtcctcctgggagggtcacgtagccaccaggcaaaaggcacttaggagaggggttcccaggccagggcctccctcttcccactggatgtgcccgctggatcctcctcctatttctccatgccaccctcgcatgcctcctgaatccaagccctgcctgtaccaatgtgctcctgtccctccgtcagtgcccgttatggaaaaggccacataatctgttgaatcttaaactcaactgtggatgaaatctacacacacatcttattccatggtggtctgggcatttttatttaattgattttgctcccatttttgtaagatgcacagtgcatcccaccggccctgccacgtgccttcaggcaacctaagatccatcagcagaggacgctttctggtcagagatgcccacatctgattccttagggacaacttggttttaataaatccaaagtcttcattgcactgatttttctacccaaatgcaattctctcctgattgcttctcagtcaagcagctcagagaacacctgtgaagacagcggtatctctcacccagcaggtgggcagcaggtgcagggaggtgggggggtcaaggtgctatgtgaattcaaaccacaggggacataggcctgggagggcagccccatcctcagccccccagacacttctgtagtaccttggagacttttggctgcaaaggaatctccacataggcctggagtgcttcgagcccagtcctcatccaagtggggaacatgtggatgaggctgagctgattcttactgggtgggggtggcgctgggggagatgaggagaagggaaagagaagtgcagaaagtccccgctggggtttgtacacgcctgtccacagtgaggaacggagtttgtacgtacccatccgcggtggggagcgggtttgtatgtgtccatccacggcgaggagcggggctgggctactgaggggtgctactggcccccatgtctgctcctctttgactgtatggggctcactgaccctggcgacatcaactggggtgtattctggataaccacgggactgtactttcctcatgcccatcctcagccatccaaagagacaaggctgtccttggttactccattccaactccaaatctgatcatcagaacacttcctggacttgggaatataaacagttgaatccagaaaaagaaataatgagcaagagaaagaaagagagagaaagagaaagggagagagagagagaaagagaaagggagagagagagagaaaagaaagagagagagagaaagagagagaaagaaagagagaaagagaaagaaagaaagagaaaaaagaaagaaagaaagaagaaagaaagaaagaaaaagaaggaaggaaggagagggagggagggaagaagaaatgaaggaaagagagagagagaaagaaaggaagggcagggcaggggactactgacagtgtggttaatttgttttgccaaataaagaccaaaaagatctgctggtcactaccattgcataaaggaaaggacattttaatatcaaagcaagtaggagggctagaatatcagaagaaatagcagctcttctcatgacaataccaaatggcataaatcctttctcagaatgatgaattacttaacttccacctacctcagtttcctcatctggcaaacaggtcagcattgctcagagggttactgtgagaatcactgagttattatttgtaaagtgcttaggatagtgcctggaatgtaggtctgatataagtgtttgttaaataaaaaaattaaacccatatttaaaaagttactcaggccaggtgcagtggctcacgcctgtaatcccaaccctttgggaggctgaggagggcagatcacctgaggtcaggagttcaagaccagcctggccaacatggtgaaaccccgtctctaccaaaaatagaaaaattagctgggcatggtggcatgcacctgtaatcccagctactcaggaagctgaggcatgagaatcacttgaacccaggaggcagaggttgcagtgagccacacgccactgtactcacgcctgggtgacagagcaagactctgtctcaagaaaaaaaagttttaaaaagttaatcagggcaagcgtgccggggattgggattgagatccagcacagggccctggggggactaaagatgcatttttgcagaggaaaatgcctgccctgttctctttgcctgcttcctgtgtttttgcactccagtcaccccatgtgaccgctggtcgggggcccttcctgggctggggctctcctctaggccaaaactcacccctcctcctcccccgcagatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggtgagtccagcccagggtggctgctggttgtaggggggcgcaggaagtactggtccctggcccagtaggatgggcttttccagtgccaggtgagacttctccgtagatgtcaccccaccatgttccaaggctgagcctgcccagggctcctggcagcagaatcaggagaggcaggggcagaggcaaggtcgccgctgccaaccctcactggacctgttctgtgttctcctgcatgactgcctttccatggataaccagctgcccagcccccacaccacctgtacccgccaggtgcctgcctgcccctcccatcacctgcaagggctgttttcacctcaaggcagcagggccccagaggccgaccaaggtgttgggctccagaaattggccctggctctgagggtcaggccatgcttactgtccagctcctcagccactgccttccaagcagggctgccagagagcactgggaaacagaagcggcctttggtcattattctgtataaattctgctttgagacccatgaaaaggtaacttttacatgtaggacacttgcctgttacctgctgtaggggtggtggggccatttggccaaggctgtcactctcaaaagctctgctacttagacttttgaaatcacttccaaatcacaactacacaaaaccctgttttagtacctttttgctttcatttattactttattttgagttgggggtctcattctgtcacccaggctggagtgcagtggcgcaatctcatctcactgcagcctcaacctcccaggctcaagtgatcgtcctgccacagcctcctgagtagctgggactacaggcatgtgccaccacacccagctaagatgtattgttttgtgtagaaatggggatctaactatgtttcccaggctggtctcaagtcctggcctcaagagatcctcctgcaccaatctcccaaagctctaggattacagtcatgagccaccacgcccagcccttttttgcttttaaatataccaggggccaaaaataagcaatgaaacaaaacaaaacaaaacaaaacaaaacgaaagaaacagcatggtcctccctcaccctgcactggtcagcgaggccacacccaacctggactgtggccatgcacgacacttctcagatccaggaccagcttttccctgggacaccccaagctgctggcccttcctccacctctcccttgacccttcctcaggggagaccagtgtcccatccccagcaaagtgctcactctggccccacagcagtgaagtgagactcagcacagcagggcaggcatgggacctccgtgacaaggttgggaggggtgggattcaaaggaagtggggggagaggcaaggggcgggggtggaggggacctcagctctgcatctgggccccgtctctctctccccatccctctgacaccccgtctgccccataggacgcagcctaccactgcaccgctgccctcttttacctcagcgcctcagtcctggaggccctggccaccatcacgatgcaagacggcttcacctacaggcactaccatgaaaacattgctgccgtggtgagtccgggcacctggggctgtgtccacagcgggcggctccgtggctggcagggtgtgtgtggaggctgcctaggcccttggtctgttttcagttcactaacttttgagtgaggtcaaaccttgccttcatgcctggagcaggaaagcccccgagaagggcagtgtcatgttgtgcccaagactccgcttagtcgtccggccagggctgcatgccccaggcctgcgtgggctttgcagagggcagatgtgtgaggggatgcggctgcccagcgccctgtccgagtgctccctgaacaatcttatttaacatccatggcaaccctacaacccaggattatgacacccatctcacagatggagaagtggggccagagagtgtgactggcccaagatcaccagtcattgtgggacctggcatcaacgctggaggcccagtccccacactctcagcaccagtttggggctgtgagtctgacctcatgggtctcctgactctccccaagtggtcgtccattgaagcatccagccaggggtggggacgctgaggccaggtggattttcttcttaatggactggatcagaatgacagggtaacagaatatattgtttcatcacatgtttttcagagctgtgcatgtgtgcccttgcaccagtctacgatataaaacatgcttctgaccatgggtattgttaaaaagtaagaagtttcagaaagagcactcttcagatctctagaacttaacctatgaattatgcaaatcccaaggtagaatgtggtgacagatcctgagataccagctctagtagccaaagctgtgtcatcccctctttttggaaagtgtagggcagaggctgagagaagacccacagataggctttagaaatggggttggtgaagtgcctcttcccactcccagaaggagggccccaggggaaaatccctcaaagcctcacttgctggtccccttgcacagtcccctgccctggggaaaccacacactgccctcaagctcccagcctacaatcgctcccctaaaaagggccccctcaggatcctggcatccccccaggggtcccgcggtgtggaaacatctcccgtgttggcccatctcccaacatggctggtttccaagcagcagcacagccagggggcatcttgactgatcttccttcctggggaggctggtgagccaccctccatcttcttcacacaattccatctcatctccctctcccaagactgcctcatacctcccccatcccagccaagccttctcttttaacaaacatcaacaaagtgtctgacaataatttccataaaattgttgtgaacaaaggttgcgaaatgtagatgggatgtggttagtgggtcagcacttgatggaaaaacccagctaggggaatgaacaccccttcccgctgggcaggtctctagttgagaaccactaggctctactgccttctgactttcctcttttaccttttatcaaaggcagcacacagccagagaggtgtgcagttacaagcccacagcttgatggatttcatacagcgaactccctgtgtggatggtgtctggactaagaattagggccagttaccagcgcacagtctgatgaattctcatagagcaaactccccagtgtagttggcatctggactaagaattagggcctgataaacaactcccagaaatcccctcaagtcctgtccccatcactgtgcacccccaccaccacccaattctgatttctagcaccatgttcagttttgcctgcctttgaacttcatataagtggaattatacagtgggtactcatgtgtggcttctttctctcacccttgtgtttgtgagactcacccaagtggctgggtgtagatgtgggttgtttgttctcattactgtatagtattcccttgtaggaatagaccaacatctatttatccatcccatgactgaccatgttcccatttttttttagttgagttggatagacacgaatatgttcacgcagacaggagcgttagaattgagaaccagagtgttctcagctggcagatgtgcccagataaaaccaccaaggggaaatctgcacggcgttcgatgtaaagtcacacctttcaactcacggtatcaactgcatccgtctgtgagagagaaagaagttcgttactcaggattcaatcccagacccgcccaaccacagcatgcccagtccaggggatacttgggtacagggaggcacctcacaccctctctcacacagcctggttttggaagcagccagcctgcctcacatccactgtgtggctactaattagggtctgttccaagctgagctcctccctctctcctttgtgggtggcggagctgctttgccaaagggaccccagggatgggtggaagtcgcctggggcgagatggaaatttctggagaaatctggaggtttctagattatacaatggtgggcagtgatggctacagtttagggagagggctttctgaagccaaaatttgcccattcgtgcccagctctacgtgttcccagtgggccatttcttgaccccacttggaaaatgagtctccactgctcttcctgctggggacttccaaggtgcttctgccaaaggctttcattggtctggaatgcccaccttttatggagggctgcccactggtgtctgactgctcctgcccagatacgttctcttaaatgtgttattcaataattcagcttactcaccgcctccaggcaatgagggaaagggcttggccaggtgtaggggcaggagagcaggcaccctgagggctgggattgatgagcattttcaggagtcacagaggcgtagccgccctaaatggacgtcgtgcctgagctggaaactcttgacccctaaccaaggtcacaaaaccaggtgcagagattggacttggcagcaggcaggccttcagggagtagggtgatgggagcagacagtgcccaggaggacacagcaagtccccagaaagcagggccatcgctccaagggccacagtggctgactggatggtcccaacagtaaggcccctcctttagacaaaagctcaaaatcccttctccccttctctgtccctcacttcctatgaagtctggctctctcagccacacctgtgatattaagaatcctaaaacaaaataatgatagggtgagaatgtccaggcagcatggagactttcaccagggccagcaaacccaggtatttacaatctctcaaccgagctaccaggaccacagctggagggcgctggtctcactggtgttgggggaggaagttgtccctggagagttacctgcctgagatgctttcattggaggggtctttgaggactccatctcaagtcagccgaaacctcaagctgagacgaatgtgatgctgggtgatagtggagagtcttaccttccacaccagatccaggagactgttaggtcacatggagctctgtactgagaggatttggtgcacacctgggctcagcagggagggcgtccatgtgagggtgagaagcaatgacagcccaagctctctgggtctggccccccctacgccacgtggggctggatgcagtgcagacgctgtgcctcgccctccctacacaaacccattaacggccatttctcttggttccaggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttc

SEQ ID NO: 36656 - DNA, 25254 bp, Homo sapiens
cctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggtgagccctctcctgcccgggtggaggcttaccccgtcttagtcccggggataggcaaagtggggcgggcgcgggacgcgtgcgggattgcggcggcagcggcgcacgcgggcacctgggagcggcgggctgctgcgggaggcgttggagactggctcccgggggctgttaggaccttccctcaggcccgggtgctcagaacgctggaggacttgcttttcttgggccttgatgcgaagtgctgaccccgctgggcaggcggggcagctccggcgctcctcggagaccactgcgctccacgttgaggtgggcgtggggtgcggacaggaattgaagcggaagtctgggaagctttagggtcgctggagggggaccccggttggagagaggagcggaactcctggacaagccctgacaagccaagccaaaggtccgctccggcgcgggtgggtgagtgcgcgccgccccgcgggggcggggagagagcctgcagccttcagaacagatattgctcattttctggcagttctcagacgtaggaaataagtcagcaccgaagcagtggttaagccggagggctcggaagaacggcaccttttctttctcgaaaaagttatatgggggctgaatgagcttctggaggcttgtttaccgttttttattgtcacacagaaaaagaaactgccttgtctcccttccgggaattctctctttaagactgtaagtcgctgcctgagtggtttcattttgttttgtttttctgcccttctctttcttcttttgccctttcttagcttgcactcccatggtgatttctgcttggtctcctgctggggttggtggtactcgttcccaccgcacagaacccggcgcctattattggccaagaaacttgagcagcctgttttgaaaagtccctcgctcagaaatgccagcttgcagatggctaatcaaagagacgtggatccaggaggctcatttgagtaccggagcctctgagagtccatggatttttattttattgggccccaacaaagtgccaggcatagcgagagaagtgtttacaaatgtgatctccgcggattctcacgagagccatgtagtggggaagataaccacatccccattttacagatggcgaaatgaggttcagagagcttcagtaattcagccaagatcacacagctagtaaatgggagatatgggattgaactcagatctaattccaaaactcaggctgttcgctgattgcatctgatatccagattacaccaagaggctgagatgtctgggtccattttatgattagaaaaaaaaatcctgttcctttcagaaatagtgtgcactatttgggattctttagaaacttccttggagaaaattaatgattcaagattgagaaaacatttatacaacctcaggccacactcttctctctcttgttattaaccattgcaccactgcaatgttggctgctttgaaaatctcatagtttttggacagcagtattagtaaagtgtaagaaaattgtcaaagcttggagctatgcttgttgaacttttgtaccaatagcacctttaccagaggctgcgtgtttaaagcccgaagaaaactttgcttttctgaaagaatacacacacacacgcatatgtaaatattcatacatttatgtatatatacatattataatacctataagttaggtataacttatatttgtatatgatatatggcctaggaaattaaggcttattaaataaaatttataaatgcagatgagtcaaatacaaagatcagacataactctatcacctaagtaatcattgtttacgttttgcagtttatcttccatttctcccctctaatatgactcttttaaatttagttacacagaaattggttttgcgctcacgacatgcctaacatcaggcctttatccttaaagaagtttcaacactcttgtgtcacctcatgtgtctacagaaaatgtttgcttttatgccttcacggttatgttttcttagtagtagcaataaataaaatagatgcaaagtgctaattacttggaatacagaagcaaattttaattctattaatgggctggacatagatgggtggggagctgttttctgcttttcccctcttcccctagtcctctgactctggtgataactatagtcaacaagtatccccatccttaaccccttttgcttctctttctctttccttctctcaaccttcctggtgttagttttctctttcctatttctgagtgtttttactccgacacttacaataaaaaagtttgaaatcccaaaaagttgacaaatttctaaaggagacagaaaaagagtcaaacttactttacaaattaatttgagaaatagctgtgggttgcattttttttttttattgtgcatgaccctgttattggccaagaaacttgagcagcctgttttggaaagtccctcgctcagaaatgccagcttgctaattgaagggatgtggatccatgaggctcatttgaattccgaagcctctaagagtccatggatttttattttattgggccccaacaggttttgtcttgcattatttaggacattggccaggcaatcactggacagccagtttgctctcctttacattttgtagaatggttatcttatggtcaaaggaaagggagagggcctttggaaaataaagctgtgtatttacaagcagtcatacagaatagttttgtggggaaaataaagaacagttatttaatttgtaatttaatcatttttcttaaaccaacccaaagagcataaaatggaatatttatttatttttgtagcttaatttgtaatttaataatttttcttaagccaacctaacgaacatattgggctgtttattttcatttttaatgggccatatttacatcacaaaggacttgagaagtcttacaaatacaataaaatgataaaatatgaattaagacattagcaaccaggatggaaaaacacaaatttgtaaatgatggccaggtttgcaagcaaaaattaaattgataaatggcagcacccccactaccagctatagttagactgatgaaaaatcctctaatgttcatgcctgaaatacagttaccacccttagcagcaaattagaggcaaagaagttctggaatttggacgttgtctctgagtaagctctttgagacactggacaagtaatttccttctgaatactcttatactgacacataggagaagtgtcagtgtttcaaaggaatctctttgaaggctactacattgctttaggggtgccagattaccagagtaaactgccagtttgagagaataactgtttcttaagagatggtctgaaacctaagtaaggaaatccccccacttgaaagcccctaggaagttaattgcttttggcaaattatcttgggccccaaaagtcccttgatgagcacatgttttgtaataggtactaaagactatttacttatgatgaaaaataaaataacacaatttaaaacttgaaattgataaaaagcaacttgaaaccaaatttaggacagtgaacccatccctttcttatttttaaataggtaaatatagaaaaaatgaccacatgatgtgaaacaaaaagcaaatatttaaaaactacatttatactttatctcaccacactaatgtaaagaattttgattttacttataaattcttagccttgtctacacatatacataattgcatgtttaatttgagctatatatagtctgttttttgttcctttgcatgttacacaaacctttttctatttctacataatttttatctcatattttttattggatacattatagagagagcatttattaaatgagctgggattactataatttttattatttattttttaatttattacttatttttataatttactattgaaaaaaagcatttcttaaatgtactgggatacatatatatatatgactttttcttgttactaaaaaattactcatagaacttacatattaaaattttaggacttgtgatgaaaaataataaaataattcaaaacgataaaaagcaacataattttatatgttgtaccttgtacttccttataaggtacaacactacaatagccttagtgtgtagttttctttttgctatgtatgtatatatatattcataaaagtggaaaaataacatttaataaatcctctttattttctggaaaatccttgctttaaaaaaagtctttagctttttatatagttctacttctaacaccaattaaatatcttcaattcagtctcaagcaggaacaaatcttcagtccacttgcctacctttactgtctttgaagtgacagtgtgagtagtaaagcccaaatcagagagaaattgacttttgtaagattggtaacttcaccttccccggaaggaaatgaggtggttcttccctttgatcacaactgctttcttgatttgaaataaactgttgtacagcccagtcaccccatctttagacatttagaaatggcaatcatagttatataggacaactagcctgagtcccactaagtagaaatgatagtgaatttagtataagattatacctttaggctgggcaggtgactcacacctgtcacccagcacttcaggaggccaaggtgggtggatcatggatcacttgagattaggagtttgagaccagcctggccaacatggcaaaaacccaactctactgaaaatacacaaattagctgggtgtggtggcgtgcctgttatctcagctactcgggaggtcgcggcaggagaatcactggaacctgggaggtggaagttgcagtgagccaagatcatgccactgcactccaggctgggcgacagagtgagactccgtctacaaagaaaacaaagaaacaaaaaatcatacctttagagcaaggccagccttgtgaattagcaaatctgactacaaattcaatcagcagatgtactcagcccagcaaagtgagcaagcttactataggttgtgttaaggcatggactgggataaactggcaaaattagagtaaatttgacaatttgacattggattcattaatgatagcctgtccttcaatgaagtcaggcagcattgtgtttctattcacctctgtgttttgtgaggctataaaaatataagatatgagaaatgtgaatactttttatttgtgagggcagatatcttgaaaaagagagcgagaggaagtcagagtatgcgggtgaagactcttgtttttttgctgaggatttagctttggtttttagccattctcacagagatcattggtcctaattaactggttgttgttgttttttttcatgtgaatgtctgtaaggtttcaggcttgattttaaaaattgggcctatactcacagaaagacaaatactgcatgatctcgtttatatgtggaatctaaaagttttgaatccataaaagtagagagtagaatagtggttaccagaggctagttgggggcaaagttgggggatttagggagatattggtcaaaggatacaaaatttcagttaggaggaataagttcaagagatctagtgtacaacttgatgtctatagctaataacaatgtattgtatacttgaaaattactaagagtagattttaagtgttctcgccacacacacacaaaagaaaatgataagtatgtgaaggaatgcccaatgtaattagctcgatttagctaattatcttccaaaatatgtacataattatcttccaaaatatgtacataattcaagacatcatgttatataccataaatatatataatttttttatttgtcgaataaaaataatacaaaaaaaccctgggcctatactgcccacaggtagtggccacaggcagagctggtcccaagcccctccctctctctgtagtcccttatcccaggttgctttattcttgtatgacccacgtggcccctctgggcttgtaagggctctggggctgtattttaggactctatagcccttacattacccatttcctctaccaaaggtcatttctcttatcttcaagcttatttttggaagggtcattatttcttcatgagaagtcaaattctgatttgcaagtgctgaacacagatgccattagtctataaaactcttatattctcacatgtaaatgtagtaacctgctaacctcagattctgcttcctctaacctagttgccctgcaactgtgatgaacctcaaaatcaccaagggtacttccccattctcagagatcctgattccttaggtctatgtaggggccttagcactttttattaaataatgcatcactacaggattctgatgtctgtcggggtcttgagaactatttttctgactctagcactaaactcaaaatgtaatttcagatggaatttcctaggctcattcattttattttatttatggcttggccagtcatggatctaatcagtaacttgcaactgttgcttcaactacctctgtcctggactttccagagattggctttaagaaagaaagaggacatccctgggataagattaccatgtgtatttttatgtacagattttgaaaaacatacaaatgaatgggatctttgcttatctcttccatgtagaaaaatttattttacttctatttcaggttttcaataatgtagtaggacaagatgacatcactatatccctgttttttacacagatatattagagatgcattatcttattggaaattttaaactattcaataataaactattagtcttttagaatttctttttcctcaagtgttgataagtaactgaaagtctacaagcagacaagcagaattagtcggtggaacttcatttcttgctccatttttgtcctcagcagtagagggtggtgagatttcaacccagcctagcaggaccaataagtctggaaagaagtagctctagttcatattggcacctgctaattctagttctgaagaccatgggaaatctcttgcctatttagctcagtgatcatccaagatgggaaattcttgggctcagctgtgagggatcccaagtttatatgtaacactaatgtctcacaaatcaagaatccaagagaatcaagagactatagttcattccttatattaaattcttaggactgccaactgggtggctacagttttgggggctagaagtctgatatcaaggtgccaactggactggttccttctgaggaccacgagggcaggatctgttcaggcttgtagatggccttcttttccatgtgtcttcacattatcttcctctgtttgtatgtgtgtccaaatttcctcttctttttttttaatttagaaatttatactgtctacaagctttatatagctttagttaaaaaaaagcaaaaaaaaaaaaaaatcaaaacaaaaacagtgaagccaagacactcttccaaagtctggacccttccggccttccaaatacaagagctctggaagttgtatataccaaatttcctcttcttaaaatgtcaccagtcacattggattaaggcttaccctattaacaccattttaacttaatcacctctgtaaagaccctatctcctgatacagtcacattcggatgctcaggaagttagggtatcagtatcactatatgaatttgggagttgggggaggacacagtttagcccatgacagtcctgaatctcctttgctagatgcatgactgtgggccagtcacttcaccagttgggatactgccatctctatcagaaaaggggtttgggctaggtcatctataaagtcctttctgctctaaattgtaaatataatgagataccaacatttagtttaattgtttaaaattttagaagctaactggatgctttgctggtgtcaacactcccctttacaaaaaaaaattcggccgggcatggtggctcacgcctgtaatcccaacactttgggaggccgaggcaggcggatcacggggtcgagagattgagaccatctggccaacatggtgaaaccccgtctctactaaaaacacaaaaattagctgggcctggtggtgcacatctgtagtcccagctactcgggaagctgaggcaggagagtcacttgaacccgggaggcggagcttgcagtgagccgagatcgcgccactgcacctccagcctggcaacagagcgagactccgtctcaaaaaaataaataaataaataaaataaaataaaataaaataaaatctcactttctgtttctactgttctctcaagtacccctctgccttctgttacttctttgctgcattctgagaggaatggggtggggagcactctttcctgtagaaccccataacccatctattttcatcaatttatttgaaattcaaagccaggggttaaaatgtccactttcaatttgagatgtctaactttcagataaatctattaacatgcatttctaagtgacttttaagctaagcattttattttattgagctcgtatggaagggtaactattatacttgtataataaagtgcactttcaaaaatactcggttcaaatgtaaaataatattcgtaatattttaagacaaacctcctagaacttatatgtgtctttcttcccagagcagtctctatgggtgcctaaacaatactgcattattagatttttttcagtttataagccacacaagaaagttaacccatgtcatctctagaggcataaaaatagacagttgttctgagaaacatatctgtttattcctagttcagtaacagcgcaatgagatcctaaattatgaggtactttttgtttatcttattgtctcattggcaaccagcaactcctgttgcatttttgacatgggaatctatcagggtgtggttaataaagtacatttccatggtaagtattctttaagaaaaaataaaccaagatttcatcagagacagaaattactgcaaactgtacttaccagtttctggtgatttgtataactgagctttcaatttcaaaaattaaaaagttctctttagtgtaacatatttttgtgtccagtaattttacttcaaaaataaaagagaattttctttaccatcaaacaacgttgctgtaatgagtggtgatatatttagtcctagaggaccaaagagaaataaaatggctttgattatgctggtttaagaaaatatatccgatgaaacagaggttaatatttgtgatgtttgatttagtaaaattataagactaccaaagaaaactagaagagcaaaataaccaaaatttatataaagaattcaatgttgataattcaaaggtttagaattttttccacctttcaaatactaagttgctgttatagatttactaccattattacccagattttctattttactaaaaaataataacacagttcgttatgataaatcagtatagatctttaggctcaacacaaccctgctaccttttaaacttttttattatacaacaaacacatatgcattatcaagaaaagatgagtttagcaaaatgaagaaaaatagtcttatcaactagaaataagcaccattaaaatttctgtgtgttaaaagataatatgctgctgaaactttttttttcttgaaatgtccctcttttctttcacttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagattagcctggccaacgtggtgaaatgccgtctctactaaaaatacaaaaaattagccgtcatagtgtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcactgactgttccaggcatctgtctactcattcttgccatgctgagggctgtcatttctcaccactgaatgcctttttttttttttttgtgcttctttttaaaagtcttttcctgtttgctttgaacttcaataaaaacagggggtaagaaggtaatatgcttttattttgtctgtggggtttttttcttccttcttttggttccttttcagatcctagctcatcaaggccatttgccacactgacactggaataagcctgaatgggggtctatatttcttccagtagttagtttaattcggtcattgagctgttgctctatttgtaaccgtcatgctagatccgagggctgactattcctgagaaagtgtggagatcctttcagactgccatggtgctagggcagagtttcagtcattatcttctgtgtctgctaattcttgcatcatttcttctactctgtaacctggttggctatgaaaagtgattcttcctcactgatgctgcaggcaatgggtgaatatccaattgttctctcaggttcttgtcatcggatacaaagaacaaatttcatgtgtccctgtttctgagaggttcaaagggagcaaatgcacagattctagcttaggatgacttccagcttctaactatttgtctgtgcattccatttcctcacccctgcgagaggttgcagtcatggtaacggctgttctgagaaattcagtgcccaaactggagggaggggaacacaaactcagcttcttcccaagcttcagggcagggctggcaagttttgccttccccgccagcaagagccctggctttaggggtcttgctacagttttcccagactggaggtcttggggctggattctggttcttagcgaattcttgccaaacacctcccctttccccagtatccatttgttttgaaggttctttgcaggcttcttgccaataattgtcttaaaacaaatggagttgtttgcatacctagatggagtaaaatatttaggaaactattctacaaatatgaaacagcccagatttgggccagaagtcctggtcctgagtctcttgttagccactcttaactgtgaattattggacaaatcatttctcgcactctgtgtaatctgtcacctgggtacttgatgatttaaaccaggaattgtggcccttctcataatactgtctcctaaatattgggtgaatttagtatatcaaggagggcagggcactatacccgtaggggactctctctctccctctgtctctttgcctttctcagatatgcatctttggtggcagacctggggttcaaaccacagttgttttgaaatttctctttccttctccactatgctccccctcactgaaactttaataataaaagtagcacacttattgggcatgtatttgttatgtgccaggttctgtgctaacagctttaagtgcattattccacgtattttcacaacaagcctgtgaggaagaggttatttccacttatagataaagaaactgagacttggagaatgtaagtgattttacccacaaacacagggcagtaagtgggaggccctgttcaccttagaacacctggcttctatcattcatggtgctgtttctagtgtggtttgaagaacctgagatccaaactgctatacaagtgacctgctgctttcttggagagagaaatctgaaagacagtggagccctcacattgtctttgcctgtgcacagcagatactgccaattttgggtgggttacacttgtttaccacgttgcttacttcagaaatcaataaaattctcttcatgcttttattttacaggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtatgttacacaaaacatccagagattacagtgaaagtcacagttaggagtagcacatagtaatcatgactataataattttacagtttttggttcccctatattatataacataactgagagaaaaacaactatgaaattattttccaaagatgagttttatttatatttatcacgcttatttgatgtggttatggataaatttaatttacaagtgacatgcacctctgaaatgagaagactggtctatttggctccatttttttctaagcaaaaatgactcatttgtgaatatgaaagcttatcatgtcaaaactgattaggatctaccataacaatagtggaactctgaaagcaagagacttctcctcttaagggatatgtctcagcacttcccttcaatcagaaggtctctaagaaagctgtcctggcactgaagcctgcaaaatatatttgcattttgcagctgaataactagacgaataagaaaagcaacaggcagaaaccaacagcttttttttttaaatcaatactttgaagggcaaactaatttcagatcacaaatccttcaaacactggtaaattagaagctaagcaaaatgcaattgtgcaaacatttcttcaactttgagtagagttgaaaaaaggaaaatagcacatgggttcatgtgatagattaatagaacaaaaaaggactgtagtatgtttcatggttgtcctcccaggcttccagcactcaagctgtaaaacaggatgggtcctgtttgtgaaaagattctaccagtctccctgtgcttcatgtccagattttaataaccgttatggaaaaatctcccctataacccaacccatttatacttaaacccatttacacttaaatcttctccaacacgaataaagaatggcgtcctggctttattataacctgctaaacacaatcaatttgctctatgaattgaaatctttgttcataattttaaaacctaaaatgtaaattaaaatgaacaaaatatgctttgcacatcaaactgtcaaggatttttgtctattgctttttcggttttgctttgttttattttaatttaagaagtgaatgtaaattgttacaaacttttaagaaatacatttggatatatgagtcaaaaatttgaaaaaaaattttttttaacttttttttcttattattatactttaagttttagggtacacatgcacaatctgcaggttagttacatatgtatacatgtgccatgctggtgcactgcacccactaactcgtcatctagcattaggtatatctcccaatgctatccctcccccctccccccaacccactgtttatacttgctaagatagcaattaatttatacgaaaataccctgagaaaataatcaaaaataaaggaaaatattgtacacatgatatttcattatcaatatgatgtaggattccttaggtaaattctggaatatttaaagactgaaatagtatgtatcaaagtcatgttttctgatatatttctaatataatcctcaattatataaaccttcttaagtaatttccaactgatctggctggattaactgattctccctgatccgtctataaaatatcctggatggcatccaaccatgttaaatactcttcccacttcaattccctcttgttgaattttaggcttatcaatatctaagttgcttccaaatctgtttatgctcattagtgttgtgatattcatatgtaatttgattgaatattgcataaattaatgaaatacaaatacagagaaaagacagattttatttctaagaaaactaggttgagtgctttggagaattcaataaagatgagctgctaaaatgttgttgatgaattttgtgagggaaaaataaaagttaagtagtaggaaaaatcacaaaaatctctaaagccattcatagagattattggtatgtttatgttttcctttcatcaaaaacgaagggagggagggagggagggagggaggagaaaaaaagaaagaaatgaaaaaggaagagaaaaatagacaaacaggaaattataggtgatgcattatggatgtgacttaagaaagaacctgggattataataacttctatatcacaaaattgtcaaatgattatatagttatattttataaattaaaacaaaatatttacagtatttttaagtgatttcctatgtaaattgacatttttgattaaatgatcaaagaagtcctccccacatcatcatattcaataagaaggattctatggtatactgcacacatatttcatatatacacattgtacatatatatatatacacacctgttatatatatgctcatgcatatacatgtatgtatgtattatatgcataggaatgcaacaaaataacggcaatatctccagattgttgatatatagttttttgtttgtttgtttgtctgtttttttgagatggagtctcactctgtagtccaggctgaagtgcagtggcatgatctcagctcactgcaacctctgccttctgggttcaagcaattctgcagcctcagcctcccaagtagctgggactacaggagcacaccacaacaccgggataattttttgtgtttttaatagaggcggggtttcaccatgttggtcagtctggtctcaaactcctgacctcaggtgatctgcctgccttggcctcccaatctgctgggattacagacatgacccactgtgcccggcctgatacataagttcttattatactttcctgccttttccaacatttctataataagcatatgtaccattatactaaaaaaagtattttaaaatctgattttcaataaaacaactacttattttcttattttaataaattttgttttcatactttggaggaacgaaagaacctgtggtttactgtatctccattataccaaggaagttgtgctaggcacattctgtaagataattcattaaagagaccaattcattcagagaccagtataataccactagcaaaaaataaaattatacttggacttgggttctgttttctttaaatattgctacaatgttatatagccctatgcactatttttgaattttgttctgggaatctccagtttgttttttactattgacagactattatctttacttactaaaatagcatatatatttacatgtcataatttgctcatgtagtaaatattttgttttatcaaaaagaatatatgaagttattaaggaattcatgttcctaggaaacacagcagaaattaattttgctgtataggtgagcagagcagattaaactgcttatatttttaaaactagttataccattaacaattagagtcactagtaatgtttttctcacacttcccttgatattttctgtcactttcttcttaattctctattcccttaccttcatctagctttccccatagcatttttttagcacttgatatcaatatatttatttgtgtattgtctgcctgcatcccaagaaggtgaagtctttggtgatgaagggtttatcttatttcctgcataatatcaaacttctaaaaagttcctaggactcaataggcatttaataaacacctatcagataaatgaattttttaagagaacacattacataatgctttctaatagcaatacagtgacaaactttatttttaagtaaattaatgcaaatatgtatattatttaaaattgtttgtttttaagataacaagcctgatagataataaattttggcataaatatgttaatgcttatcaaaactcatcagtacatatcctgtcttttgatgaaaaagtaatagaaaggggagaacaaagagaactctcatgctcactaggcaggccgagtgcagctctgacagcaatgcaagagaaatattactatctccatcatatgcaggatgaaatttaggcttggagaaaacaacacttcgttaaagattttatagctgctcaagatttgaccaaggcttttaaaacttcaaatgttcttttccttattacactgtttcttatcaggatttgtggactttggaaagtaaaatgaaaagtcagagcaatgtgagttagtttgataatctcagtggccagtaacagctatccccactctgaatatataccaaccaacctctcccctttctccaaggaagttagttcttggcaaaggcatttcatgcagtgtactttgtcattctaaccttcctttttttttgtatgctcctgttgctaatcatcctatttctatgggcttcagtcactcttttagcttttgtcttgggagactttctgtctgttgacatgacttttaaaataatcttctcccccattgtatttatatctcattagcctaccccccctccccttgtgttttagaagagttttattgtctgtcatccctctatagttcccaccctgttacctgcccgtgtcctgttcaaacacttgctccttttttccttgggcaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggtaagagtcttaaaatgcaattgaaagaggccaatcttggaatttcatgtagaaccatttataagacaatttgaaattggggcctactgtggtgctatgttgacacacaggaaagggaaggacaggtggctagggtaccgcagaaccaggtgccgagctaactactggtctagacctttatgagtaagtctaggcaattcttccagatataggagaatgagtaaatatgaaccctaggaacagggttcatcagctcaaatcaaaagctcagaaattattttttttctggccttgacttacgcttatataatggtgctcgttcatggccagaaaaattcagaagcctgcagatacaaggacacagaaatccaaaaggtaggtaggaatgctccccctttctttggggatttagtttgtcctgataattccatctggggacctgaattttcatggatatctcaatgtattctaaggacccagattgaagtataacagaagtgtttctagttttgtttgacatgaagaaacctctggacataaagcttttcccatccctattcagcctataaagcaatgtttctcatccctggcagtgcattagaattgcttagggagctactaaaaatgtttcatgtttaggtcccatctcagggcaattacatcagagtctctgagtgaggaccttggtattggcctgatggagtaagtctggggtagagcctaacattctacatttttaacaagctcccaggtgatgctcatgctgccagtccccaggtcaccctttgagtgttaaggctagagactagaggaacaggggagacgtctaagtattggtgaggtttgtcttggttgctgctaaatgattgctggccatttcaacctggggtttcctgttctgtgtttaaacactgactgtattactggtgtcatgctgtgactgttgatataagcagtggatctcaaaaatccatgcagctcctgcccaccattttcatagtctgcttataattagccgctataactaatagtttccaaactgattttctaggcttagaagtggaaataaactgcacccggacccagaataccaagtgcagatgtaaaccaaactttttttgtaactctactgtatgtgaacactgtgacccttgcaccaagtaagttttagtctttctctgattaaaacactagatataacatgagagttatcattttcctagggaagtaacactgactgagagttaagaattagggttctagtcctgctttgcctccaagcaactagatgactgtttgctcatttaaacactggtgaacttcctgtgtaggtgacactttgctggccacttaagctaaagatatgagccagacatatgcctggcatcaaggtatcagtccagaagcacagacagtcaaggaaagcaatggttattgtgtttcaacagcatgagaatagcatcagaagagacttatgttccaggtgttacaaattatacagaaaaacttttcaactctgcctgaggagatggaggtgaagacatgaatgtgtctcatgacttgaatcttgaagaaagaaaagaaagagcattaacaggtgcacatggatggaatgcacattataggcagggaaacagcagctgcaaagagacaaaggaagctcaggaaaacagaatacctggctggagtgtaggaaagactgagaagcgttcagggctgaatcatgaagggccttgtcttttaggctaaagaggttggttttgacccaaagttagagaacctgccttgtaagtcatcttgggaagcttttaggagttcatctaataggcttaagaaataagcacatgatgccttatgttttatttgctaggaaaattttatgtacagttgtcccaggctctcccctggccacaagtgtctgagagtgcccctatgatgacaggctaggtaggcattggggaagcagctgacttagtaaaataataacaataatagtaattccaaatatttcataatcttgatttaattttcttgtcatcataaccttttgaaatagataatattatttccatgttattgatgagataaaaggctcatggcagtgtgacttcccaagctcacctagtcaggtaatgggcagaggctgtgaactcagacaacctgattgtgaatgtttgtctgtctgaaggaaatcacacatgaacctcttgagtctcctgatcaccaccggttgctaaaagtggcagcctctaagggccagctgagtaccctccctgagctacatcatgggcgtggctatcacctggccattttcttggtctataggaattttttgaaattacttttgacagtttattttaagagctagtttaagctataggatttacgtgttcagtttattactaggtttaagtttatttttgtatccacttcatctctcttgtgtgtcactattttcctatcttcctttaactcttgaaatcttaagacagagtcattccttatgatatttttcatccagccatccaaattatattaacttgtgccagctttagatactaatttagaaatatttgaaggaatacgtttgccagagatgcaaagatgaataaaatggcccctaatttacaaagtgccattgaaaattataaaggaattattctgccaggcttttgaatttctcctgtatttttttttctagatgtgaacatggaatcatcaaggaatgcacactcaccagcaacaccaagtgcaaagaggaaggtaattatttttttacggttatattctcctttcccccaaccccatggaaagatgtgaagaaaaaccaatcactcttgattactagaaagtcctttatttaatcttaaagattgcttattttcatataaaatgtccaatgttccaacctacaggatccagatctaacttggggtggctttgtcttcttcttttgccaattccactaattgtttggggtaagttcttgctttgttcaaactgcagattgaaataacttgggaagtagttcacaaagatttgcctcattcttacctataaaaagctaccactttggtagatttatgtattgttaatttcttgcccctgaatgcagccttgagagctgactgataagaacaaatgaaattattcctcagctagtttctgagcaacagttttggggcattgagtggtattctcatccttcctatgaacaggtgttctctgcagcagcagaattggccaaaaatcagaagcaattcttcactattcattgagatctccctatgcaaaaagagaacacaagaagcaaaggcattcccaggaaacacattgcagggaacactttaaaaacttgtacttcactgcctcctcttcctcggcctaattgcttgtttttaattatttctccttcttaacttaaaatactatggggacacatgttatacaaaggtgacttagtagagtcagtagaaaagccaaaattagatattatcataattagtctagaaaaatccctttaagtcattcatcaactacagggtcacaccaactttcagtaacttagaagtattcaattttcccttctcagaacaattatctgtttcttcagttcagttgaagaagaaagtttgccttgcctttagcggttgtttagctgaaaatacatttgggatatttaagcactgtaattgtgctcagagacatacagattcttctatctcacattgactttaatgcatacacctattgagtatgtatgcttgagttatttgtgtgtgtatttcatttctgggcatccatagcaagttgatgttgacttgcttgtcctacggcttctgcatcctgccatagtcttgccgtccacatctttgctggacagagagtggtgcttgccatatggtaagtcaaaagccatctccttgctaggccagcctgtggtaattagatgactaattaagatatgtcctttcactagaacacttgacttagtagtacgaaagttccaaaatcagcggtctcctgcgatgtttggccacttttaagtttcactgaatttctcctttttccttcttatatttctcttagtgtgaaagtatgttctcacatgcattctacaaggctgagacctgagttgataaaatttctttgttctttcagtgaagagaaaggaagtacagaaaacatgcagaaagcacagaaaggaaaaccaaggttctcatgaatctccaactttaaatcctgtaggtattgaaataggtatcagctttccttgaaaagaaaaatagagaaattagtgatttggctttttgttacttccttttacttttttgtttcttgtttgtttcattttgtttgagatggagtcttgctccatagcccaggctggagtgcaggggtgcaatcatggctcactgcagcctcaaagtcctgggctcaagtgatcctcctgcctcaactgtgaccctgggactacaggcatgcaccaccatgccaggttaattttttatttttattttttatagagacagggttcactttgttgcccaggctggtctcaaacttttgacctcaagcaatccttctgcctcagcctcccaaagttctgggattataggtgtgagccatcacatccggcctgttactttctttatttaaacattgcttgtgtttgtgggtgcataggttaaaggggcctcacagatgaattatgatatggtacccaaattaaaagtaaacttgtacacaaaaaccgtaagaatcaacaaaggagggaattgagagtgtgctgaaaatgagctgaaaaaagaacttggccaacctccatgttccgtgttgttgttatccctgcagagaaacagcctttaccaggcatgggttcagtatccaagcctgagcaaagagattgctcttaaagtttgtcataagggcacagcttaactttctctggctgccggttgaccttatgtctcaccatatcttttcccaacatggtatcaatatatttcagatagcaagaaatacaccgagaaaagaaaccagttgcacttaatggaattattttcttatttggggccagggctcagtgggagttaggattctttaaattaatatggtaaaaaaaatttcaatttgagccattttctggtattaagaataagaatagttacagggaagaaaattttagagtagttatatttattatttattttaataagtctatatgaaaaataacctcaacctattttatgaattctttaggtttcttgcctttaaaaactaagacaatattgcttagtttctggcaaggccggaacctttcagaataaaaattgaatggtaaaagtaaccttcttaatcacttaatctagcttcctaattttatacatcaagcaactgattgtacttctttctgaattaaggaaaaattagaagttcacatttagaatattctaaagatatatttttatttgtctttctctgcttccattttttgctttctaggaaacagtggcaataaatttatctggtaaggcttttatcattttatttcatagagatggcatcctttagagtaataggccaatttcagagtaaaataatgttactaatttcagtgacatattatgggatcttgttatttctcatacaattctacctgctcagcataaagcatttatcaggcagtttgtttaaatttataatgaatactcatagttaaaaataatcaagtaacaataagacacaatagtctgaggcttaagaaacttttccttcataatcagctagatgtattacagaactcctgcctaaaaagatctagaggttaaagtgtactgtagactcaggtattatcagtgtacccaactctataacaacatacatgattccattcagttgttctttgatctgtgatttagagataagatgatcataaactctttgcttatacttttagatttgtgggtcattgatcattggatccataagagatgttataggtgatcttttccaatcctcttaatttataaatgagaaaagaagatacagaaatgttatgtattgtggcccaggttatttaacaaattactgggtatatggcaggatttggagttagaactcaaggttgtcttgtttctgtattcccctagtcagctcttcatagacctttaggacttagctatattctgaagtactataaaaagagaaataaacatggttttcactaatgggaatttcatttagaaaaacaaattttcagactattttctatttttcagatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggt

SEQ ID NO: 36657 - DNA, 30858 bp, Homo sapiens
cggagagccgcgcagggcgcgggccgcgcggggtggggcagccggagcgcaggcccccgatccccggcgggcgcccccgggcccccgcgcgcgccccggcctccgggagactggcgcatgccacggagcgcccctcgggccgccgccgctcctgcccgggcccctgctgctgctgctgtcgcctgcgcctgctgccccaactcggcgcccgacttcttcatggtgtgcggaggtcatgttcgctccttagcaggcaaacgacttttctcctcgcctcctcgccccgcatgttcaggaccaaacgatctgcgctcgtccggcgtctctggaggagccgtgcgcccggcggcgaggacgaggaggagggcgcagggggaggtggaggaggaggcgagctgcggggagaaggggcgacggacagccgagcgcatggggccggtggcggcggcccgggcagggctggatgctgcctgggcaaggcggtgcgaggtgccaaaggtcaccaccatccccacccgccagccgcgggcgccggcgcggccgggggcgccgaggcggatctgaaggcgctcacgcactcggtgctcaagaaactgaaggagcggcagctggagctgctgctccaggccgtggagtcccgcggcgggacgcgcaccgcgtgcctcctgctgcccggccgcctggactgcaggctgggcccgggggcgcccgccggcgcgcagcctgcgcagccgccctcgtcctactcgctccccctcctgctgtgcaaagtgttcaggtggccggatctcaggcattcctcggaagtcaagaggctgtgttgctgtgaatcttacgggaagatcaaccccgagctggtgtgctgcaacccccatcaccttagccgactctgcgaactaggtgagaagttgtccccctacccccaacattttccggagcgccagtgctggaagaaaagcccctagggcagtgcgtttgtgcagccatccctccagggggagtgtgcataccctcctgggagagtgtgcataccctcctgggagagtgtgcataccctcctgggaagagactgggggctgaaagtagagaagggacaaggggaaactcaaagggcattccctgggggttcccttccaggttttctcctgtgttgccccgaaggggtctacgggcactgctcctgcagtctgcggttaaaaattagacgccttcatttccggatcaacaagggggtgcagagggaggtgggggggtcacgcctccccgcacccggaaagacgttgaggtgtgtggccgagttggatttggtccaggcccgccaaggaaggctgggagaggcgtgctataaaggctggaaggtctccgtatttactcctttagtaaatacggagaatcacgtcgaacaccagtggcccagatactgtcgtggccgcgcacctttggagttttggggcaaagagagttggatggaaggccgaactgggtatctgtctcctttcaactctgccagccccagggtgcagaggaacaaacaggcaggagaagttgggtgtcccctactttttccttccttccgcacagataagtctgtagattagtggggccccggcgcctcagtgacgttgtcgcctcttactgcgctggggcctgggcttctcggctgagaccctgaaactcctttccttttatcctctcagctttctccattccttcctttactctacgtctctgtacacagagtgtgatgtgagggttcaccccgggcgcccgcagatcccccacgttccccagcacgcttgggatgcatctcccgagtgcgctaggaatgggcagccccgtgtcccccgcgcgagtgccgagcggaccggcgggggcagaggtgaattgcacgcctggggggcgggccggggcggggagccgaggttgctgggagctgggtctggagtccgaggacggggagggggcatggtcgccccccgccctgtgaactgtgaagtgcgcggctccggccgagccggtggtttccagccgggccagccgagcgcggcggctgcggccgcagacgtggaggagcggagcgccgaggctggcgccaggcggcctcttttgtttatctgacagctaaatatcaaggcaatcaccgcctcgcggccctgcctccaacccccacagctaagacaaacagttgggctaaaagaatgcctctgttatcataagtttctatctctcttctcatggctgggcctttattttctcttgcttttttaatttcagagtctcccccccctccttactccagatacccgatggattttctcaaaccaactggtgagtagatgatttttaaaatatcctgcttatcttaagttagaaatagagcctctagaacgtggctttttgtgtgtaggcaaaggcttggggaggtgctgggcttcacgttggttctaggtttcctctgttggaagtttggtgaatttttctgttgtggctgggttttttgctgtttttgcaaagacgttcccttgatatgctttacattttgttcctttttcatgtatttgtgctgtgtagccggtgggctcagctttaacacgtggaagctttagtccagagagaagtgtcttgggaaccaaataggactggttgatggggataactcggagacttagtgagtgccaggagcatcagtgggaataatggaaagggtgattcgatagatgggaagacggtttaaaaaggtgcaaagaagactttggtctggagtagacactagaacttttcagaagtataggcaacagccagtaaaaggggggggggggtaggttcctcctgctccagtcacctgcaagtcagtcctctcccggggttttctcagtattcgccatagggactatcaaagtttgaagcatagctctgcctgtctgctgctttgtcactggctggcatgaagccatggcagaagcccatttgagactggcaccagccctgttgtggttgtctgcattcaacttctggccggcagcagcacaggggtccatcctctggacatcacagtgctggggacagggtcagcaaaatgaacttgggggtgacaacaaggacaaacccaaattcctggagctccctcttacagtaggagatagatctgtttgctaaaagtacaggttgtatgtaaccttggtttttgtgcctgtatactggtgcctgaaaaaaacattaatacttgggacatttttattttgccaaggttctgggagaaggaaaagtgaagggttgggcaccatttagctcctggaattctgcaagtccttccgcctcctgcgttttggctgttgggcctttccccccactaattaaaagttttgctggggcgttgtcataaattaaatactttaatgaacgtgtaaccgaagcccatactctgcagccagtcctcctgggactctaccagctccctcaagttgggaaggcgttcctgcttgcctggtgccggtctaataagtggcccgcaaagcatgtgatattttgctttcgatttacaaaacaccagataaatggttattaataaggagatacccagctctctgtatttgtaacaaacgttaactggaattaccaagctctgttttcctaaagactgtaacttgactgggttttggcttaaagaatcaagaattcttttatgaagttcattttccaaggggccacctctgacctgttttttttgtccttccatattcttcaaatttggaggttttccttaaaagagagagaacagtgaccttagccccagggataaagaccagcaggggtaaatgttcccagaaacctccaaaaaccatagaaaagaaaggccatgttcccttgggtttcctgcagagacactgggataaatctgttctcaggatttaagcagtcattctgccaggccagggcctcattttcggtgagtggagtgatatatttattcattagcaagtgttgacattaggtagcaaaatgtgtgtaaacagagaagccacaaagacaggaatgtgccatttccaagggggagaaaagttctccagatcagccaataggaagtgattaacctgccaatcggaaactaagacagctggttactcacccaaaacgttttgttgaaaatagaacaaaaaaagaaatgagaaaaggcgctgctgtgtaagaatttagcatcagtaatagacaaagcccccacgaagggaattgtcctgccacattggaggacagccaggtctggagctggagcacaccccccccgcccccctcacaggtctggggctggttttgccagctgctgtggccgggggcattgaggtcagaccacagatgggcgctgacccaggtcttcatccccattttgcgtatgggagaatgtttggcccgggaatctacatggaccatttacattcttcagtttctatgtcccttaggttgaatttttggtcttgggttactagatgaaacaggcacaaagttttacagtggacaactgttaaaatcttaaccagttgcacaactaaaggaatacatcctgtgaagtctccatcttaggaaaaggtggtgggaatggggctggggcctggtaccctgcagcctttggagacacagagggctcaaagctaggaactccattttgctataatttaagccactccactcagcatctgggaggcctggactttagacacctaggtactgtgtggtccaaccaggagagccttctttgaaagagtgttcacatgactgaacctaggggaggccagttgtgacttgtggctgtcagaagtcagaaagacacccccacctccacatcccacaagaagtcagaatttgctgtttaaagctggatctcggggatagctgtgtgggctctgcttcccgtgtttcattgtatctgatggtctgaaaggtttgaggaatggctggccttggggggttgctgggtgagctcttgagggacccaggtggccagtatccatgggcagatccagcctgcaaatccagatcggaagtctggtgtcttgacctgagatctggcactgcgtttctctcttaaccgaggtccctcttaacttttctaggcctcttttaaaatcagcatgatgaaagagattaggtcattcattcatttattcattcattggttcagtcattcattttacaggcatgatgatgtgcctacctagaaatttgaggattccgatgcagtgctgtgttctttttttttccgagacagtctcattctgtgcccaggctggagtgcagtggcccgatctcggctcactgcaagctccacctcctgggttcacaccattgtcctgcctcagcctcccgagcagctgggactacaggtgcccgtcaccatgcccagctaattttttgtatttttagtagagacggggtttcaccgagttagccaggatggtctcgatctcctgacctcgtgtgatctgcccacctctgcttcccaaagtgctgggattacaggcgtgagccactgcacctggcagtgctgtgttcttttataaccagggttcatttgagttctgggttggttgaactacctggggcagagctgggacccttggggtacagtggtgagtaggggctcctctgtctttaacagtacttaggaagctcagaacgcagttgctgagactatcgtgggactcccagctcctttaccttgtactcattctcaatagttcgctccttggctgctccccagggttgggttttcaaagactctgttggagctgctcggagaaaggaatgagtctttttctctcgcagaacctagtgcttaccaagtgcttgataacacttagtgttgcgtgagtcaggagtggcctagagcttctgtctgccagccagcctgggctctggggaacaggcgacacaggcctaaggtgagaccctgacttcagagatctgtctatgcggagcttttctgtgggtgagagatggaggtatggctcctttaaccttgaggccagtctggatggcctggccacctccaggaaagagggtagggactccatagcctgcctggggagtgagagccatgggatagggctggactcttgggaatagcccagctcactgggtggccctttgagctagtcagtgacgcctcagtttacctggctgcctatggaacaggtatactttgcttcttcacaggggtggtagggaggcttaattaacgtttgtaaatccctcttgagatcaaagccactgcagaagggcagagcaccatttcacaaaaatgcttgtggttgcctgtgtggagctggcttacctttgatctgagatgggctgacaccctgaatgtggtctcagctctgctctgagatgcccggcttttcctttgaaacacaccttgcccctgggattctgccagccaaaggtggcggggagtggctgtggataagtcattatgtttaatgtgggggtgtcttccatctgggaggagtgggtggaggagagggttgagaagcctatctctagaaaatgatgaaggccatcaaaatggtttagaaagtgcagggtatacaccatttaacaagtaactccatttcctgcctgcctctattgttttctgtttgattaagtgtatcctgtaaaactgtatattcctgttaggaattagactttaccctgataaaatgagattacacacacagtcttctttccccctacccaccgcagccacctcacccccacgcctgcctccacttctgcccctcgcccgcttaggagagttcttgaaaagttgtccttccagccttgagaatgtgggagagggagtgaccctgagttagagagagaaacttagcattaagagggcagacagcagaaacccagagatggtttggggctatgtgtaggccactaaaggattcccatgggctacttgcccgtctgctctttttttttggctttcctatttgccagcatggccaagtggttccaactggaaacccacagggacattgtcctggtggcctggggtaggaggcctggtgtctgcacgatccaacctgttgtgtttgctgcggacctgggcagcacctttccttagccgggctctccgctaggacttcagggagtttggcgctgccagtggtgcatgacaagcttacagggtcttgtgtatttgtgtttcatgggactaatgagttgtggttcatggacattaggttttgctttaattgcttggagggcggttgtggagactgtttctcagctggaattgtcattatcctcattaacggtgaggtcactgtgcagagtacctgagggtgacagaagttgaagagaagtctagttaagggcagatgcaatctaaaggtaaaaatcagtgaggaaactccgagtgttgggtgccaaatgttttataggaactgagggcagagagccttagcaggtctggggttgcctgggaaggtttccagagatgaggggtttggactagcctgggagaggtagaacatttcccctccggctcggagccttgctgagaatgttctctgtcttgatctggtggtggttacacagatgtatacatgagtaacattcattgcgtctacttgggattttgtatactttgctctacttaagttagtcctcaattaaaaaaggggaaagaagtcccggcagcccaacatcaatcttgagaatgttttcaagaactgggaaacctgtctttaaaaggatgaaggcagagaggacatgggctccaaggagagagccttctgcccttgatgagggatgacagagcaaccagggttgagaaagtccaacccaaacctcctttgaccttgggaaccacctggtatccgtaatgggggactggtaatgcaagagaaattccagccagtctcattgagcctgactcgagtaatgattaactggctgcccggagcccagacgggtgacaaggtgctgtggtctgtcttacgatgggcagtgaagcctgagcagaccattaataatcagcatcaaggccgcgagtcagccttttggaatgtgtggtttgtctttcatgctgtttagagcgtgcttaaagatggatcttggtgtttttatttgtgtatttatttctttctctccccttttcaaatccacagcagactgtccagatgctgtgccttcctccgctgaaacagggggaacgaattatctggcccctggggggctttcaggtaagatgctttctcttattttcctggcaattccaaccttttttgaaattgctaaagactggaggaatgggggtggccttctgccaccccagctggtctggacttcattctcatttttatatgccttaagttggatgcatcggtggtgacattgtggtgcccttcagctcctcatcctgcagtcctttacgctctggacactggatccgttccgtggacggggagacaagagcgagctggggattgctttggtgtgtgaagtgttgcccggttatttttaagcagctcctggcttggggggcttcagcttggtgactttggtgtcattaactcatgcatttgagctctttttttgcttttgctctttgcgcatgggggatgtaaagggaatggacccacctttagggaacttgttgaagacagatcccaagcatacgatgggatttcagagtagatctgaggcttccctcccaagttctgattcccagcccagcctgctgcaggattttgcagcacatgtctggggctgggagcaccagggtgggagcactgccaacagtaggagctgtaattgttccctagcggggcaggttttcctcagggctcacaggtatgcgtgaaggcctggaatgccagtgctggggggtcacggggctggctgacaggcacggggtagccagagcattgttgttcctgaggatgcgaaaagagggcagtacttagagaaactcactggttatgtacatgggacgcatttcatgttgttctgaagaaatcctatttctacctgtttttccatccccaccatgtcatcactagattttctaagaactggctgaagcaagagggaaaacgaccttaaaaacagaaattccagcagagttttgggcatttggcatttccttgcctgtaggatcacgtggtagcagctcgaatagaagctgtgccctgttgtggtgtatcctcttgtgtgaggggcacccttttttgtggggtacctgctctgactacttggtggtgtgtcttccatggctggctcaggcaaagttcattcccggacggctccctccccggctctcctcttcaggaactgagcttgctgagaacgtctttagggagacccttgtttgttttcatttcaatgcaatatatactctgttatctgagactgagggtattgtttactcaaagcttctaatgagaattgagcaggaaaaagagggacctagagaagggagggggcttcaggcagtacggtgggagtggacagaggagttgaggagggagaaaaggcagcagtgtgtgaactgcatcttttctgctttctaaggctgagagagttcttgaaagaaagaaggccaatgagaggaaagggtctcagcagaataacacgctcaggatgttgttagatggttttattttttaaaccctgaatgtgcagggaggagccccggcccctccaaaccacatgaaataagcaagggaagtggcagcttttgaaagggtcctttcggaaggtttgtcttcttgataacatcttgtctgtctcccctgccggaggaaatgacgacaccaggctgagataccagcctgagtgcctcctcacccgcccgtgccatgtgacctgtgaagccctcaggagatgggtgggcttttttttttttttcttttttgacaaagtctcgctctgtcgcccaggctggagtgcagtggcgcgatttcggctcacacagacggagtctcgctctgtcaccaggctggagtgcagtggcccgatttcggctcactgcaacctccacctcccaggttcaagcaattctcctgcctcagcctcccaagtagctgggattacaggcatccaccactgtgcccagctaattttttgtatttttagtagagatggggtttcgccatgttggccaggctggtcttgaactcctgacctcggatgatccacccaccctttcctccccaagtgctgagattacaggtgtgagccactgcgcctggccgatgggtgggctttttttccccaaagctcttccagtcctagaaagaaactgggggtaaaacaatcattaactccttcccctcacccctccaggtaattgtagacacagatattaataaggagctgccaggaagaagcagtgactctctgaagggcagtgtggcttcagaagactgcagagagaagagggggccttccacatggcaagagcatttgttttgaatttcagctcttgatttactaattccaaaggcttcaaagtttgagctccttcttctttccgttcagagttggtgcagtgtattcataatgggccatggtggggagggtacactgttttgggggttgatgtcaccggcttgggggcgtctggaggggaggtgatgggcacggagaaaacctagggctgtcctctttgtagcgagaatgccttccaaaagggaactttattggcccctgtccagggcagagagttttgtaaatggagaaagcccaaacctcctccttttcaagaagttgatcgttccatggggggtggcctgggtgtgtctgccttgctgtggatgaggccagtgactggatgtggcagggctggatgggggaaggggcatagcagacactgaggttggggggtgggagcctggcagcaaggtggggagcagtgaaaactgaggagtttctccctcctcctccttgaaataacctctctgagcctctttcacaggccctgtgtgctgttttccttcctgtcctgccctggctgagagcgggcttaatgaatggggctcagtttagggtgggaggaaggtcggcagcaggagccagggcttgattctcttggcaagggaagaagggaaagaaaaaacagccgaatgtgaaaatgtggtgcctcggaggtgggggtggggtgtgctcaaaggccggtcctctcctgaaatgcaggggtgactccaaggctggcccttccctttcctgcgcccttgcaaactgcccgggaggaaggggagtgggcgggtaggagcccgggggcggggctgctggctgcaggttggaattccagcattgcagctttgttttgggggggtgtgggggggtgggtagacgacaggcctggtcgttagggacttgcagtgaaacacaccccacccttgcaagtttcctcggtctgggaaaatgggacatttttagaaggcagtgacttgcttccaggagattgtactttcatttttgacagctggctctctgagacagatggattgctgggtgcaagcttgtgtgtgtatgcgtgtgtgtgtgttgtgggggtgggtgtgtgggtgggtgggttttgccgcagacgtacagatagacaatcccgtgcgcaaacacatgagagcgtgcggatgcccacaggcaggctctgggatagggtgggtccctgtcgctggggtgggttgatgtcagggcggcctctccaagaggttgtggacttgtggggtggagtttgtggattgattctgctttgtgatttggcagtctgtgcctgactctctgggatgggtgtcttttgaaaggcatgcaactccagaacaggtccttgctgctgcttggacatggatgtgtcatggctcaggaagatcacctgggagaggtctgatgtagctgggaagcctctaggctcagctccgtcgtggagatggaaaggatttgctcccagagctttccggggatcactgggaatgcagagcatgtgttggaagctatcatctttgcagcctccatctggagtttctgtctgggggctttcattttgcctgtctgctgtcctggtttgagtgggttgagggagcagcatctcccttgtgagttgtaggttattcagctgcagactcatcttctagcctcctcctttatatatgaatgtctggagctggctgggcctcagccatatggacctgcccagttagggtagggattggaagccagcaaccacttgtagttatttaaacttcaaaagaagtgctcccatggatctcaaggagggaggtaggaggcagtggagacagaagtgctcacgtgtcctgggaaactccatctcttggctgtgcgaagtcatgcttgttggagagacccggcaccatgcctccaacccaagggtggccaactctttgcttgagattcatatgtggctactagtccccaagtctgggggatgggagcgtccttgagtcagtatccattcagcatccaaggatgtttctgtctccttctctttgatccttgctggcatctgtcatagtctcagaggagagccttcaaaaatacctatataatctgaaaatgcacccctggctcagtccacagttgacttgggctcaaaccaagtagcttaggaaacattgctccatcctgttttaaggaaagttaatcagctgcacgtgaacaattattcattgtctggcttggaattgtgatcatgaactgggaacctgggcctgggcgcctgttgctctgcttttaaattaagtcacctccccctgcctggctacaaaacagctcatggtttcactgaggtctctaatgccattgtggagtgagggcagggggcacaggttgagctcacaggcatgtgggcctttcatccaaatgctcatgagcgtggactttgggggactcaggtggacaggtgcttgtgaccatgagcaagctccttccttcccatccccttagtaccctgcaggccactgtgagaaatgacggcctagaactcaggggacaccttctgcctctccttaaacacctgccaacaggatgagtcagggctggggcgggctcacctggtgcacacccacaccctggtgaagaccagtcctggaccccgcctcttctgcagtgccccaggtcatgcacttccccctggagaagggcttactgataaaaccccttttgtcctggaaagaatgaggcagtccggcaggggttaaatacagggtgacagcatttaaaatctctggagcaaatttgggctgctctgccggccagacaagatggtctgctgccgcctcacgcatcctgtccccaggctgaactgggccagcaaagggagagggccaggtgaaggccaggctttgggtggtgtcacttttggtgacactgtagcatgctgattgcccctcacttcctacacacacacacacacacacacacacacacacacacacacacatgcctttacttagcaaagcctgactgtagctgcgtagacttgtacacctatgggacctccgtggcaagctcagagccggtggagcagtgaaaagggaggaaatgccgaagaattcatgatcaagtttggcttcctttgcttctttttaaaattttttaatgttttaattttttttttttttaattcgagatggagttttgctctgtcgcccaggctggagtgcaatggcaggatctcgagtcactgcaacctctgcctcctggattcaagggactctcctgcctcagcctctgagtagttggattgcaggcgtgcaccaccacgcccggctaatttgtgtacttttttgtagagagagggttttgccatgttggtcaggctggtcttgaactcctgacctcaggtgatccgcccgccttggcctcccaaagtgctgggattccaggcatgagccactgcgcccggcctctttgctcctttattattgttgttactgtgtcataattccttgcagaattatgatggccaggctggtctttacttccttcggtccaggccttgaactcggagcagcactctcaaagcagttgtcttcacctggcagaagaaaaaaaaggtgtaaagtgctggttcctggacttgctcgcacactaaaatccctcgggattcagcttcccagataactttcttgcttctttgtagagacatttgagagaaaactattattaactatacatggtccactgttttgctttgctgtcatgaatgggattgtaaaagggacccatgggaccgggtttccttttgggacgatgaaaatgttctggaactgtagagtggtgatggttgcacagttcaccgaatgtattcaatgccattggtggcacattttaagttatgtgtattttaccacaagtttgaccaaaaaatggccagcggtaggttttaaatacatgtagatacttggataatctataaggaacagtgattgtggagagtaaaattggagagacttctgttagttgcctaggacctgatgatggtagacacttgttttggtggcagccctgaggtcacatgggaagtacattgatggaccagggagcaaggctggtagcctgcctgggatctcgtgtgtgtgtgtgtggtgtgtgtgtgtgtgtgtgtgtgtgtgtgtgtgtgtgtgttttgagatggagtctcactctgtcaccctggctggagggcagtggcgtgatctcggctcactacaacctccacctcctgggttcaagccattctcatgcgtcagtatccctagcagctgggattacaggcgtgccacaccatgcctggctaatttttttctagtagaaagggcgtttcaccatgttggccagactggtctcgaactcctaacctcaagtgatcctcccgacttagcctcccaaagtgctgggattataggcgtgtaccaccacgcctggccttctgctgtgtgttacctgagcaagcagacacatctgtgctgatccttcgaccttccttttttcttcgtgggttccagaaatgagagacaggaaagttccctctggtttgattcccggcctgacttttctgctgggggaagtgaatatgcttgttctcactctgcggggtccccctggcctgcccatcccagtgactgcgaaccaggatggtgccagggttggctccaaaagctggtgatccagacccttcctgggcccctggagaccccagtccctgtgatgtccttgcccaagttctagggctgcagtggccgtaggtgactggcccgggcaccctccctttgcgggagcctcgtgaaaggatactgtaagcacagccacagggaggtcaccactggccctaccacctctcgctcggtattgaatggctagccccaagcctggctgcctgcctactgtcacacagaggcttcctctccgggctattttcagcgggaagatattattaactgctgaggcacagttctcaatttagtggttaacacaccaagaaagcaacactcacctgatcccggccactctacctaaacctgttggctcacttgggggactcggctgccccccagcctctctgtttctctctgtgggttcacctgggagatgtgggcttccactcccgtggaaggtgccccgtggattcagtatctgctagagagagaaccaggcttcttacgaagccaactcttaaaaggtgtagaaaatgatcgtatttatactctaagatggggacattttttgataggggtgggcactggctgggaaaagggactttcagcggtgttgaggacagttatttaaaacagggtgataactttcaccttgtaagttaacaggaaatattgggacaagacaggaaattgcatcatctttttttttgagaataactccagagaaaagtggttcgtgaaaggtagtggctgagaaacggctagcctgttttctgttttgtgttttttttttcttcccttccactcccacgagaacatgtaggccattttctttaagaaagaggctgtttgagaactttatgttatttttattatttaaaaaaatattttaccagaagggtcaccttcagttgaaatgttaactgccgccttatttcccattttactaaagaatctttcatgactttttcagcttccttccccaaatggtaaggccaagcagctcttggctggaagctaattttggtttggctggggagtcctcaacactgagccccacccagtgtcattagctcagttttaacttgcaaaaaaaagattgtatttttttttttgatggggggtacgtaagaatttactcacgcctttagcctttttacccacccccggtactgccttcccctaacagaggcacctggcacttagccgccgggaactcagggctgccttcgtgttttcaagccaccgtgtccccctcatcctgcaggagttctgtaactttcctgagactatttctagggtgctagtgaggagtggaggggaaatgggtctcggagctgccctggtacagctgtgtccagtaacggtgctgtgctttggaggaaggagtgatatggttcacctagaagcatctcccagagagggggcttatcacagccctacagtggtgcagataaggtccagttccattttttgtctctgggtttctaaatcccctctttgttgatgtcattgttctaatgacacagggcatgggacagtgccccggcccgtgctgccaaggagccgtctttaggacagagaccagaaagaaagagacctgtgtgtgtggctggcccgctctccactcacgctcacccccaccctcccagctttttccttagcgtgctttgttttgttttcataacacaacaagggccctggggtgtgtaaaagcattgttgaacacttggtgagggcaacttgtccaaacagagcaggacgccaaagcagaatgctgtgggcaggtggtgtgcccacagaggttggtgggccggcgccggccttggaaacacctctcagtggcatatgccgcggcggctgagtgtgacctagcgcagaacagggcttccctcttgtgtcctccgtggggagtccaggagagggacttggtccttctggctgactccgtgcttggaaggtgtgctcccctctcaggtgggttcacatgtgcctccctctgccgggtgtgaagctaggtgggcccgctgctttggaagaagccagtgtgtccctgtggtttgtttatggagcaaatatgtattgacacctattatgtgccaggctgtgtgctgtgcagaggaccagttcctgggctgggttagaattaagaattggcagttggaatggcttgtccgaaggtgatgttgaatccatggggatggagccggcgggaggggggattgactaggagttgcctctacctggaggcaggcaggggcagcttctgtaggacagaggagcctggtccctccatgaagccaggccataggtgggggaggtgcagggtgggccccctgggatgggcctagctcttgagtcatccacttctacttctgctttggttgtgtggtctgttgagaattgagataaagcaaagcttgtggataaacagaggtaggtctcccgggttttggttccagcccgcctccccaccccgcttcttgctgattgtaagatgacagcaggaagaacaggagctgtggttataatccaccctccagaccctggtagtacctggggcacagcacagagtggaagtgaccagcctagcgccaggctcctcagtggaccacggccaaggggtggggaaacatctggaaagacagtatctaatgtcttgacagccagaggagaagtgggatgttttcaaagcccaggagtgactttccctttgtaactccagaggacttgattcgcaacgaagaccatctgggggatgaaggaaattcttgctttttaattttaaatctgagggttaagcccgtttctgaggtgtcagccctgtgtgtgaggccctggcctgtctggggttgggtttggatgaaataatctaagatgcagttaccagggtgtttccttttcacattcatccttctctgtctgttcccccggggccaaccgatggcttccaagctctgtggagttcactaattgaattactcttctcgctcctccgtgaagccccaccaggaagaaaaggcggggagagctgcttttgctggggggtttgatcagagcagaaagggaagatctggtctcaattccaatttcatcttgcaaagtcgggactttctttcagccagaagacaactcagataaccaggccagcgactgtgtgctcatttcagtattgctttcttacgttttgatctgcgactgtcactcaacaggaacaaaaacaataagacgccaagatatgactgtgccgttggcagattagctgtctgcattttctggggtggctcactcggaggttaaatgattgtccctgtcccctgtcccaccttccagtcacctcatgaagctgttaagtgtctccttcccctgcaggctaagtgaggatcatcaagagctgggcctggggaccttgtcagcctcactgcagcctctgagccagccctgccccaccccctcatgaatcagtaaccaagagggaaaattaaaaagttagttatcagtgtgatctgagtgcaccataccgttcttacaaatagatgggccccatctcctgctcagtgggggcacaatcaaaaccctgctgggggggctgttttctggggaagagcccaggatcgtggggcctgcaaaaactcagaagcccccccaccttccccccagggtgtccaggatgccctagtcccaggagggggctgggagagaattacaatgtcggggccagcatcctccactttcctgtcactagaggctggcctgctctcctgggttgaggccgagtgtctcagcccctggctggccacatggccttgcaggagccatttctgtgttctgggcctcagttttctcatctgcaaaataagggcttgggcttggctgccaagtcccttcggtgatctgtgatctttgtctcttggatttgaggggtgtgggaatgatccccctattgatgagatatccctatggaagccaaagactgcttccattttaaaataaaaaggttgtagttctttctgtctcttggctcgcaaactcttccaagtatgggtgaaagctgaggactctgttcagaaaaatgcatgctataccacaatttgtatacatctgcagggggccgatatctttgctgaagcccagtcccacccgtggaatccccagttcaggaaatctatgcttatgaggactagttatgggggtgcaaaggagagccttaagagagctgaggcctttttcttttattgtggtaaaatatacataaaatataccatattaacaatttttaagtgtatagttctgtggcattaagtacattcatattgtgctattatccccaccgtccacatccagaactttttcatcttccctagctgaaactttgttcccatgaaacactaacttcccttctcccctcccccagcacttggcacccaccattctttctgtctatgaatttgcctcctcctctaggtacttcatagaatagtggaatcagacagtgtttgtccttttgtgatcggcttatttcacttaacataatgccctcagggttcatccatactctagcgtatgtcagaatttccttcttttttaaggctgaataatattttattgtatgaatattccatgtctggttgatttattgcttgatggacacttggcttgcttctaccttttggctattgtgaataatgctgctgtgaacatggatgtgcaaataccactggagtcgccgctttcagttcttctgggtatatacccagaggtggaattgctaaattacactgtcattctgtgtttaattttttaaggcatcgccaacggtagggcctccttgacttgtgcctcatgtgtcggcacacaccgatcgcatgcggtgggggagccctacccaccggggtgggcttgagggcgaatcctggggcagagggagtgagaaagcggggaggggacagtctgtccctgcgcggtgggggaggggcagtgctgggctgctgcagtcaccagccagattggagctcacatttatgggagcccatgtttatgggaggcctggaggctctgaaaggtggggcacccagcacagagcagctggccgtgtatgttggactccagggccttgtgacagcagcttctgggtgggggaccctttcattcttcttttattcccttgacctcctaactggaggttaggagtgggaggacccgccagagggagtgggggcttgggtctgggaggtcctgggtgctttaggggtgaaagggctgggatggctgaacagtgagtgtgtccaagcgggagagattagattacggaggcagacagaagtaatgattaacttttccagtctgcacgctgtctccaggctgtcgtactgttgtttttccctctaagtacagtgcggccctggcctggccaggccctggtattgggttgtaaagtgagagatggaatgagggctgggagtgcacggggaggggggccagggagggagctcgcaggagaagaaggagcttttccatcggatcctgcattggaatttattggccggaatgcagtaaatgttcaaaatgccatcccatccaacagttttcataattgttatggaacaaggggagccgggggaggggaggaatgaaaaggacttttgtttctcactgtatttttccatgtcttcggacagttttcctaccctctagaaactggagtggagttggatctgtgggggatagggtgggagaagggtctgcctttgggtcctgtgatgccttccaaggactaggggtcctggtagcctggggctttattaaaacgaggcccacagcaaaagtagcttggtttcttgcacacacagagcccccccaccacctgcaaaaccagggaaaaactgtcctgtccttctaggggttttgtccttttggaaaattggcttaatgatgcagtggtttgtattaagattttcatgatgctttaacgtgtgtgtgtgtgtgtgtgtgtgtgagtgagagagagagagagagagaaagagagaaagagattgagagagagagagagagaatgaatcagcattcagtgccagctgcccagttgggaatccagatagggaatttggggaatctcctacactctcagggtggcaggtgggtaggtgggtgaggtaagagacttgacttggtagtttctcttggacacgacagactttctgttccatgcttgtcccagcccttgtgtcttcctgggggtgccagggtcatgcccagagggaaggcagctgagcagacaatgccatgcagggctgagggcttctgtgcctgctaatatgtgaaccccctttctgaagagagctgctctgagttacttggggggtaacagtgggaacctggttggtgtaccatggaggggaagtatctggaaatttgaactcgagaaatgattcgactgcatgcacactaaacagcagccagagaggccctttactgtcaatattatgaatggagttggctgggtcgggagtccccacccttcctctgaggcctctctcagaggagcctgggcagagtgggcctcctcagacagcagtggctgcaggcagctgggtacacgctgtaatttgcatggctgaatgctggggcacaggaagccgcgtcagcctgactggcgagacagacaagagcttttgatttgtgtggctttcctcccctgccccgtgccaccctcaattacattctccatggcgagataaatgctcttaggagcattcatccccaggttgggggcttcagactcagatgcttggggggttttgggaggtggtgtgggaccagtttggggagccagggagtacattttagttctaggaattgattatttaacataatttgtaaggacacagtcactaattagtgttctagaccagcaggatctgcgaaatatgtaggcttgggagaggtggcaaggagggcggtgatgggaggagaaacttcagggaaccaagcctgggcagacagtggacggatgacagtgataaaagagatcctctcttgggggctcaccgtctcttgagggtgatgaatagtaagacagagtaaaaagtcatttctgactctgaaattaaagaaaaaaaaaagttggtttagagatggacacagcaaaacctgactcaaacctcctttcccttttgattttattttgttttattgttgcaaattaaatgcaaaaatgtaccctgctcctcaaagtggttttcttactctctggaaggtagtaaaaataaatggaaccagtgttgtttaatactgagaatcagagtccagccagagaccatgaaggcagaagggggcccatggggccatcttcccttgtcccctttacattatttatggacaggtcaaactgagaccctgagagggcaagccacttggccaaggtcacagagcagcttgctggcaaaaaagccgtatcaccccccacttcttgctgcaggggagttgcaccccatgcgcagctctaaaagctggtgcagcatttccaaagtgtgttctgaaggacactttggagaggaacagtgggcttggtggctttagaggcctgtgtccacagctcacaccaggcaatattctgggcttgaattgcagctctgcacttcggccagtgacttgtgcctcacccctactactccctttttttaagataggctggtgatagtatgcagcctcagagggttgtcatgagccacttagagaacacagcctatgcaaagtaaatgcttattaagtgtaggcattggcccagaactgttctaccatggggtgtggggatgtggagacaatcaggaagactggtgggcattttctgagcggctggagaacccaggagcctcagagatgagaccaacgtgtgtgcagcactctccacaagctggccccaatcacttttgcatcaaattggtacagcaaccttatgaggctggccttgggggaaccctgttttagggatgagctgaacttaccgggaggctgcatgcgaggttggtgtgaaatgcatatctggctttgtagctggtcggctcacctctggggttggcacaggggcgggggttctgccatggctagaatgcgctaaggggtggaaacgaagcctgctgggcccgggaaccagagagcagcctggcctttgaaggagaccctgtggcaccccctgcccacccccaagtccagccatctcacttcactggagatgctgcaaagcatgaaaaaaaaaaaatccagtgttctcaggtcagccttccaccagccaggattcatcgtctgatctgtttggggagagagcatggggtggtggagatgggttgggccccagtgttttctgattaactcgcagtttacctgaaacattttggtttgtttcctccatgaggaactcactctaaaccccagcattgtctgtgtttcctgaggagtctgagggagctctggggtcctatttcctcttttggatgaggctgtgagcatggtggattagagacagccccttaaagttagcccagatatctcagcaagttttacgcgtctctatttgggggagggattcgcctattgaaaacaagagaccagcaagggtccttgtgaattatgatggtttggcgtgagaatagatgggatggattggcactggagtccccttttatcttaggcttgtccctgaagagggcttgttgatatcagaacagccaatttcctgacagggttgggagcaggggatgggtgctgttaacctttgagatgtccgttgtggagggagagacaggatgaggcaaccgttggtggcgcctgggtcctgaggagggaggaccctggacctggcgttagcgaggcgtggtgatgtttgcgctcccaggttgccaggtgcaagctgtctgtgtccacatttctgcccttcatttgcccctgattggcacagggagcctgcaggaggcggccgtgcctgcccaggcgcccttcctccccaacttctccgtcctcagccttctgctctgctggaccatggaggagggggctgataggcccgtggccctgttggactttggcagaggaatatcacttcattatccaagtgcctcacagagatgagagccggtggagacccgtcctcactcgcctttgaccccagctcccggtaccctagcaattgggcacatttaaccgtgggtcatcagctgatggagctcatgtctttactggcttttttccccaagcttgcccttgttcctaaatggaatcttgggggaccccctccccacaagtacgttctttgtgtgtctgggcccagtcaggcccagatagcttctcttccacgcgtgcccgtgttctcataaccccatggctgttcttggagctgctctgcctctctgccctctgccttcaggtggagaatggtattgttgaggcactgagcaaggcctttcccccctcctcccatttttcttctttctcatctcctgacgccttcaaattaaaaatttaagaaggggtctgggtgcggcggctcacgcctataatcccagcactttgggaggctgaggctggcggatcacgaggtcaggagatcgagaccatcctggctaacacggtgaaaccctgtctctactaaaaatacaaaaaattagccaggcgtggtggcgggtgcctgtagtcccagctactcgggaggctgaggcaggagaatggcgtgaacccgggaggcggagcttgcagtgagccgagattgtgccactgcactccagcctgggcgacagagcgagactccatctcaaaaaaaaaaaagaaaaacatttaagaaggggaaaattccttgcttaacctaaaatgtggccttgaggcctggtcaccctgtgccattgagacctggggtgtgaggttcattcacgagcctctggtctcctggaagggtctggtctgttcattcatgagcagggtaattaaataactctttgtaagagtcagggagctccttgctaagtggtcttccccagttggagcgcaaacacaggctgaagtcctctcctttctcaacacccacctcccccttccctttaaagggaggattttatgctttaagggaaatggggaaggttgggggggggcaacaccttaaaggaattttaggcagattcagcatttttctggtgttgctccaaaaattccccacactgtaataaaaagatacaactgtgagcaggcatctgattagtgagctttttacaacacagcttttcttttggatgctttaaaatgaacacatactgttttaaaacaagcccctgtacagttttctggggagggggagaagtttgtggaaaataccggaaaaggttataaagctgagggaaattaacaaaggactgtgagttttgccttcagaggttaactatcagcgagaggccaaggctcttccttagtccttgtactgactgaacttcccagcccctcgacacgtggcccgggaagtccctgggagcaaagcgtccacacagacctttgtggggagactcgtgtgggctgtgggcccgattcagggaactgtgtttctgtgaagatgaagctgagcatttcccagaaatgagcccaaatggcggggaattcagggcaaaggggaatctctgtagtggcaatgggggatgtcgtgcggggtccccagaaggtgtgatgtccacacaagggtgtgtgttcgaggggcctttgctgttgccgaatggttttgctggaaagcttgttttttgtgtgtgcttagagatagtcccggcaggaggagactggagctgtcctaacgggaggacagaggctgctggtgggggagctggaggggacagcgagggaggagcaggcaggagtctccctgcggtgggttagggcaccaaatggacttcagggcccttgttcacacacagcagcattcacgacatccatgcattgcagtttttctgggctgggccattaacctcagcagaaaaatgctttttccagggggtgtctggcagcacattgctggcgggctgcacagatgaaacagaaacccacctgacacttccccgtcctgctacagatctcaggctccagtccccacccagcttcctctgcccccagaggcccccacccttggcagacaaggcttccaccccttgcctaggtggctgacaggcctggcatgggggcacctcgatctcaggtccatactccactcactcccttgctcctcctcctcctcctcctgttggccggtgccaggtttcagtgggtcctggctgcatgaaacaaagcattgtgaggctctgctgagggtctcccacccaccctccctcccgcctccttcccagcagctcctcgagtcttcctttccaggccaggtttgttgtcccgaattgggaaaataagcaaaagcttcttgtgtttcagaacaccctcctccacaccaaaagggtggatgtgctgtgcctcccggaagagggctttctcccccgcttcacacttgatgccaatgtgtccttccttccctgggcgttcaggtctttggtgtagccttcagagctgagttccctcagcaagaaagttcaaagattgccagcgctcacaagtttattagcagttgatggatactttgcagaaacaagtgaatgcctgatgagtcaccttctccctgtccctgtcttgttttccatatgttccagtacgtatgtgcacacagaaacacacataacacacactcgtacacactgacatcatggacacagtcttgcacacgcacatgcacaagcactggacttccaagctacatggggggtggtgaccggccagttttctggtgttgatttttagtgggggttgggggttgagggaaaggaatgagacctcagtgtcccctttttgtggagcttttggggcaggcatttgggaaggccagcttggggtgtctgtagggaaccgctgctctgggtgtgtgtgtctgtggctgccccagcaggccgcagtgtgcacatttgtatggccttactgacgggcacctccatccaacactggctgctacttaaaacaacaacaacaacaacaacaactgagtggagccagtgggttcccaggtcctaacacgcctgtaaaagttggagccagttagtgtcctgggctgccccagttacccagcctgctggggcagcaggatgcggccccatcttccgccatggaccccctgcagggtgcaacccatcatcattgactctgaacccagttactccagaaacacaaaggccacaccaaaacacatctcacactcaacccctgctttgtgccccccaggtccccaagaggaggagctggggctgcagggagcgagggcaaggccctgaccgacgtggggcccttcccctctgcttttccccctctgctgtccccatttttgttaacaaatacaagacttccggtctccaccctgctgccacaaaccacagcgttcctgcagtctggctgggctggggagatttatggtcccaagtctgaggcctgcccgctggctcctacttaaggaggagtcagaatgcccgccgccggggctccctttccctccgtgtgaccccccttttaaagtcctccaagtgcctgttgaggaaaattaccttaccagaatcaccccggcccccaggctgcctgtgggaagactgtgtagggaagcggggcggggcctgcaggggagggatgagggcggagcagggcgccctgcaggctccagatgcttctgtggaaggaggggagagagggggcacccctggggatgggggtgccggcagagaaggggagaagggggacgcatctatttgagacacataatcttctgtctgggctggaggaagctttgttaaggtagcccgggttaataccggtctgcatgttgtgatttggcattttgacatgaattcaccctttgtgtacagggctgctgctgacacactgagactgttttcctattaggaatatagatgtttttgtcccaagccaccctcatttttatttttaccagataggttcctcatgaccacggcactgatttgagagctgggtgacaggcacccagagaccatcgcataggtggtcccagagtctagacacctgggttctagctctggctgtgtcatcccctggtactccagcagcaggctttctgggtcctggttttctcatcaggatgacaaggggctggaggagctggccttcaaggttccatccagttgaaagatctgtaactccaggacgttgctgaggctttttgaggccctaaaagcagactacccaagctattaagggtccctttgcatctgtgctctgcagagaagaggctttgttggccaggtgggcacagatgctggtgtactggactcctgatgggcaggggcctggagagaagcagcacccagcgcttcctatgcttaaagaaaggcagggtcctggtcaaagggctgtaagagcctgggcaagtccaggactagcctcaccgcctccttctttctgtctcgtcctgagagatgagctggtgactgggtgcagtgggggggcgggtgtcttcattctaggagtcaccaatgcctgtccccactaaccctctctgccaatgtgttttctagattcccaacttcttctggagcctggggatcggtcacactggtgcgtggtggcatactgggaggagaagacgagagtggggaggctctactgtgtccaggagccctctctggatatcttctatgatctacctcaggggaatggcttttgcctcggacagctcaattcggacaacaagagtcagctggtgcagaaggtgcggagcaaaatcggctgcggcatccagctgacgcgggaggtggatggtgtgtgggtgtacaaccgcagcagttaccccatcttcatcaagtccgccacactggacaacccggactccaggacgctgttggtacacaaggtgttccccggtttctccatcaaggctttcgactacgagaaggcgtacagcctgcagcggcccaatgaccacgagtttatgcagcagccgtggacgggctttaccgtgcagatcagctttgtgaagggctggggccagtgctacacccgccagttcatcagcagctgcccgtgctggctagaggtcatcttcaacagccggtagccgcgtgcggaggggacagagcgtgagctgagcaggccacacttcaaactactttgctgctaatattttcctcctgagtgcttgcttttcatgcaaactctttggtcgttttttttttgtttgttggttggttttcttcttctcgtcctcgtttgtgttctgttttgtttcgctctttgagaaatagcttatgaaaagaattgttgggggtttttttggaagaaggggcaggtatgatcggcaggacaccctgataggaagaggggaagcagaaatccaagcaccaccaaacacagtgtatgaaggggggcggtcatcatttcacttgtcaggagtgtgtgtgagtgtgagtgtgcggctgtgtgtgcacgcgtgtgcaggagcggcagatggggagacaacgtgctctttgttttgtgtctcttatggatgtccccagcagagaggtttgcagtcccaagcggtgtctctcctgccccttggacacgctcagtggggcagaggcagtacctgggcaagctggcggctggggtcccagcagctgccaggagcacggctctgtccccagcctgggaaagcccctgcccctcctctccctcatcaaggacacgggcctgtccacaggcttctgagcagcgagcctgctagtggccgaaccagaaccaattattttcatccttgtcttattcccttcctgccagcccctgccattgtagcgtctttcttttttggccatctgctcctggatctccctgagatgggcttcccaagggctgccggggcagccccctcacagtattgctcacccagtgccctctcccctcagcctctcccctgcctgccctggtgacatcaggtttttcccggacttagaaaaccagctcagcactgcctgctcccatcctgtgtgttaagctctgctattaggccagcaagcggggatgtccctgggagggacatgcttagcagtccccttccctccaagaaggatttggtccgtcataacccaaggtaccatcctaggctgacacctaactcttctttcatttcttctacaactcatacactcgtatgatacttcgacactgttcttagctcaatgagcatgtttagactttaacataagctatttttctaactacaaaggtttaaatgaacaagagaagcattctcattggaaatttagcattgtagtgctttgagagagaaaggactcctgaaaaaaaacctgagatttattaaagaaaaaaatgtattttatgttatatataaatatattattacttgtaaatataaagacgttttataagcatcattatttatgtattgtgcaatgtgtataaacaagaaaaataaagaaaagatgcactttgctttaatataaatgcaaataacaaatgccaaattaaaaaagataaacacaagattggtgtttttttctatgggtgttatcacctagctgaatgtttttctaaaggagtttatgttccattaaacgatttttaaaatgtacacttg

SEQ ID NO: 36658 - DNA, 6937 bp, Homo sapiens
tgggaatccaactgaagagcagccagaggagagctgaagagaggagggggaggccgatgacctgggctctgggcctctgaaggcaagtaggggtgcgtgaggtggggggccgtggtgtgggggtggtccgccagggtggaccggctggcaacctgccccccggaccctgacagcctggcaacgaggagacgatccgttcggagccgggcgctagagagaggtgcgcagtgcccgagatccctggctatggggaggcggtgactggtgcgggccaggccggaccaagggctgaggggctggctccagaggcaccgtcagatcgtctggaggagaaccgcgctgaccgcttcccagccagctttgcaggcgcccgcgcgcagccctcgacggtttcggtaccgagagacggctgtgggggaggctcctgcgggagaaatggccaaacgggagccgtgttggggggcgcccgggaggcagttggggggcgcctgggggggccctcgtgggccagcgtcccagctctgtgcctagcccgtgggaggtgggtcgcgttcgctgctccgggccctgattccggaaaggggcctgtggggccccgtgtcctgggtgctgtcccttcccacagactccaggttgatgtcaaagtctgtctgcgcggtaggtctggcgtattctgacaggacacagtgagcatctgtagaggagaggcttgaaataaaggaggagcacgaatattccctggatttctggaggtgtgtggggatgtggggtgggtgccaaacactggagaaccgaatcggggtgggggactgcgaccagagcaggtcaggcatccaggagcacctcttaatcttcccctctctaatggtgttccaggcgcttcccccaccttccatccccatctgcctcccccaccgtcctaaactgggggcttgaaagggtgagctttggaggtaggggtgatgagggagacatactgacaagtaccaattcacgacctgttttctagaatatgtggcgcccttcccccattttctgctgcgcagagcaaggggatgtggcgcacctagtggtgaatcctcagaattggagaagggagtaatgagaagagtatgacgtcaagagaaggagttgttatctctagaaccttgaagcagggcctaaacaaaacgagaatattccaccagcaaaaccccgaatgttgaaagacagatatcaataatatggggattcttatccttagcgttggtctctctaccaagggctttactgccacccctcatttcctgtcttactttttcatctgtttgtccataggcctgctttaaggctggccagttctgcaagaaaggcaaggaggaggagactggctcacacctctggaggttggtgagaagggggagggggcaattcaggggacagttggagaaagagagcatggcaggtggctttgagaccagtgggtgcagacccacttctactctgctggatttgcacagtgccagcatcctttttatttcttgcaggggacatgagataggtgtaggttgtgttgtgactcagaaagacctgagagcagggaccaggacacaggaaaccatagatacattgaacccttgaatgggaagacagatatttgtcacaggagccagagtgcttgcctatctaccattctccattctctcctgtatgtttacttgtctgtaggacccccttctgtcagctgtggggcttgacactacttgaacaagaaaaggagggggaaactgcaccacataagtgaaggttggtatgagagtgggtatacttttgggcggggtagtggagaccagcatgggtccgggagtgcttagggtccaatctggggacttcttggcccctcccattgccgacacactttcccaccattgttggacctgtttaataggaggcagccggtccagagagactttctcaaagcccagctgtcccacctagcattcaacatcagtctcactgcatatgtctctgcatgggatgacataattggaagagactcaaagccccatttcattctctctccctagatccacctccagtggctgctctgctggtggtggggttgctgctgacaaccaccctcaacgggtctgcacccatccaggaaatctctgtcttcctcaagcttggttgtgcctgttctacactctatctgtattattgaattactgactgagactgtgtttgggaaggaggctgagtgactactggactggatattgactctaactcttgtttccaagcttatatcctcaatcacctaaagatcagagtgtgaagaaacaaacctgtgacagatctgtggttgaggtttagactgggggaggagtatagtactggactttctttgtaacttgtaccatgactggggcagagattgagtctggtgcccaggtcaagcctgaaaagaagcctggggaagaggttgtaggtggggctgagatagagaatgatgtccctctggtggtcagacccaaggttaggacccaggcccagataatgcctggggcaaggcccaagaataagtccaaggttatgcctggagcaagcaccaaagttgagacaagtgcagtgggtggggcacgccctaagagtaaggccaaggcaatacctgtttcacgatttaaggaagaagcccagatgtgggctcagcccaggtttggtgctgaaagattgtctaagacagagagaaactcccagaccaatatcatagcctctccacttgtcagtactgattctgtcttggttgctaaaacaaagtacctgtctgaggatagagaactggttaatacagacactgagagctttcctagaaggaaggcccattaccaagcaggattccagccttcttttaggtcaaaggaggagaccaatatggggtcctggtgctgtcctaggcctacatccaaacaagaagcctctcctaattctgatttcaaatgggtagacaaatctgtgagttccttgttctggagtggagatgaggtcactgcaaaatttcatcctgggaatagggtaaaagacagtaacagatccatgcacatggccaatcaagaggctaataccatgtctaggtcccaaactaaccaggagctctatattgcatctagttctggttctgaggatgagtctgttaagacaccctggttctgggccagagataaaaccaatacctggtctgggcccagggaagatcccaatagcaggtccaggtttaggtctaagaaagaagtctatgttgaatcaagttctggatctgagcatgaagaccatttggagtcctggtttggggctggaaaggaggccaaattcaggtccaaaatgagagctgggaaggaggccaataacagggccaggcacagggccaagcgagaagcttgcattgatttcatgcctgggtctatagatgtaattaaaaaagagtcctgtttctggcctgaagaaaatgctaataccttttcaaggcccatgatcaagaaagaggccagggccagagcaatgacaaaggaagaggccaaaaccaaggcccgagccagggccaagcaagaagccaggtcagaggaggaagccctcattgggacctggttctgggctacagacgagtccagcatggcagatgaagccagcatagagtccagtctacaagtggaggatgagtccataattgggagttggttctggactgaagaagaggccagtatggggactggggctagcagtaaatccagaccaaggactgatggggagcgtattggtgattccttatttggggctagggaaaagaccagtatgaaaactggggctgaggccacctctgaatctatactagcagctgatgatgaacaggtcattattggttcctggttctgggctggtgaagaggtcaaccaagaggctgaggaagagaccatttttgggtcgtggttctgggtcattgatgcggccagtgtggaatctggtgttggggtcagctgtgagtccaggacaaggtctgaggaagaagaggtcattggtccctggttttggtctggagaacaagttgatatagaggctggaatcggagaagaggccaggccaggagctgaagaagagacaatattcgggtcctggttttgggctgaaaaccagacctatatggattgtagggctgaaactagctgtgacaccatgcaaggggctgaggaggaggagcccattattgggtcctggttttggaccagagtagaagcttgtgtggagggtgatgtcaacagcaagtctagcctggaggacaaggaagaggccatgataccatgttttggagccaaagaagaggtcagtatgaagcatgggactggtgtcagatgcagatttatggcaggggctgaggagaccaataataagtcttgcttctgggcagaaaaagaaccctgtatgtatcctgccggtggaggaagttggaagtctaggccagaggaggaagaggacattgtcaattcgtggttctggtccagaaaatacacaaagccagaggccattatagggtcctggttatgggctacagaagagagtaatatagatgggactggagaaaaggccaagttactgactgaagaggagaccataatcaattcctggttctggaaagaagatgaagccatttcagaggctactgacagagaagagtccaggccagaagctgaggagggggacattattggttcttggttctgggctggagaagaggacagactagagccagctgctgagactagagaagaagacaggctagcagctgagaaagaaggtattgttgggtcctggtttggggccagagaagagaccattagaagagaggctgggtcttgcagcaaatccagtcctaaagctgaagaggaagaagtcattattgggtcctggttctgggaagaagaggccagtccggaggcagtggcaggagtcggctttgagtcaaagcctgggactgaggaggaagaaatcactgttgggtcctggttctggcctgaagaagaagccagtatacaggctggatctcaggcagtagaggaaatggagtcagagactgaagaggaaaccatttttgggtcctggttctgggatggaaaagaagtcagtgaagaagcaggaccatgctgtgtatccaagccagaggatgatgaagagatgattgttgagtcctggttctggtctagagacaaagccattaaggaaactggaactgtggccacctgtgagtccaagccagaaaatgaggaaggggccattgttgggtcttggtttgaggctgaagatgaggtagataacaggactgacaatggaagcaactgtgggtccaggacattagctgatgaagatgaggccatagtggggtcctggttctgggcaggagatgaggcccattttgaatcaaatcctagccccgtgttcagggccatttgcaggtccacgtgttcagttgaacaggagcctgatccttcacgcaggcctcagagttgggaggaggtcactgttcagttcaagcctggtccatggggtagggtcggcttcccatctataagcccctttagatttccgaaagaggcagcatctttattctgtgaaatgtttgggggcaaacccaggaacatggtacttagcccagaaggggaagatcaggaatctttgcttcagcctgatcagcctagtcctgagttcccatttcagtatgatccttcctacaggtcagtccaggaaattcgagagcatcttagggccaaggagagtacagagcctgagagttcatcctgtaactgcatacaatgtgagctgaaaattggttctgaagagtttgaagaactccttttattaatggaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacatacatatgtaaagtgtgtgaggaaacccttgcttatagcgtggattccccggaacagctgtctggaataaggatgattagacatctcactactactactgactatcacacactggttgccaattatatgtctgggtttctctccttattagctacaggcaatgccaaaacaaggtttcatgttttgaaaatgctactgaatttgtctgaaaatcttttcatgacaaaagaactactcagtgctgaagcagtgtcagaatttataggcctctttaacagggaagagacaaatgacaatattcaaattgttcttgcaatatttgagaatattggcaacaatatcaaaaaagaaacagtgttctctgatgatgatttcaatattgagccgcttatttctgcattccacaaagttgagaaatttgctaaggaactgcaaggcaaaacagacaatcaaaatgaccctgaaggggaccaagaaaattagtaatggttaattgctggcctcagattgtccttatgttcctgagttatgatccttgagtaatgctttgattttaatagttggttctgtgttgcaacatatatctttagtgctgacactaactttgtccaactctgtctgtaagctggagcatttttctgatgccagctgaatattagagctgaaaacacatttgttgatatttgtcttgtccacattgtgatgttcagtatttgagcttatagtgaactgagcaatcataaataagccacccttctgattgtcgttctactgtatatatatatatatttgagtgttgtttgtgtttcaataaagtcctatgttaaagttg

SEQ ID NO: 36659 - DNA, 344497 bp, Homo sapiens
ttcctctcgccgctcccggctcccgctgcggctgttggaactggagcgcagcccatcttgaagccctgcggggaggggccggtgacgccagtgctggccagctctcaggggccataagaccctctcccccatcggcctgactccctttcatcccactcaacttcttccgatgttcagtcctcccagacaccctatttgggaccctcccggatgtgcgtggggggagtcactccttcagggagcagtggggacggcgccccgtgctagctggagggattcccctcccccaactctccatccttccccaccccttccagatgtagggggggtgggggatcccctccgcgataggccgcgagggttgacgcggtcccacgaccccctcccacgatccccagaggtgcagcgggcacacccctccttccagatgtgcggaagcccgagccccgccccctcctcccgctcccgcactgacctctcttccgctcccgtttgtcctgcaactgcttcttcttctgcttcacgctgaatggcttcttcctcggcatggcccggaccagtcacctggcccgccctccgccgagctcccgccgcctcaactgactgccccccggggcagcccccgccgcaggggcccgggaccctagaggaggcggggctagcaggtgacgtcagcgggcgggcccgacagaattaccgccgcggcggcgatggaaggcggacgggggagatatagtcacttccctccaggagcgaggcgagaggatgatgcggggtgggctactggcacgtgagagccagtggcaccgagagggcgccccggcggcgaggaaggaggcgcgcgtgggaggaccaggctaactccgtcacggacgctaccaactcgcgttcggaggagggggggcgcgtgtcatcactaccttgcgctcccgggagaacctaccactcacctggagggggcggcggagcggagggcggggcctactacctaggggagagggggcgtggacacgctgaggctatactacaaagccccgggcttgaccttagtggaaagccgagactgcgtccaggttgctggactacaccgggggcacggtcagaggtctttaggggagggcggcggtctgagagtcctgggtgccgacctgttgggacccaaattccttgtgggaacgatgataaggagcaggtttacagatcataagtgcaaaagcgggcgagaagggaaacccaagcgggacaaggacttttggggggaggtcaaagggcacgaagttgtgcctgcagctgttaccatagtaaccgaggaccggatgtggcgatcttacggtgcgacagtcctcttctcaggccctctggcccgagagcctgttgactctgtgacacactctgaggagctggttgtggtgttttccagcgagggaagaaaagagtaattttttcaaagcatttatagaaacgcagcaaagggaaggtgtgaggttgccgccatgcctggcagagacggagggaggcagttggctccggaatgcggccgccgcagatgttctccgcaaccttccggaagtggaatggcgggagcctcagcattgctgcccaccgaccccccggaagcggaaacagaatccccgcgtgccccttcctcactaccctccaaatcccgctgcagccattgccgcagacacgatgccgaaacgaaagaagcagaatcatcaccagccaccgacacagcagcagcccccgctgcccgagcgggaagagactggagatgaggaggatgggagtcccatcggtgaggggtctgggagggatgtgcacatgcctgtcaagcccgtccgggcaaggggctaggggctaataaggtgcgaaggagggggctgtaacggaaggaggaagggcgcacgcgctggggagggatggaagtggggctctcccaaatggagccttgaaccaggagttctcttactggaaccatcaacctcaatacggccccagacctttctggagaaggcgggggtggagagaataaagagctcttttgcgcagccgcagaacagtaggggaaaggggtagtagagatgttgcagattgcgatgactgggatgacagtttgtatccagactttgactgaaaaggtacaggtgcagctttctctaaactagtcctctggccagcagttaaggtgagggattggttcatgtctggagacacttaggttgttttggatagcgacggtacggtgaagaaaaaaagttgtcagtatcttttcctgcattatcccctttgattgaatatctactttttgcaaaccctgaaacagctttgcagaaaaaagggcagatagatggggtgagaactcccaagactgctgaaaatatacctgactttactggttgaattaagaaataagtaatacaagaaaaacacctaagaacagaatcatcagtcctttaatccattctgatgaccatattttcatgtctgctcttaggaccacccagccttctgggccctccccccatggccaatggaaaacctggcgaccctaagtcaggtgaggaggaaggggccctgatccttgtattaggtcgtagagaagacagcaagggaggggataaaacccaggaaggacttaaaaataaaagatcagggattccatccctaaatgaatggagagaagttgtatatttgctgatttaaaaactcaatgttgtaaaaatgtcacttcttcccaaattgataaacagatttcatgcattccaagtcagaacacccataatgtttttgtggaaatacacattattatagggaaatgcaaaatatcaaggcgactatcaagacaatcttgaagtgggagggcttactatgaatatcaagatttgtaagctgggcatggtggcacacgcctgtagtcccagttactcaggaggctgaggtgcgaggatcctttgagcccaggagtttttgaggccactctgggcaacatagtgagatcctgtctctaaatacaagaagaaaaaaagacttactataaagctacaatagttacaacgatgcagtttggaaacaatgatagacataagtcaataggacttatgtcccgaagagtccaataacaggcccatacatgtgtggacacttcatttatgatgaagatggaactgaaaagttggtcttttcaataaatgatattggatcaattggatattcatgtgaaaaaaatggaatttcaccttgcactcataatcatatacaaagatctatttcaaatggactgtagatctaagtataaaaggtaagagaataattattctagaaagtaaatgtattttctaagagtagctaagagttcttaaacagacaagaaatgcacgtatacacactaaccataaaggaaagattgataaattgaactccgttagaaaatataaatttgcggctgggtacagtggctcacgcctgtaatcccagcactttgggaggccgaggcgggcgaatcacgaggtcagcagttcaagaccagcctgaccaacatggtgaaacccctgtctctactaaaaatacaaaaattagccgggcatggtggtgtgtgcctgtaatcccagctactgaggaggctgagacaggagaatcgcttgaacctggaaggcggaggttgcagtgagctgagattgcaccactgcactccagcctgggggacagagtgagactgtctcaaaaaaaagaaaaaacaaaatacaaacttgccaaataataccattaagaaattaacaggaagccatacaatagaagatatttgcaataaatataacaaataaagatcctgtatctataatatataaagaactcttccagacaagccatttgaaaaattgacaaaaacacaggacaccttattaaaatggagatctaaatgaactaaaggtctaaatgaacaagtactcaatatcattaattgtcaagtaaatgcaagataaaaatataccactttgaaattagaactcttgtgtactgctgctgggattataaaatggtgaaactactatagaaaacaatatgaagaggttcctcttaattaaaaatagaactaccagatgacaaaaaaattaaaaatagaattaccccagaactcctgcttccaggtatatatcaaaaaaaaaaaaatggaaagcagggtcttgagatatttgcagactcatgttcatagcagcagtattcacaataacaaagaggtggaagcaacccacatgtccactgatggaaggataaatgtggcgtgtacatacaatggaatattattcagccttatgaaggaagaaagtgctgtcacatactacaacatggatgaactttgaggactttatgttaagtaaagacatagtgtattattccacttatctgaggtgtctaaagtcaaattcaggggctgggcatggtgcttcacgcctgtaatcccagcactttgggaggccaaggcaggcagatcacttgaggtcaggagttcgagaacagcctggccaatatggcaaaaccctgtctctactaaaaatagaaaaattagctgggcatggtggtgcacacctgtaatcccagctactcgggtagctgaggcatgagaattgcttgaacctgggaggcagaggttgcagtgagtcgagatcacgccactgcactccagcctggatgacagagcaagattgtcaaaacaaaaaataaaaataaagtcaacttcaaagaaacagtagaatgatggttaccagaggctgggggaaggaagctggaggaaggggagttttgtttaatgggtacagagtttcagttttgcaagataaaaaacttttggaggtcgggcatggtggctcgtgcctgtaatcccagcactttgggaggccaagtcgggcggatcatgagatcaggaattcaagaccagcctggccaatatggtaaaactccatctctactaaaaatacaaaaattagccaggcgtggtggtgggcgcctgtaatcccagctacttgggaggctgaggcaggagaatcacttgaacccaggaggcagaggttgcagtgagccaagatcgcgccactgcactccagcctgggcgacagagcgagactccatctcaaaaaacaaacaaaaacttggagatctgtttcacatcaatatgaatatatgtaacactactgaactgtacacttaaaaatagttaagatggtaatttttatgtgttttttaccacaataaaaaccgaacaaaacaaggcatgatgattcatgcctgtaatcccagcactttaggagaccaaggtgggaggatcacttgagcccaagagttcaagaccagcctgggcagtgtggcaagacccaatctctcattaaataaataataataaccaaacaaaaaaataaccaccacttttcacactcaccatggcaaaatttaaaaacctaacaattccaagtgttgtcaaggctataggacaactgctggtgagagtgcaaattggtataaccactgtgaaaaaaaagtttggcattatgtatgaaacttgagcataacatatactttataagccagtaatacctctactacgtatatattcaacagaaatgcatacgtatgtgtaacaacatgtataaaaatgtttatagtggcatttctcgttatagccccaaactggataccacccacatgtccatcatcagtagaatggataaataaattgttgtgtatgcatgcaatgggactacactgcaacgaaaatgaatgaactgctgctacaggcaacctggatgaatctcacaaacatgatgttgagcgaaaggagccagacataaaagaatgcagactgtatgattccatttttgtgaagttcaaaaacaggcaaaaactaacctatggtgtcaggatagtggttacctttggggaggagggtgggtaatgggaaaaggggcacaaggggaggatcttttgaggtgctaataaggctttatctcttcacctggtggtggaaactcaagtgtgtctactttgtgagaactgggttgtgcacttaaaactggtgtgtctttatgtatgctgttcttcaataaaaaaaatttttttaatcacggtttatcaggattcagctgcccattagacacctttctgtgtctctctctctctctctctccagctcttcacagaggtcctccaggatcaaggggaccactgattccaccactgctgagtctcccacctcctccttggggtagaggcccaattcggagagggcttggccccaggtctagcccatatggtcgtggttggtggggagtcaatgcagaacctccttttccggggccaggccatgggggtcccaccaggggaagctttcacaaggaacagagaaaccctcgaaggctcaaaagctggtctcttatcaagaatacctgcccgcccaaggatgacccccaggttatggaaggtgaggtccattttgttatgcccattactcccagagtgacctaattttcagaagatcattcacaatcttctctgggctttcctttttgcttttgaagcagaagtagacctcaatgttatttctcccaggagaaagactaccattccaaaatacctggaaatggtagggggtagaaaatcagttctccttctgtctctgcgtttcattgtatttgttttctttgttgctcaaatttttaactgttccattttcacttgttcacagacaaatccgaccgccctgtctgccgacattttgccaaaaagggccactgtcgatatgaggacctctgtgccttctaccatccaggcgtcaatggacctcctctgtgagactgtgccttcccatccaggctggaaggagctctctgtgacctagcggccatttatttctctgtagccctatgatggctactgtgaggctcttctaacaccctcagtcagtgacacacccatcccatccaccacttcccccgtgtggggtccagagtggtgttgcatcactggtgcgcggcatacgcgctttcttctgatccagcctgtagagactcgcctttgggacccatctttgcttcctttcagttgcctcctggatcttctttcccgtcatcaaatgactgctgaacaggaaacctctttggtgctgtttcttgtgcatctgtccacctgttccccagtattgccctcaattcctgagagccctggagcggtttcctaccattcccttcttttagctgcttgttttaagtcctttttatgtgacattccctacccccaatgttgtcagctgcttgtgaaactcagccaggttgtctaacctggggtcaagtttgggtgactggtgcagagttacttcctaaaaggccactctccctgcctttggatttcatagtttctctgtcagtagcatgatccccaccgctatggtctatctatgatcaccgtgctttgtgaaactgtgcatccccttgtagcctttctcagtgtccgtggcatttttgtgacttcccagcactagaataagttttcctgccaaaatgagtgaggcgcttggtgccctctggactttcccacttcccaacatgggagaattgtgaactttccatcagactgcctccctggccctccccattcttctcctgttggttattctgagtctgacacagacccatgacatgtcttataaagcctccaatggctttatcctacctagatcccttccagcccattttaattagactatgtcattgtgaggccaccagtccattcatttgaattctgtgaatctccaccttgcctatctttgggtagaagctggacagtactgttgccctcttccaatcctcttcccctacatccctggcactggttgttttctgtgaaaacagcagtgaacaggttcagttttgaactggccctgaggaaatgggtcaggagttgtattggcaagagggaggggtgagagctgttggagaactgagaatgaggttttttttttttttttctttttaactttttttatattagtaataaatgcagtggaaaccagcattttatttaatccctgtgttctagtcatctctggagttgcagatgaagctgttctcacctggtggagtcagcttattctttagttcatacacactagtgatggggaatgacaaagcttaaggttcttccaggctgaaaaaaaccaatggaggttccattagcctgtaggcatcaaccagaacaagctgccttatgttcaagggcaaagttttgtaagaaaaaggaaaggccaggtgtccgtggagttatttttaaatattttactttgcagagtttgtgtttatggagtggtaatgatgaaggagtctttcagcagcaatttgcagaatgcctgtgggccaggcaatataccaagcactagagataactgacagccaaagccaatggatttaaaatgtacagggaagacaggtttctcataatcacaaatagcatgtaaagttaaacctgtcaaaagtgctgggaagaagacagggaagaaaagagggtgaaagagagttgtgtaataaagggagtcagggtaggagatgcaactgagacaagctccaaaggataaacaggaggtggggtgggagagggaagtcaaggcaaaggtcttcgctaaaagacctaggggaagaggagctaagaaacctagggacagtgggagatgatgcagaagaaagaggagttagaccactcagggccttggaaaacatgaagatttggctcttttcttagaacagaagcctttgaagaattttagacaggagtatcatggcttaggctggcttttcaaaaaaaatcagcttgtatggagagggcccaccttggacctggaagttaattagaaggctactggctacttcagtagtacaagtgagccatgatggtgacatagacttgggtagtagagttggagaaaagtagacatttgaaaattacaggtcaaaataaaagtatcagatttctccaggtagttctggcttatgtaactgccatttaaaaagaagtcttaagatagaagtttatggctgggcgcggtggctcacgcctgtaatcccagcactttgggaggccaaggtgggtggatcacgaggtcaggagatcaagaccatcctggctaacatggtgaaaccccatctctactaaaaatagaaaaaaaattagccaggcgtggtggccggcgtctgtagtcccagctactcgggaggctgacgcaggagaatggcgtgaacccaggaggcggagcttgcagtgagccgagatcgcaccactgcactccagcatgggcgacagcgcaagactccatctcaaaaataaataaataaaaaataaaaataaaaataaataatttttaaaaagatagaagtttatttctctcacaggtcaagaggtggacaatcaacaatccaagatgtgtgacaatgccaccactacaaggtccctgagtattcagaacctcaacccccaactttcagattcacaaccacaagcttctattcactgtccaaagtgaagctctggcttcctcatccatgttcaaagcctcaggatggaggaagggctgagaacaccagttgtctgggaagaaacttctttttttttttttttttttttttgagacggagtctcagctctgtcgcccaggctggagtgcagtggcatgatcttggctcactgcaagctccgcctcccaggttcacgccattctcctgcctcagcctcccgagtagctgggactacaggcgcccaccaccatgcccagctaattttttgtgtttttagtagagatggggtttcaccgtgttagccaggatggtctcgatctcctgacctggtgatctgcttgcctcggcctcccaaagtgctgggattacaggtgtgagccaccacgcccagccggaagaaacttcttaaaagttaacttataactcctcaacttatgggcaagcatttaagttgagtttattaattctacagaggttatctccctaaaagggggctaggaatgacaggattagggtttgtgtttggtgatttcaaaagaaacaggaaattgttctggcttagatgctgtcagaaagatgactacttcttaatcttatctagaaggagggagaaatgaaatatggctaaagctgtaaggtaaaaaagccaacacattttagctgacagggaactgtgtggtgtttttgtgcttagacaagattttgaagtttgtctaatttcatcacaaacacaggatgaccttgtttgacactgattttctgtgagatagtttatgttcaacaagagtaccatggcctaactatgggcaacaggccagctcccagcaacaccaaagcctgccagttattgtcaggccagttcccaattctcagggactgtttttcttaaaagtatgcaaacatataattacaggttgagatgaatcatatgaaggaaataaatggggtactgaatagaaacagtagttggggagctactcaagacatggtggccgggcgcggtaggtcacgcctgtaatcccagtactctgggaggctgaggcgggtggatcgcctgaggtcaggaattcgagaccagcctggccaacatggtgaaaccctgtctctactaaaataacaacaactagcgaggcgtggtggtgggcatttataaataatcccagctacttgggaggctgaggcaggagaatggcttgaacccaggaagcagaggttgcagttagccgagattgcaccattgtactccaccctgggcaacagagcgagactccatatccaaaaaaaaaaaagacatggtggctaggatagacctctctgaggaatctgtagatgaagggcccagaacttagccttgaggaactctgacattgaattgctaagtgaagaaggacaaggataagccagacaaggagactaaggagggatgacggagaggcagggagagatctcagagtgtggcgtcacctggctgcttgctcagtgccaggtaccctgctaagctctttatagacattgtctttgtcttatttaagcttcacatacttttttggggggggagagggggtggttcaagcgattctcctgcctcagcctcccgagtagctggaattacaggtgcccaccaccacacccggctaattttttgtattttagtagagatggggtttcaccatgttggccaggccggtctcgaactcctgacctcaggtgatctacctgcctcggcctcccaaagtgctgggattataggcatgagccaccgcacctggccaagctttgcatactttcagtgaacactttagtgcctactgtagggcaagcactgttttaggagctggagctacatcaataaaaaggacaaaatccctgcccatatggagcttacattgctttgaggatgatagacaatatacataggtaatataattttaagtaatagtaaatgcttcaaatgaaaataaagtgaaaaaagaggttagagagtgacaggtggaagagaacaggttgatacaaagagagagctgctttgaggaggtaacacatagagagaaaattaaacgagggaacaaaccatatgaacacacagagaaagtgcgttccaggcacagggaacagcaaaggcaaaggccttgatgcaggaatgactctggggtgtttgaagtaaaaatagaaggccaggccaggcgtggtggttcatgcctgcagtcccagcactctcagaggctgaggcaggagcactgcttgagctcagaagtttgagaccagcctgggcaacatggtgagaccctgtgtctgcaaaaatgtttaaaaagtacccaggcctggtggcgtgtgcctgtagtcctagctagttggaggctgaggtgggaggatcctttgaggttgcagtgagctatgattataccactacactccagcttgaatgacagaccaagatcctggttcaaaaaaaaaaaaaaaagcccagtgtggctagactgtgggagatgggatcaagatgtttaacagagggcatattgtacagagccctataaactatggtaaagcatttggattttattctggattttatacttttttaaatatttttatactttgaacaaatggatttactttttttttttttctttttgagacggagtcttgctccatcacccaggttggagtgcagtggcatgatctcagctcactgcaacctccacctcccgggttcaagtgattctcctgcctcagcctcccaagtagctgggactacaggcgcccaccaccacgcctggctaatttttgtatttttagtagacacagggtttcgccatgttggccagcctggtcttgaactcctgaccttttgatccgcccgcctcagcctcccaaagtgctgggattacaggcgtgagccaccgcgattggcccatggatttacattttaaaaccacctctgactgtaggtgtgaaggatagactagagaatgagaatgacagcaggcagaccagttaggaggccagcgcagtgcagtggtccagggagaagagacgatggcttggtcagggtagaggtggagagaagtggttaaatttgggttatgttttcgtctcagttgatggcaattacatctttctagttaactcaggccagaaatattggagtcatccttaattctatttgtcaaacatgacctccaatccattaacaaaacttgttggctcttttccaaaatacattcagaaaccagcccttttcacacctccactgctgtcaccctagtctgagtcaccatcacctcctaatagatctccctgcttctgtcatttctgcccattctttgctgcctgccccctcccacctcccgcccaggttgttctcagcacagcctccagagtcatcctttttatttaacaatttaaaaaatgttataggccaggcatggtggctcacgcctctaatcccagcactttgggaggccgaggcaggcggatcacgaggtcaggagtccgagaccagcctgaccaacatggtgaaaccccgtctctactaaaaatacaaaaatgagccaggcatggtgacgcacgcttgtaatcccagctactcaggagactgaggcaggagaattgcttgaacccaggaggcagaggttgcagggagccgagatcacgctactgcactccagcctgggcaacagagcaagactctgtctcaaaaaaataaaataaaataaaaattaaaaaattgtattatatacggagacaaggggtctcgctatgttgcctgggttggtcacaaacccctgggctcaggcaattctcctgcctcagcctcccaaagtactggcattacaggtgtgagccactgcacctggccaggtcatccttttatttattttattttatttttttttttttgagacggagtctcgctctgtcgcccaacctggagtgcagtggcgggatctcggctcactgcaagctctgcctcctgggttcatgccattctcctacctcagcctccccagtagctgggactacaggcgcccgccacctcgcccagctaacttttttgtatttttagtagagatggggtttcaccatgttagccaggatggtctcaatctcctgacctcgtgatccacccatctaggacttccaaagtgctggcattacaggcatgagccaccgcgccccagcccaggtcatccttttaaaatgtaggttggatcacatcactctgctcagaactctgcagtgacttccatttaaatcaacagaagaagccaaaatccttaagataatttaaaagacctttcccaatccagaccctgctttacttctcttttcacctttcccacaactctggctcactcgtgccactccagcccctcttgcctccttcctgtttgttccccatgtatgtccgaacactcctgtcacagggctttactccagctgtttcttatgctagaaaggcccttctcctggaaatccatgtggccaaaactaatcttctttaatgatttgcttgaatttcactttactgaggcctcatttaagactaaaatctgtcctcttgatacttttaaacttgatccatattttcttttatctataggatcatctcccctgctggaaacctaatcagagatctttattttattcagtagtatcccaagagcgtagaagagtgcctggcacatactatacactcaataaatatatttgttgaacagatgaatgaaaaaatgaggcagacttagctggctgatggattgattaggggaggaggaatggagaaagaggatgatgacctttcagttttggcccaaataactgaatgacctgtggtgcaatttcttgatggggaagcctggaagagacaggctttaggagtaagaacaagagctccattttgtacgtatgagagagatttattaaagatctcagagaagatgtcccataagcagttgaattcatgagcctggagctcggggcagaagttgggggccagcaagagaagtttgggaatcttcattggttatagatggtatttaaagtcaggaggtgataggtgataagtctagattaaggagagtgtcaaagatttagccctgaggcacttcaacatttagacttcaggagaagcccattagatgcaaaggaaacctatagagagtagtgtccctgaagaaaacaaaggagggagggagcgaccaagtctatcaaacattgatgggagagtgagtaggatggccccagatctgttgactttggcaagtgtgaattcagacaatggtggcaacaaaagcatgattgtagtggtttgagagctgacagaactacaggagcaccttgctcaagctcccatattaagtggtagagttagaagtgaaccaaagtcttgattgtggtgatagtttactgggtttatgcaggtcaaaacttatttaagtgatactttgcagtttattttgggtgccattttattttgtgtacagtttattgtatgtcaattatatctcagtaaagctgttaccaaaaaaaataaatgaaccgaagctccactgcaccgtgacttctgcatgttgggctccagttccctgtttacaattgtacacttcgggattttgtgacacatttcaacactggaccgatcagacctctcccttagccattggtctgcactgtcttttctgcccatgacccagtcagtctcgcgccccatgaccctctcctaaaacacgcgcagtctcctctctcttccccttcctctcgtgtcttccttgcctaccagcctcacctgatgggctcgtgttctctccgtccccgatccactcgggctccggcagctgctgcttgggcgccttcggcatcgcggtggcagaactagaaacgagttacagatagaaactagaatatgctttttaaaaaaacaaaaaacaaaacaaacaaaaaaacagtatgcctcaactccttcatactagtaggaaattattatgttcattccttgagtctcgcggcgtcgggaggtcacggcgtcaggcttcccagacagtcgtaaacgccatgtgtttacgcgactggagcaagcggacgccggccccgctccgtcattgcaggccacgcctccactgaaccagggccacgcccccgagatgacggcgaagctcgcacgtgcgcagcccgggggcggggttggccgcgccagcttggagagccagccccatcggggttccccgccgccggaagcggaaatagcaccgggcgccgccacagtagctgtaactgccaccgcgatgccgaaggcgcccaagcagcagccgccggagcccgagtggatcggggacggagagagcacgagcccatcaggtgaggctggtaggcaaggaagaaacgagcagagggggaagagagaggagactgcgcgtgttttaagagagggtcatggggcacgagactgaccgggcccctgcgggagttactgcgcatgcgtgccgtgggcccgggaggagtttgccggggaggagtgggtttggaatcggggttaaaggaaagagatccagatgtcgcacgtgacctaagtgagactgggcgagataaaagaaagagcatatggcaccgagggagagatggggagaaatgggaaaaccttgcttaaaaaatttggacatccgccccaccatacactgtattccaccaggaatatatgagccctgcctcgacctccccttccccctgcgcgcgcatacacacaccttgggagcctgtgatcccccttgtttctcaagagagggtgactccttcatggtttctttcttaagacacccctctcactcaactggagcaagagtgtagatttttgatgttggaatgagggttaaggtttacttaaaaagcagcgaaagtttgttaagcgcttgtttttaattaagcactctatatactgtgctttgagaggggaaggaaaaaaacatgaagatatcctcccagggttgaagtcagttttaagggggacataaatggacacaactaaccccagtaggtacacagtaactaattttaaaagcacttattggatgcctactgtataccaggtactgtgtggaggaagtgggaatgtagagataaaagataagactttccctcaagggacaacccagtatggtgaagggtcagagcattaaccagacagacagtggttgtcagagtatgatgaaggtgcttaagaatgttatgggactgtagaagagaggaggagcatctactcagacaggtaagggagtgtcagcaaagcctcccaagaatatgtaatagctgagtatttttttttgaggcacattgtagctccatcacccaggctggagtgcagtggcatgaacatggctcactgcagcctccacctcctgggtttaaaggatcttcctgcctcagtctcccaagtagttgagactactggcatgcaccaccacaccttatttttaaaattttttgtagacacaagatctggctatgttgcctaggctggtctcaaactcctgggctcaagtaattctcctgcctcagcctccaaaagtgctgggattacaggcgtgagccactacatctgctccccagagtttattcttgaaagatcatcgtgaattagcaaggggaagcgcattccaagccaaggaagtttgtggaaggtagagatgtaggcaagcctgactggtcccactagagcctggtgactagtgtgatgaagtcagaaagatgctcaggagacagataatgaaaggctttagatgccattccgaggagtttaatcctaaagacattaagaaggaaggcccattgaagtgcataaggaatgattatgaacagttcacctgtagcactgagcaatggagaatgaatggccttgaactggtcaagatggaggcggggagaccatttagggggctctggccatgatctaggtgagaagtggtaaggggataagccaaggcctgaagaataaagagttactaaggaggcggcattgatcggaactgagaactgattaaatgaagggagaagtaaggttgacacttaagtaacccagtgactagtagactattaactgaaagcagtaatggacaggagagtaagaagtggaaagagataaggtgaacttctgaatgctgagttaggcgtttctgaggatttctaaaaggaaatggcaagaagagagtttgtttagtcactgtggagagacaactatactaggagtaaagacacaggcaagtagagttgaagtgctggatatggaagagtcccctagagagtgtttgcagattgaaccaaaaagaaggttaaaggtgggaaccctaaagaacttcagcaattgcaggaagcaggtggggaaggaggctgaagagatgagactgagaaaggcaaacagccagagaaactggaggcaaaccaggagtgagcaagatcccagaaattaaataatgatagaagagaataaaaaaggtgtggaggtaggcagcatggaatgctgcagagaagtcaggcaaaataaggaccaaaaaatactttgtggtttgaggagctaagggttcagtggcaactttggcagaagtagtgttcattcggagatgataccagattgcagtatgtttcaaaggtatgggagaagagaaagtgaagcttgtgaattacgattttgagacccaatgaggacaagaatacgaaacagtaatgggggagaggggtataagggtaaagaaggcttgctttcttgccttgaaggagcagcttaagcgatatacgaaaggagagaagacacagtatatctctagccacacttaatctttttcagttccttggggattatactttctcacaatgaaactcttcggaggcttttcctgtccctataatgaagtggataagagtgattaaagtacaaaagatttttttggttttggtgggttttttttttttgtgacggagcctcactccaggctggagtgcagtggcgcgatctcagctcactgcagcctcaatcgcaggctcaagccatcttcccttgtagctgggactacaggcacacaccgccatgcctggcttattttttgtttgtttttgttttttgttttctgtagagatgaggtcttgctatgttgcccaggctaatcttgaacctctggcctcaaccagtcctcccaccttggtccccaaaatgttgggattacaggcgtgagccagtgtgcctggccacaaaagagatttaaaggaaggagagatggtatggctgtgttagtccttggggagaaattagtgtctgggatgagtcagtcatctgtgttgataaggtgagctgatcaggtttttccttcttaggtacttcagtagatccttcctcctaatgcctttaggattaaactccttggaatagcatataaagccttttattattaatcctgcacaatttttcaactctcacactagtcacccaatactgggctcagattttttttctttaacttttttgtttgttttttgtggtttgttttttggggaggaggagggccccaaactttgaaatgtgttctggatggaggatgcagattaagcaaagacagacataagcgtgcctgggacttcataaaggaacagaaagaagccagtatcgagaccagaggtgtgggtagggaaacagaaaagatagggtagggccattttagtctgtgaagcctttaattattggaattgtctctcgttaactctagttttttggagaagtagatgcaccataaaactttcctgaataaatgattactttgaaatacatggaattctagtctgagaatattttaatgtagtagatggcggataccattgactttttttcttttttttttttttttttgagacagtctcgctgtgtcacccaggctggagtgcagtggcgcgatcttggctcactgcaacctccacctcccaggtacaagcgattctcctgcctcagcttcccaagtagctgggactacatgcgtgctctgccacgcccagctaatttttgtatttttagtagagatggggtttcaccatgttggccaagctggtctcaatctcctgaccttgtgatccacccaccttggcctcccaatgtgctgagattacaggcctgagccgccgcacccgaccaatttttttttttttaatattaaatactgaaatgcttaagggtagaattagatagcagtgaatggaagggatgttttggaagagaagataataaataggcctaagcctgaagggaaatcatgaggctgcctccagtaggggagggagttggacatggtcctctaccttcagggaaacaaggatggagagggggagagctagaatctgttgaatctgttttggctttactgggaacacaggctaaacagtctctcaggttactctctagaatgaaagcacacagacaggtaaatatgacacaatgtgatttgtgctataatattcaagcagaacaagtaaggcatagactgaggtgttcatttgcttaccagataactctatttacatggcctataggttttacaaacaacgtgtccccctggccaggcacagtggctcaggcctataattccaacagtttgggaagctgaggcaggagaattgcttgaggccagaggttcaggattagcctgagcaacatagtgagacctcctctctaaaaattattatttttttaattaggcaggcatggtggcgcttgcctgtagtcctagctactcaggaggctaaagtgggaggatcacctaagcctaggaatttaaggttacagtgagttatgatcatgccactgcattccagcctgggtgacagagcaagaccctgtctcttaaaaaaaaaaaaaaaaaaaggagggtgtgtgtgtgttgtatacatgtgtgtgtatctacacatatctcccaaattgaatttataatatcttcttccttcctataagaccttctcttccactgcctccttaattaataaatggtaccacttagcccagctaattttgccagctaaaaacacaggagtcatctctgagtgctctttttttttttttttttttttttttttttgagatagagtcttgctctgtcacccaggctgcagtacaatagcgtgatctcagctcactgcaacctccgcctcctgggttcaagcaattctcctgtcttagcctcctgagtagctgggattacaggcgcccgccactatgcctggctaattttttgtatttttagtagagactgggtttcaccatgttcaccagactagtcttgaactcctgacctcaagtgatccgcctgcctctgcctcacaaagtgccgggattacaggcatgagccaccgcgcccggccgggtgctctttattccccacctctagccccatcctatgaattcttctttatgtccgcttgtcaccaccacccagactactctgacagcctccccagtggatttcccactatgcttattccctccgattcttgctgtactctgaagccagagtgaaactttaaagtgtgaaagtgatcataccaataaagtccccattccttaaccttgctacaaggccctcactccagccttaccttgcaccattctcccctcagtctgtaagcttagccataccaaacctttccctgtctctcagtgtgtgtgctttctcacagctgggcctgtgcacagcactggaattacaccatgtgtctgactaacttctcatactcctcattacttcagttatttgcttaaatgccatcttcttagagaggccgccaccagagatgaagccagcctctcccccaccaccaagtaggctttaccttttcttttggaaccttcagtacacctggaattacctatttaaaaatctctcttcctatagcctgcaagctccagaggagaccacatttgtcttgttcattgctatgatcccctacgctagcacaatatctgacacatggtagctgtttagtagatacttagtggatgaatgaatagagatgggaatgattatttctgcaggagttgtgagacagtacaaatatttaaggagtgatagttaagctagaaaaataataaaataggatagaggctacagagatctttgcaggggggatcagactgctttggaatttgcagataagcattcacgatgtccgcttaactttctagacaaagtggtgaagaaagggaagaaggacaagaagatcaaaaaaacggtgagaaaatgagggttgaggataagaaatgactatggatgtttccaagctaaataaatagccatgtgaaggaggtgggaggtccaagggaggagaaaagatcttgtcaagagaggagataggcagggcacggtggcttacacctgtaatcccagcgcttagggaggcagaggtgggaggatagcttaagcccaggaatttgagacctgcacactccattctccacaaaaagaaaaaaaagagagagacaggaggtaaggtgagggtggagtggagggccagtgggccaatgtgtggcagagcacagcctgcttggattgctcttggaaacatgtttacctgtagcttaactccctttatagttctttgaagagctggcagtagaagataaacaggctggggaagaagagaaagtgctcaaggagaaggagcagcagcagcagcaacagcaacagcaggtacaagtgccacagggcccaccaatcctgggaggcatctgggttccaccaacccctttccagcccatgttgctccattcagctgatggggaaccctctgtgaggcagaaatacagcaggggcctgggcttcattttctcactgttcttttgctctcagcagcaaaaaaaaaagcgagatacccgaaaaggcaggcggaagaaggatgtggatgatgatggagaagagaaagagctcatggagcgtcttaagaagctctcagtgccaaccagtgatgaggaggatgaaggtaaatgacctgagggggaatgggtacctggaatccatgagtcatggagagtgatacctcataccctgatcttcaagttggattcaattggggggccagacattgtaattctttcctatctcatgttctccccctgtcatttcagtacccgccccaaaaccccgcggagggaagaaaaccaaggtaagccatctgtgtggtaaacggagactccaaggatgcaaccttgaccatcctactgacttctgtggccctttcattctctagggtggtaatgtttttgcagccctgattcaggatcagagtgaggaagaggaggaggaagaaaaacatcctcctaagcctgccaagccggagaagaatcggatcaataaggtgacagtggtggctcgatcagtcactctcactccatttagcaccttctggccatggtggagtaatttcccgcttttaaactagctcttctcggtctgtcttacttatactgttaaaatcatctttttagaatacatgcccaggctgggcacagtgggtcacgcctgtaatcccagcactttgggaggccgaggtgggcgaatcacgaggtcaagagatcgagaccagcctgaccaacatggcgaaacctcatctctactaaaaatacaaaaattagccaggcgtggtggcgtgcgcctgtaatcccagctacttggaaggctgaggcaggagaatcacttgaacttgggaggtggaatttgcagtgagctgagattgaggcactgcactccagcctgggcaacagagcaagactcagtctcaaaaaaaaaacaacaaaaaaaaccatgccatttttatcactcagaaatctacagtgattctgttgctttaagcacagaacctgaaacaaagccccaggtccttgctcttctacttgtgactcttctgcgtgtgcatcttagtccatgtccatttgagctcttgagaaagcctccagtgctagtgccactcactctggtggcgcacttgcctgacttataatccttagccttgctgacgttccctagttatctcttcgctatctagtctgaagctggagggtagggtttttctgggtctcatttttcgtcagcagcactcaatacagatggtctccaacttctgcttcggtgtacgatttttctactttatgatggtgtgaaagtcatactcatttagggtactcctcaactcatgatgggattatatccagataaacccatcataagttggaactatttttttttttttttttttttgagacggagtctcactctgttgccaggctggagtgcagtggcgtaatcctggctcactgcaacctccgcctcccgggttcaagtgattctcctgcctcagcttcctgagtagctgagattacaggcacgtgccaccacgcccagctaatttttgtgtttttagtagagacagggtttcaccatgttgaccaggatggtctcgatctcttgaccttgtgatccacctgccttggcctcccaaagtgctgggattacaggtgtgagccaccacgcccggccaagaactatcattttttatttaagtttctggtgggtttatcgggatgcaacctgtcgtaaatggaggagcatgtgtatggttaacacagtagactctctagaaatgcttattacacagcaaagtagcacaataatttgtatgtatgtgtgtaatgtgtatgtgtgtctcctccaggccgtatctgaggaacagcagcctgcactcaagggcaaaaagggaaaggaagagaagtcaaaagggaaggctaaggtgagagagtaactagcaggaggaggtattggggcccaggaattaaaacatttcatcagggctgggcgcggtggctcacgcctgtaatcccagcactttgggaggccgaggtgggcggatcacgaggtcaggagatcgagaccatcctggtaacacggtaaaaccccgtctctactaaaaatacaaaaaaaattagccgggcgtggtggcgggcgcctgtagtcccagctactcgggaggctgaggcaggagaatggcgtgaacccgggaggtggagcttgcagtgagccgagattgcgccactgcactccagcctgggtgacagagcgagactccgtctcaaaaaaaaaaaaagaaaaaaaaaaaaaacatttcatcagacctgtcttttccctattagcctcaaaataaattcgctgctctggacaatgaagaggaggataaagaagaagaaattataaaggaaaaggagcctcccaaacaagggaaggagaaggccaagaaggcagagcaggtgtgtatttggtgttggggcaaggtggaatgagggactagggcttccagggtccttatgggagagttagaatctggggatatagttattatcccagcaaacctttattcttttctttttttgggggagtagttggggtggtggttcgtttgtttttgtttttgtttttgtttacacaggatcttactctgtcactcaggctggagtgcagtggtgtgaacacggctcactgaagcctcaacctcctgggctcaacagattctcctgcctcagcctactgagtagctgggactacaagtgtgcaccactacccctggctaatttttttatttttagtatagagatgaggtctcactatgttgctcaggctggtcttgaatttctgggctcaagcagtcctcctgcctcagcctcccaaaatgctgggtttacaggtgtgagccagcatgccagccagcaaactttttctataaagggccatatagtaaatgtttttggctttgcaggccacatacaatctctatcacatattcttttttttttttaacaactctttgaaaatacaaaaattatttttataaagttcaggagctatataaaaataaatgtcaggtcagccttggcccatgggctgtagtttgcaacacctaatccagtgaagaaagggcctggaatttatctcagatgatctgggtcctggctctgccttcactggctgtgtgaccttgaatacatcttcccatccccttgggtctcacttgtctcctttgtgtgatagaaggaggagtccggagatctctagggtccctatgcgtctggcacttcctaattctgtgattctgctggattcctctgactgtgcactagagcttcctgatctttttttttttttttttttttttgagatggagtctcactccgttgcccaggctggagtgcggtggcgcaatctcagctcactgcaacctctgcctcccgggttcaagcaattcttctgcctcagtctcccgagtagctgggactacaggcacgtgccaccatgaccggctgattttttgtgtttttagtagagacaggatttcaccatgttagccaggatggtcttgatctcctgaccttgtgatctgtccatcttggcctcccaaagtgctgggattacagacatgagccaccgtgcccggacggctacctgatcttttctttgcatgttaacaaggaaaccacagaaactcattttatacaaatgaaactcttgaaatccatttactccaccttcagttacattgtattgggagttacatttatagggacataacgcgttgtcacatttcataaatacacattcataccatttgtcttgtaccattcctggtagcagaaattaataaaggacctcagggagaccaggggctgggtatgagaatgagagaggatcccaagatattttaggactctgagtagtgaaggaaagagctggggcagggacagggggcagatgatgtgaaatctgagttctagaaggagtccctagtttttttttgttgtttttttttttgagacggagtcttgctttgtcacccaggctggagtgcagtggcacgatctcggctcactgcaagctcctcctcccaggttcacaccattctcctgcctcagcctcccgagtagctgggactacaggcgcccgccaccacgtccggctaattttttgtatttttagtagagatggggtttcaccatgttagccaggatggtcttgatctcctgaccttgggatctgcccgctttggcttcccaaagtgctgggattacaggcgtgagccaccgcgcccagccaggagtccctagttttgaccatccccgggttctcacagggttcagaggaagaaggagaaggggaagaagaggaggaggaaggaggagagtctaaggcagatgatccctatgctcatcttagcaaaaaggagaagaaaaagctgaaaaaacaggtaagaccttggttcttagcggtcaaaagtaggggatttttaaatacttcaactaggggacatgcgattggggacacgaaggaaaggtttgggggctactccaagtaaaacaatcggagtaagaaaataattgtgttctgtgaaccttatctcaatgtctgatgacatgggctgtttcactttggggttttttgtttattttttgagacagggtctcacactgttactcaggctggagtgcaatgacgtgatctctgttcactgcagcctcaacctaccaggctcaagtgatcctcccacctcagcctcccgaatagctgagactatgggtggcaccaccatgcctggctaatttttgtattttttgtagagacagtattttagcatgttggccaggctggtctcaaactcctgagctcaagagatccacctacctcagcctcccagagtgctgggattacaggcgtgagccagcatgcccagccagcatgggctgtttcatggtgatgggaaactggtagactgtggcttcaaatgtagtttttcctaccttctcagatggagtatgagcgccaagtggcttcattaaaagcagccaatgcagctgaaaatgacttctccgtgtcccaggcggagatgtcctcccgccaagccatgttagaaaatgcatctgacatcaaggtaaggtctcaaggggccccttccagtccacttacctagggaagagccagttctctcatcttccctgagtggctgtggtgtgtgaatgggttagttcagtgggaagaaagattggaggcattttccacaccttaggttctgccaacttgagcaagaagatagaaaaaccagtagaagtggggtccacccttggcagaaaatagtgtgggacagactagactagctgaggatgcatggggctcccattacaggcagcgaacagggcggggaccggctgtggggagaggaaggggattatgctggaggtagcggtttgtcagaggcttccctgcagggagaaagtggccgctcctgtcccaaagggagaattttcatgtgatcatcccttccctctgccacctctttcctgatggctgcagctggagaagttcagcatctccgctcatggcaaggagctgttcgtcaatgcagacctgtacattgtagccggccgccgctacgggctggtaggacccaatgggtgagaagaggagggagctggaggcaaaaaagggcctggagggaaaagaagagatttctcagtggtggccaggtcctaatagcttttattccccagcaagggcaagaccacactcctcaagcacattgccaaccgagccctgagcatccctcccaacattgatgtgttgctgtgtgagcagggtgagaccactggggagaaaaggggcttggtggggtgggcagttgggtagaaaagccagccagccaagaatagaagaaattgtggctatggagttggaagggatgtggagggagactggagaccgggaaagggatgctaaggaaaggaggggagggtcaatgaggaacttgagagtgttttatttggaacaagtacaaagagctgggcagggtcaggcaaaacagaaatgtaattgaagggaaagaaagatgagactcttggctcttgaggctgcctgactgttctccctctgcctcccagaggtggtagcagatgagacaccagcagtccaggctgttcttcgagctgacaccaagcgattgaagctgctggaagaggagcggcggcttcagggacagctggaacaaggggatgacacagctgctgagaggctagagaaggtagaggagatggcgcaggggacacgggcaaagacttgggggttcctgggaccctcagacgtgtgtcctcttctccctcctcccaggtgtatgaggaattgcgggccactggggcggcagctgcagaggccaaagcacggcggatcctggctggcctgggctttgaccctgaaatgcagaatcgacccacacagaagttctcagggggctggcgcatgcgtgtctccctggccaggtgggccattcacctcactgccctcccttccagcctcagaccaccggggcccttttcctctttcccttctcattcttccaaggccaatagggaggctcaaggcttacctctccctccttactatctgtgttgtgagaacttagggtctttctctatttatctccctacttggtggtgagttctcatcaacataccctgcagctgggtgcaatgggtcacgcctgtaatcccagcactttggaaggcagaggcaggaggattatcttcaacccaggagtttgagaccagcctgggcaatatagtgagactctatcttcacaaaagggggaagaaaacatatcctagcctgggcaacatagggagaccctgtctctacaaaaaatttaaagatcagctggatatggtggcgcacgctgtggtcacagctactctggaggctgaagtagaagtatcacttagacctgggagatttagactacagtgagcccttattgtgccactgcacgacagcctgggcaacagggcgagaccctgtctcaaaaaaattaaaccgtatcctgcccgagaacttctctgaggagagcttgggaaggagtgttcatggtctcaggctctatctccgagttttctctggggttgtctgagcaaggatctttctctccctgaccctgccctctgctacccaccctctagggcactgttcatggagcccacactgctgatgctggatgagcccaccaaccacctggacctcaacgctgtcatctggcttaataagtgcgttacggcctttgcatcattggttcccattctgcactttcttccccttccctccctgccctgttttcctttagcccttctccactgtgcctgtgagtggagctctattcagacccccctttccctcccagcccccgttgtctgcctgcttcctctgaattctctctcacttgaccactgtgacacttacaccctgttctctgaaacccagctacctccagggctggcggaagaccttgctgatcgtctcccatgaccagggcttcttggatgatgtctgcactgatatcatccacctcgatgcccagcggctccactactataggggcaattacagtaagtaggattgtgtgtggatgcagggaagagatagaacctcgaaaagaggcctgagtgggagggcctatttagataaactgaatcctgtcagaattccagacagtgatgcctaccccatcaccaccagtccctggttgtccctttgctgggaagaggagcaaccactgatgcctggtcccctcttctgccccagtgaccttcaaaaagatgtaccagcagaagcagaaagaactgctgaaacagtatgagaagcaagagaaaaagctgaaggagctgaaggcaggcgggaagtccaccaagcaggcggtgagcacctgagggacttctgggctgggggccactgttctctcctggcagtggaggaagaaggagactctggaacgctggcctacatttcaaggactgccgcgcagggctcaggtttctcttttttcctcttcctctccaggaaaaacaaacgaaggaagccctgactcggaagcagcagaaatgccgacggaaaaaccaagatgaggaatcccaggaggcccctgagctcctgaagcgccctaaggagtacactgtgcgcttcacttttccagaccccccaccactcagccctccagtgctgggtctgcatggtgagtgccgcgggcctctgctgctccacaggaagcaccggaagcatgtatgtgcaccctaaattctccaccaaggctgagattgctcctgttctccaaggccagcacatgagagggactttgcagggactgaaaagaatataaattgcttcttttcgtggctttcaggtgtgacattcggctaccagggacagaaaccactctttaagaacttggattttggcatcgacatggattcaaggagtgagttggcggggttgcctcagggatgtgtagcaggagccacagggagagtctctggggacctctttgaccacctgtcttccatcttgcagtttgcattgtgggccctaatggtgtggggaagagtacgctactcctgctgctgactggcaagctgacaccggtgagtcctggagccaaggagggagagcatgagaaatgtgaagacacagctgcttttgccagaagctggaatcagggagcctctcgagaatgtagagttaaatacagaactcatgatagatgattcatttccctaagaggggcagtagaggaggaaagagcttagatcagttcaggggggagagctaagagaattaagatagaactagggggcacacccacgtgttttggttatacaagaaatatatgtcttttatagaacgattaaaaattgcataaacgggccaggcacagtagctcactcctataatcccagcagggatcacctaaggtcaagagttccagaccagcctagccaacatagtgaaccccgcctctactaaaaatacaaaaattagccgtgtgcggtggcgcgcacctatatcctagctactcaggaggctgaggcagaattgctggaacctgggaggcgggggttgcagtgagctgagattgcaccattgcactccagcctgggcaacagagcgagactccatctcaaaaaaaaaaaaaaaaattggcctggcgtggtggcccacgcctataatcccaactctttgggggaggctgaggcaggcagatcacttgagcttaggagttaaaaaccagcctgagcccagtgtggtggctcacacctgtaatcccaacactttgggaagccgaggtgggagatcacctgaggtcaggagtttgagaccaacatgaagaaaccccatctctactaaaaatacaaaattagccagacgtggttgcacatgcctgtaatcccagctattttgggaggctgaggcaggagaatcacttgaacccaggaggcagaggttgcagtgagctgagattgcgctattgcactccagcctgggcaacaagagcaaaactccgtctaaaaaaaaaaaacagaccagcctgagcaacatggtgaaatcccatctctactaaaaatacaaaaattagctgggtatgttggtgcacgactgtagtcccagctactcgggaggctgaggtaggagaattgcttgagtccagggggcagaggttccagttagccgaggtcgtgccactgcactccagtctaagtgacagagtgaggctctgtcaaaaaaaaaaaaaaaatgcttaagtcaagagaaaaatctggagataaccagttttttttttttgttattttgttttgagacggagtctcactgtcgcccagcctggagtgcagtggtgcgatcttggcccactgcaacctccacctcccaggttcaagatattctcctgcctcagcctcctgaatagctgggattataggtacgccccaccatgcccagctactttttgtatttttagtagagacagggtttcaccatgttggtcaggctggtctcgaactcctgaccttgtgatccgcccgcctcagcctcccaaagtgctgggattacaggcgtgagccaccgctcccagctgagataaccagtattaatgttttagtggatatctttctccttttttctttgcaaatgtgcatataatttttaacaaaaatgggctgtcatatgagttgttgtgtagctagatttttccaaatatatcaagcatttttccatgcaattacttatttcatatgagtctaccttttttttttgagacagagtctcactctgtcacccaggctggagtgcagtggcacagtcttggctcactgcaacctccgtctcctgggttcacgcgattctcctgccttagcctcccgagtagctgggacaacaggcgcgtgctaccacgcccagctaattttttgtatttttagtagagatggtttcaccgtgttagccaggatggtcttgatctcctgacctcatgatctgcctgcgtcggcctcccagagtgctgggattacaggtgtgagccaccacgcccggcaaactctaccattttatttgaacttttgtaatatattgccatctagtgtgttagaaagtttgtagccatttctgctctctctagcagtgttgagaggccattttctcatatccagagattagatctttagaaaggtattattagattctccccaaaacactaaacttgccacatgaggcccttacgatgtaccattcgtgagtctcgctgtatggagagcaggtgttctttggctgtggttagtccctcctgcttgtccctcttgtcctccattttgcttaactccccttttgtcccttaactcttttactttgctcaccatgcctttgtcatattaggggaacatccctgttccttttcttttttgagacaaagtcttcccctgtccccgagggtggagtgcagtggtgcgatctcagcaacttccacctcctgggttaaaaccattcttgtgcctcagcctcctgagtagctgggattataggcatgtcccactatgcccagctaattattgtatttttagtagagacagggtttcacaatgttggccagcctggtctcaaactcctgaccttaagtgcctcctgacctgccttccttggcctcccaaagtgctgagattacaggcatgagccaccgtgcccagcccctattccttttcttatgcatacttgtccctggcccatttctggtgtttgtctctccttcagaaaagttggtgtatggacgaggtcaggagatcgagaccatcctggctaacatggtgaaatcccgtctctactaaaaatacaaaaaattagccgggtgtggtggcaggcacctgtattcccagctactggggaggctgaggcaggagaatggcgtgaacccggaaggtggaggttgcagtgagccgagatcgcgccactgcactccagcctgggggacagagcgagactccgtctcaaaaaaaaaaaaaaaaagttgatgtatggagctgcagcacctttttcccttgccctcctcttaactactttgtcttcccttgcagacccatggggaaatgagaaagaaccaccggctggtaagttggcattgggatttagggaatgataatctgatggaggaagtgtgactttaaccgaccacctccctctcttctcgggcagaaaattggcttcttcaaccagcagtatgcagagcagctgcgcatggaggagacgcccactgagtacctgcagcggggcttcaacctgccctaccaggatgcccgcaagtgcctgggccgcttcggcctggagagtcacgcccacaccatccagatctgcaaactctctggtaccacttcaggggccagggagggtgcccttcaccttatcattcatgtctacaaactgtacctagaggaaccgagaatgagggagcctcagctcacaaactggcacatcttgagggtttgccttcagaatgtgaggtgctaggtgtgacagccctccccttcctttgctacaggtggtcagaaggcgcgagttgtgtttgctgagctggcctgtcgggaacctgatgtcctcatcttggtgagtgagctgggctgtgggaaaagggataagggtaacagtaatggaagacgggagttgcagtgctcagtcatggaattcctcctatgtaggacgagccaaccaataacctggacatagagtctattgatgctctaggggaggccatcaatgaatacaagggtggtaagtcagctgagagtgtgccctcatccctgctccatggggaccaagctgtagtgtccttcactacagaagggcctaggactcccttatttcatgttctgattcccctctttctcctttcttcctgccctctgttgttgctatctttcttcaaagctgtgatcgttgtcagccatgatgcccgactcatcacagaaaccaattgccagctgtgggtggtggaggagcagagtgttagccaaatcgatggtgactttgaagactacaagcgggaggtgttggaggccctgggtgaagtcatggtcagccggccccgagagtgagctttccttcccagaagtctcccgagagacatatttgtgtggcctagaagtcctctgtggtctcccctcctctgaagactgcctctggcctgcagctgacctggcaaccattcaggcacatgaaggtggagtgtgaccttgatgtgaccgggatcccactctgattgcatccatttctctgaaagacttgtttgttctgcttctcttcatataactgagctggccttatccttggcatccccctaaacaaacaagaggtgaccaccttattgtgaggttccatccagccaagtttatgtggcctattgtctcaggactctcatcactcagaagcctgcctctgatttaccctacagcttcaggcccagctgccccccagtctttgggtggtgctgttcttttctggtggatttaatgctgactcactggtacaaacagctgttgaagctcagagctggaggtgagcttctgaggcctttgccattatccagcccaagatttggtgcctgcagcctcttgtctggttgaggacttggggcaggaaaggaatgctgctgaacttgaatttccctttacaaggggaagaaataaaggaaaggagttgctgccgacctgtcactgtttggagattgatgggagttggaactgttctcagtcttgatttgctttattcagttttctagcagcttttaatagtcccctcttccccactaaatggatcttgtttgcagtcttgctgacagtgtttgctgtttaaggatcataggattcctttcccccaacccttcacgcaaggaaaaagcaaagtgattcataccttctatcttggaacatgggtctctttcctttttttttttttttttttttttgacagaatcttgccctttcactcaggctggagtgcagtggcatgatcttggctcactgcagcctccacctcctgggttcaagcaattttcctgcctcagcctcccgagtagctgggattacaggcacacaccaccaggcccagctaattttagtgtttttaatagagacagggttttaccatgttggtcaggctggtctcgaactcttgacctcaagtaattcacctaccttgacttcctaaagtgctgggattatagggatgagccactgtgcccaacttctttttttttctcttttctgagacagggtcttgctgtgttgcccaggctagagtgcactgtaccctcaacctcctgggctcaagcaatccttccacctcagcctcctgagtagctgggactacaggcatgtgccgccacactcaactaatttttttttttttaatttttagtagagacagtgtcttgctatgttgcttaaggctggtcctgaactcctgacctcaggcagtcttcctacctcgacctcccaaagtgctggggtgctgggattatagacgtgagccacgacgcctagccagaatttgggtctcattgtccaagttaatctcatgaatgaggaggtgctctgccctgtggccagggaccagggtattgattctctcaaaaattattaaatcatctagccaaaatgtacggtactgtggggtatataagaagggaagagacaagatctgccttcattaatagtctggttagagaagacttaaaagtaagcatgaatagataattaatttgatcaattgtctaatatgtcgtactctagattctaagttgccacatactcaaaaaagggaaagattatccagggcctgattatttgacagggtcacttgagggtagatcttgaaaaatgatgatttgactaatcagggaccagggagccatttttcagaagtaggaaaagagcagatctcaggcttggggggaagaacaagctacttgggagttaatggatgatagctgctgtggccatttttcttaagagttagactggggagatgggtttggaaagtaaaatgcaaatggtgggtagtggtattaggtggtgatgtgcaaggcgtgctgtagaaacctgcagggtgaagcccataacttttgttacgggaatggggtaactgaatcctaaactagctaggggagatagggatggaaagagcagatgtggaggttggggagaagggagtgacaggagatatatccagttccagagggaatagggagagctgtgtggctaagatttaactgtttggacatttaatttggggaaattgttttccagccaagtgaataaataatactggacttcaagtacaagcttcatacaggaagtgaagttttggtgtggagatagctgcatagtcagggaacactctaaattaaaaataaggaggccgggcatggtggctcatgcctgtaatcccagcactttgggaggcgggcagatcatgaggtcaggagttcgagagcaccctgaccaacatattgaaaccccatctccactaaaaatacaaaaaaattagccgagcgtggtggtgcacacctgtagtcccagctactcaggaggctgaggcaggagaattgcttgaacccgggaggcagtggttgcagtgagccgaggttgcgccactgcactccagcctgagcaacagagcgagactctgtctcaaacaaaaaccaaaagacatcaggaaacatgcctcttatggaatttgagggggaaaagtcagggtcttggcagtgaccttggacaagccattagcctcttgatacctcttttctcatctgtaaaatgaaggtggtagttacctacttcacagggttattaggggattcaatgtgtaataatacgtaaagtgccttaaattctgttgcttttgttatatgtatttcatattatatatatatatatattttttttttttttttttgagatggagtcttactctgttgccaggctggagtgctgtggcgtgatcttggctcactgcaacctctgcctcctgggttcaagtaattctgctgtctcaccctcccaagtagctgagattacaggcacgtgccaccacgcccggctaagttttgtacttttggtagagatcaggttttgccatgttggccagtctggtctcaaactcctgacctcaggtgatctgcccacttcggcctcccaaagtgctgggattacaggcgtgagccaccgcacctggcctatacttttgcatttttaagtttttacttcgctagtctagttgagatgatacataaaatatataggaatgttatttataaagtgaataccagcttgcatttcaaatatttggtcactaatttcactacttcaaacataagtgagaaaagtactttaagtactccaaaataactttccgccacaggcataaatttcatttctctctctgttctttttttttttttttttttttaaagatgaggccttgctatattgcccaggctggtcccaaactcctggcctcaagcagtcctttctcctaggctccccaaagtgctgggattacaggaatgagccacggcacctggccacaaactttatctcctcccgtgtatgttttaacttctgtgatccctgtagccgatcatatgtgctgttaatggaattaataattcacctaaatgtgggcaaaagtatgccctccaaaaagcagcatagaaatggaacacgaaagggaaacatttccatggtagcgcatggaaatttcattaaccaaattaaattgttttatttataaacagcttattacctacaagtgatgcacatatgtggtacacagtaaacatcgtagaaatgtgttttttgttgttttgagatgtggtctccctctgtttcccaggctggagtgcagtggcacaatcatggctcactgcagcctcaaccctctggactcaagtgatcctcctacctcagcttctcaagtagctgggactacaagtgtccaccaacatgcccagccaattttttaatttttttgtagcaaagaggtcttgctttgttgcccgggctggtctcagactcctgggttcaagttatcctcccacctcagcctcattaaagccaaagcctgaaggtaggaaaggaagagccttcagggaagggaccaaaatgtgcaaagaccctgaggctgaaaagagctgaacatggtcaaggaatggctggagctgagaacttgagcatgcgccaatacacacggggccttatatgcatagacagcaggttgggatgtgatcaggagaggctgagcaatgggaggccattggttctgtttagccaggagtgcaaactgattcagttttcatttttacaaaattgctcctggctgctaggtggcaaatagtgggtgtggggagacagggaaaagagatgccaggagaacagctcaatattactttggaaagaagattctcttcatctaagaatggaatggaagggagataatgtagactcagatatttccatgtgaagggaagggaaaatgttgctcacagtggatgggactcactttttcccaagctttggtgccagagaatcaagaagagtaggccgcgcacggtgcctcatgcctgtaatcccagcactttgggaggccgaggcaggcggatcacctgaggtcaggagttcgagaccagcctgaccaacttggcaaaacaccgtctctactaaaaatgcaaaaattagccaggagtagtggcacgcatttgtaatcccagctactcaggaagctgaggcaggagaattacttgaacctgggaggtggaggttgcagtgagcggagatcatgccattggactccagcctgggcaacaagagcaaaacttcgtctcaaaaaaaaaaaaaggtttgctgagcagcagtaagtgtagaatcaatgctaacattaatttgtactgggctaagatagtaggattttgtgatttttcaacattaggtctactgcccaggagtaggaatgaaagaaataggataatgattctgaattgaagatagaccccgttgcacctggggaaggattgacagaaagagaacgttgaatgtcacaagggtattttagagggaaaaaatggaagcagaaaggaaaaacagactgaaacggtagagagaaaagtgcctgcagggagggcttggtgaagaaacatcattgtagtgaaatgaatgaaatgttcaacctctctccccctgcaaaaaaacaaaaaacaaggaaaatcttctctttatataatctaaagtttttacgtaagtaaaaaggaacaggtaggccgggtgccgtgactcacacctgtaatcccagcactttgggaggccaaggcgggtggatcacctgaggtcaggagttcgagaccagcctggacaacatggtaaaaccccatctctactaaaaatacagaaattagccaggcgtggtggcaggtgcctacaatcccagctactcaggaggctgaggcaggagaatccttgaacccagggggcagtgagccaagatcgtgccatttcactccagcctgggcaaaagagtgaaacttgtctaaaaaaaaaaaacaggtttctttgaattttttttttttttttttttgagatgaaattttgctgtcacccaggctggagtgcaatggcacgatctcagctcactgcaacctccgcctcctgggttcaaacgattcttctgcctcagcctccagagtagctgggattacaggcaccagtcaccacgcccggctaattttttgtatttttagtagagacggtttcaccatgttggtcaggttgctctcgaactcctgatctcaggtgatccacgcgcctcggcctcccaaagtgctgggattacaggcgtgagccaccacgcctggccgaattttcataaatgatttgaaagaaaatgagctcattctttctttttttttcagacggagtcttgctctgtcgccatcctggaatgcagtagcgttatctcggctcactgcaacctctgcctcctggattcaagcgattcccctgcctcagcctcccaagtagctgggactacaggtgcgtgccaccactcccggctaatttttttttttttttgagacagagtcttgctctgtcgcccaggctggagtgcagtggcgcgatctctgctcgctgcaagctccacctcccgggttcatgccattctcctgcctcagtctcctcagtagctgggattacaggcacccgccaccacacccacctaagtttttgtatttttagtagagaaggggtttcaccttgttagccaggatggtctccatctcctgacctcatgatctgcccgcttcggcctcccaaagtgctgggattacaggcgtgagccaccgcgcctggcaatttttgtatttttaatagagacggggtttcaccatgttggctaggatggtctccatctcctgaccttgggatttgcccgcctcggcctcccagagtgttgggattacaggtgtgagccaccgcgctcggccgagcttattcttaaaatacagtaaaaactttaagctctcttttaaggttcttgtggcttgttgcaggagatagaagaaaggtgagaagcaggcagtaaatggaagcagaaagagacacaaagttgtgaccactaggttgtgacatgtttgggttttttcacttgagctgtatacttctttggtatttcacgccctagcctggtccttagattatgtcttctcaggtcttctcccagtgcacacagcaacaacagactgacctgaacacctccgcccacacacaccaagcctgggcaaggggaaggtaaaactacccactttgggcctacatgcagtgaggcctttcagatactgataaaacattgttgccccctcatgtggccaatgctggaaatacagctgagacacgtattccagggcagtgtagcagcctcagcaactgggaatttgttagaaatgcatatctcgggatccatcctgacctactaaatcagaattttgctggaccctacccccaatctgtctgttttttctttttgttttgtttttgttttttgagatggagatggagtctggctctgtcacccaagctgaagtgcagtggtgtgatctctgctcactgcaacctccacttcccgggttcaagtgattctcctgctttagtctcccaagtagctgggattacaggcgcgagccaccatgcctgactaatttttgtatttttagtagagatgggatttcaccatgttggccaggctggtcacaaactcctcacctcaggtgatccatccgccttggcctctcaaagtgctgggattacaggcataagccactgcatccaacccaaatttgtttttttttttctttcttttttttttttttttttttgagaccaagtttcgctcttgttacccagactggagtgcaatggtgcgatctcggctcaccacgacctccacctcccgggttcaagcaattctcctgcctcggcctcccgagtagctgggattacaggcatgcgccaccacgcccggctaatttttgtatttttagtggagacgggggttctccatgttggtcaggctggtctcgaactcctgacctcctgatctacccgccttggcctcccaaagtgctgggtttacaggtatgagccactgcacccggccccagatttgttttctaataagctcttcagatgatcctgatgaatgctaacagacttgaaaaccgccattctcaacccacatgttaaaacatgttaatatcttcaactgccccatatctgccacacacactccccccagagtgatgtatcctttcttttttttttcagatggagtttcactcttgttgcccaggctggagtgcagtggtgcagtctgcaacctctgcctcctgggttcaagcgattctcctgccttccgagtagctgggataacaggcgccagtaaccacacccagctaatttttgtatttttagtagagatggggtttcttcatgttggccaggctggtctcgaacttctgacctcaggtgatccaactgcttcggcctcccaaggtgctgggattacaggcgtgagccaccacgcccagctttaatttctggtttaagagtggaggccaggcgcggaaatggggaaatggagtttccctatgttgcttagggtagttttgaactcctgggttcaagtgatcgtcccatgtgggcctcccaaagtgctgggattacaggcgtgagccaacatgcccagctttaatttctggtttaagaagagtggaggccaggcgcggaaatggggaaatggagcttccctatgttgcttagggtagttttgaactcctgggttcaagtgatcctcccatgttggcgtcccaaagtgctcggattactggcttgagccaccatgcctggccagagccactttgggaagagcagtctatacttaccctttgtttttttgtgacggaattttgccctgtcactcaggctggagtgcagtggcatgatctcggcccactgcaacctgcacctcctgggtttaagggattctcccgcctcagcctccggagtagctgggttataggcacccagctaatgtttgtatttttagtagagacggggttttgtcatgttggccaggctggtctccaactcctgacctcaggtgatccacccacctcgccttcccaaagtgatgggattacaggcatgacccaatatgcctggctttttttttttttttttttttttgagacagggtcttgctctgttgctccggctggattgcagtggtacaatcatagctgtgagtttgaactcccaggctcaagtgatcctctcgcctcagcctcccaggtagctggaactaaaggcatgtgccaccatgcctaatattttttgtattttttgtacagacctggtctccctatgttgctcaggctggtctcaaactcctgggctcaagtagtcttcccacctcggcctcccaaaagtgctgggattacagacatgagccactgatacccaacactaacctggctaaggtcacccaggctgtagagaggtagagctgggacaatggcctttatctgactccagcatcctcaggatttcctcccttatctgtagaatgtggataagatgaccaagaacacatcctagagggcacgatagccaggataggactgttctaggaacacacacgaggcgtgttaaagaagactcagaaagatgaaaaccaggaaagagccctgtggccgagatctactctgtatcctagagtattttatgtactttttgaagcattttttcaccagtacttaatagcaactgttagatcaagcattagctccagaggagtaaaaatcagattccacagatttgtactaatgtatctaacacaggtggtaatggcttttaaaaaaaaaaaaatgaaaaacagtccaggccgggcgcggtggctcacgcctgtaatcccagcgctttgggaggccgtggcgggcagatcacgaggtcaggagttccagaccagcctggccaacatggtgaaaccaagtctctactaaaaatacaaaaaaattagccaggcatggtggcaggtgcctggaatcccagctactcagaagactgaggcagaagaatcccttgaacccaggaggcagagattgcagtaagccaagactgcaccactgcattctagcccaggcaacggagcgagactccgtctcaaaaaagtccaaacacactaggggttaaataagctgcttctctttccactgtttattattaatgtacaaaatatacaaaaccaaaaaaaaaaatactcatcctcaaatccattttggctctaacccaagaccctgcacaaaacccaaccaatccactgttttcatagaaaacaactgatgccaaagtgaaggagagaactgggaaagggcaaaatcatcttgttgaatccacccaggaaggcgcctggtggggattcagaggtggttgacagggtgaagtacctggaagcctccttcacgctggcaaggttccaggtgggagcagggagtgagctgactcccaaaggcagtgcatgtagtgtgactttcaggcccagcacgccgggcccaagttgatgagaagctggtctcactgaagtattttatcaagtctccagactggctatagttggcaaaggcagaccagcaccaccggtctcacctctgccagctaaaacttgcaccggatgcagatacgagttcgccatcatcgaacctagcagacccaggacgcagactgggtgttcacagaaagttgaaggtcccacttgagaaaggactaagaatggtgagcccacgctgggggaggggtggggatgatgtgtgttccagaactcaaatccagctgattgagccctctcagtgcagtgggatatacaatacccctttcagcatctccccaccccatgaggaataatgaacttagctgggatgatttcttaagtgcagctgatcctgtgtcagagttctgtgtgcatgtggggacccgcaatagaagggtaggggtgttcgccaggataaccagctttaggttctcaagcattaagggtaatactggaaaggggtttggggtacagggcgaatcttctcaaaaagtgaagccaactgggtctcctcttcagcagtccaggaacgtttccagtctctctcctccccagactggaggaaaatatgtacatcaatgcgcaccagtgatcagaaaacccccaggaacccaagcaagtgggaactgagggggccggctcctcatcagctggggaaaagggaaaatgggcctcacagaagccataacagggtggaaagagcgaggctgcagtccacaggggttgtgtgaacagggcaggcaaatggtccctagggcagggggggcccattgacacccgggtggtagaaggcacagttgttctcatagcggcagttgcccttcatcatgaaatgtcggcagacagggcggtttgacatgtctgtgggaacgatggcaaaacagttagacaggaaatagctgagggcaatgccaccctcaccaccccttgtccatgacatcctgagaactgtctttcagagacaatcttggggatttgggggaagggcatagagtaggaactgctatgcatactaggacatcaaagagacgggtacctcacgttctgcctagctaccaacagtagtgactctcacccactccccaaaagcttgtatgggacaaccaaaaggcatatgggggacagggagcatcctcacctcctccatggctgtggcctccatcgtgccctcggtggccccctcccccgtggccaggaccatcatggccacggtgctcatgaggtggcggccctcgatggtcatggcctcggtgaccagggacatcatgaggccggtggccatggggccccccgtgtccagggccttcatggggacgatgtccaccacttccacccatgcttccgccagggccttcgtgggggcgatgtccaccaccggcacccattcctccgccagggccttcatggggacgatggccactgccaccactgatgccaccgccagggccttcgtggggacgatgtcctccacccccacccatgctaccaccagggccttcatgggggcgatgcccacttcccatgccaccgccagggccttcgtggggacgatgtccactgctgttgcccatgcccccaccagggccttcgtgaggacgatgcccaccacctccaaccatgcccccaccagggccccctcgtccatttgggggtcctcctccagagcgacctcctctggcgcctcggaatggaggaggaggaggaggaggttcgtttcctcctcggccacctcggcctctatggtatggtccaggacctggtcctggacccccccgcattgggccaccccgcatagggtcgcccgggccatcccagaagggatcacctccccggggagggggtggaggacccagaagacgtggacccactggcccaccagggcctccatggggacctgtaaggggacaaaaaagagagacagtatcagctaccaggaactgccatctcccaacctaaaccaccacctcccaccttccagtcaatcctatactattatcagactgaaattaagcagataagcccattccaaccttttactcaccacctacctggcataggtcccccaggtccagggggaaagtgctgcatgcccttggggcccccaggaccccctggtgggaaaccattggctattgggccagggcctaggagtccatgtggcactgttaatgaaaacaagagtaacacagcatgagcactctagaagactagcatgatctcccatttaggtgcaaccaactgaccctctcaaaccaacctggcagagcaatgctctctctgtccagtcttcccctcccatttcttgcctagtggccacagccctgtattcttctgcatctttgaaaccctgcttcccccaactccactgcaggcttcctcccccagtcccctggggctggccctgaagattacccagcatctgcttgatcttgtccgaatagtctggttgtttcagtagttcctctgaaggatgactgtttgggctaccctgtgaggatgtaagaaggcaaagtcaacagacagaaagggtaacaaccatggcgaaagatagcgccaaagattaggggtaagtgggtagatgtggagaactggggtaaggcgaatgggagacagtgaggagagcgagcttaaggaggctccacagaaggtggaaaaggggaaggagggtgcgtaccatgatggaggtgaggatctcttggacattaatgcctcctcctccagggccttgggggccctttccagcacccatgcttcccataagattggccagaactggaggcaacttggagcctcctgccccatcaggtgagccacctgaccccccaggttccagagtctcaacatacggagtctcatccatggaacactcctgaaagaagaacaaaaaaaatcaggattgacagaacagagacattctcatatgaaagatgcaccgaattcaatgaccatcacaacttccatcatcacagaacattgacttacctcatctagggggatgagtttagggggtatgggctcgtagggctcaggatcaggctcatgaggactatcaggaacaacacaggtgagagaaaaaagaatgatagtcaagttattaattcagaccctgaaagtaatttctaacctccaccccgtaattaccccagctcatgttccctcaggagtgtccaagcactcaacatcccagggcacgaaccccactctgctcacctctccttgttcaggaagagctcctgaaggattcccttctcccgctcagcctggatatatcgctcctgactattgcttccaggggtgacaagaggtgagggcagaaccaggggccgggggcacacccagggcaccttctcctccatgttatcatggctcagacgccgcgctgtctcaaatgcatgtcggtctgacagtatctctcgcttagccgcctcaccaaagtccttgatcttattcacatttactgtcggcaggggaagaaaagcaagagggaaagtaagcacaaccaagtcctttcaaaatcccttaaacacacctattacgtaggaaatgacctcttacctcgttcagtttcatccaattcaaaatagaaatattctctcagtttgccttcctcaggccatgtcacacttttcctcttcctgcctttccgggtcagttggttaggatctccaggactctccactggcttggcatccagagctcctggctccaaagaggctggaagcagaagaggtttcagacccagatccctcctttcagaaaaccccccaaactgaaccagtttctagattacctgtatccatgagctccgggacttcaacagggggaaccggggtgcctggacggtctgcgtccattgcctcagaaggtggtgctggttctggggaagaaggtttggctgtgcttggttctgtgctcgttttcccttcaaaggggcttggctattgtgaaagaaaaggaagttaatgaactgactggaaagccaagggcaaggcaattagtccagggtcccaggcacagtcccccaacagttcctatataaaggaagactctgtctccacaatgtctcacctgcaccagtctatatccaaggcaaaacgcctcttgttgtcctccccgacaactcctagctgctgtgccctttcttctactttaccttttatactctgtcactgaaacctacttctgggagcccataccttggcagccgtaggtgacagtactttttttttcttcttaattttgatgcctggaacaggggctgaattaagagcatccagaaagcccaggccctccatagctacaaaaagaaagagcaccaaatggcatcatcagacctccttcataatcctacacctgcaaacacagtccaggcataaaatgagccagtgaagaccctgcctcaacttaggacacgataagctcaagaggaccaggaagcacatgcaggaggattcacacaggatattcttgttgttattctaggtttctcatggcaggcaagccatagctttggatgtgaattatagctcaggtagctgacgaagtgagcccttgtgaacatgacagatcaccttaccaggtgcccctgaccagtcacagaatggcacacgtccctatcttatctctaaaattactcctaagtgacccctgaaacgggagttccagaggtacaaaaagtaagggataccaagaaatcaaaggaaaatggagggaaataataaaagagaagggaaaaaacttctcgttcccagggacattcattcccataagagtttgctcctggccaggtgcggtggctcatgcctgtaatcccagcactttgggaagctgaggtgggtggatcacgaggtcaggaaatcaagaccatcctggctaacatggtgaaaccccatctctactaaaaatacaaaaaattagccgggcgtggtggcgggcaccagtagtcccagctactcgggaggctgaggcaggagaatggcgtgaacccgggaggcggagcttgcagtgagccaagaccgtgccactgcactccagcctgggtgacagagtgagactctgtctccaaaaaaaaaaaaaaaaaagtttgctcctaattcaaagtacatcttccccactttagactcacgctgtggcgggatgatcttcactttgatctctttggtggcattaggtgttgtgttgagtggcttgtatttcttctctgcagggggagtggcatctcctggagcagctacgttgctgtcagaagaggaactgtcatcaacatctccgactcaccccctcctgctcccttgtgtccacagatccaccccattcagagcctgagaatatggtccatacctctgacgtttgagggggatgggtttaaggttgtacttgtcagaaaccaccactgtgctggcattcttcttcacaggcaccaaggatggtgtctccagctctagtcctggggaaagaagcacggtgtgggcagctgaactcaaaccccagacccccgaattttcctcccgttctcacccgcaaatgttcttctagccttgtaaccaaagcttcctctgctagtcttccctcttccttacgattaacataccacacatcaaatgattcccccataaggctctgggtgtgcacatgcccatgaaccctccagaggccagccgccagtcttaccagtggaacggaacttggcatgactgggtgctgtggtgcgaagagacttgggcttctccctcttcttctctggggcctcctcagcccgggtctcagccttcacctctgtcaaaggtcgctcaggaagggtagttcgactttttccttcatctttacgtttcttcttatctttctctgttgtgaaaaaacaaagcagaaaaggattttatttagatgaacactgtcagaggtgaagcagactgggagcacctaaaggccacatcccaataggaaagaaataaatacaaaggataaaggactaaggagcttaccagcaggctgggtactgctctgagagcggatgacagccatccagtcgctgacaaggactgaggccaatttccggagctctgcaggtgacagaaaggggaaatgcctaaataatgtaaagtaacattcttccaggaacagaaaatgggaggtttgagaaaatattgtgaaaatttatgtaacggagaaagtaacccaaagttttaagaagaacatgagatatgcttaaaaaccaaacccttaaaaaatggaacaatgaattagagttgtgttctacttggataactttcaactctgatgtcatcacaccactctggagtaaaaagacctaatatttcagaatatgtggttaaaatctacattagtaaaagactacacgttgggtgcagtgtacactgcttgggtgatgagtgtaccaaaatctcagaaatcaccattaaagaacttatacatgtaaccaaaatccaccagttcctcaaaaactgacatttttttaaaaagctacgttagttgctttatgtataacacacctaattgttacaacaatctgaagactttttattttcctttatagatgtgaaaacaagaataaaatttgtttctaaatatatgaaaaaatactttgtaactctttccttttgtacttggcaaataacatctctgatctatggcacctctcttctggccaacatttccacttataaactcatttcataatttatcatttagtaataggagtttcacagatgagacacgctaggatgatactatttcccacagcaaattttaagtgtatgtgttttataacaagcaattttaggaatcagcttccagttaaagtatggcaccttatattcagcaacagagaaatgaacaactttggaattgagaacaggaaagagggtacaggttagaggaactttctctttaaaagaaggaaaaaaagcaaggtgaggtagaaagagaaaagtgaagggacaatccaaggatgggaaaagatattaaggtaattaagtggaagtaatagagaaaagcccatgagagagcagaagtggcaccctaccttcatcctcacttgacttgctcagctgcttcaccagtttagctgtgttgttctatgagagatgggagcagcagaaaggtaaatgccaggaggcaaataattccacttagagctaaaaacgacaaaagttacagtcctccctgcttttttttttttttttattttttgagacggagtctcactctgttgcccaggctagagtgcagtggcgcagtcttggctcactgcagcctcgacctcccaggctcaaatgattctcccacctgagcctcctaaataactgagactacaggcatgcaccaccacatctgggtaaattttttgtattttttgtagagacagagttttatcatttttgcccacgctggtcttgaactactgggctcaagcaatccacccacctcagcatcccaaagtgttgggattacaggtgtgagccaccacacctggctgacacattccttttttttttttttttttgagacgaagtctcactctgtcgcccaggctggagtgcagtggtgcgatctcggctcacaataacctccacctcctgggttcaagcgattctccagcctcagcctcctgattagctgggactacaggcgcatgccaccatgcctggctaattttttgtatttttagtggagacggggtttcaccacgtcagccaggatggtctcagtctcctgacctcatgatccgcccgcctcagcctctcaaagtgctgggatcacaggcgtgagccaccgtgcccagccgccacacacctattaaaggagataaattcaaaccaagtcttcttcttctaaattcctattttttttctgctgttctacctcacaggcccaagattacagccacatcagtcagtttgagtttttcatccattagactaaaccaaaaaaggaagaatcagggtttaaagactaaaggtacctgcttgagatggtctacagtgagcggtagatgctgcagggtcagtagaatttgctggaggaggggaatgttgttggttgtctttgaatacgtcagccaattgttaagaagtttgtagccgccaacgtcaataaatctgcaggcaggcaggagagtctatcagtaatgccctttctaggttttgacagtaccacatcctacaatcccagtctcccatcaatgaccgaggaaccccatgcctcaccgccccatcttttcgctacaccttcccattccaaccatccagatccccacttacttgaccaatatttctggtgaacgggtctgcaggagaatgttcaagtaagtgcatcgactcaccatctttcgtgcttccttcatcaaactgcagaagatgagttagggttagaaatgaagcagccagtatctcttctcttagcaaaagcgcctctctgtgaactgcctagagattcctaatgacttgggactttgctccagagaaggggagtcacatatacctctaggaagatgggatggatccagtgtgacatggaaacttatgggagaacagagacaccgcagtctctgacctggggaggagagcatcgctgcctccgtaacacacaggatgaattccattctgcctccaggtgataaggctatccctcaacaactgtccctaatagtctgttcaagactggcttagttatttactctcccctgaaaaacctgagaatccctgaaggaaaataacattatgggtaggtggaacacgaaccaaaacaatctagaattctgttaccaggctaccctgctctcattccaaagcatgactcccttgggaccgtggacgtccaaatctccagtttccattatggtcagaaacaagtgatcatcttttcctatcccttatcctaaaattgttacattttaatcctattgcactgactatctttccctttcctttccaggatcattccagtgtgcctcaactgcagccatgttttaacacacaatattctctactcacagtgaatacaaaaaggggtaaagactcacctgaagatcttggaaatcccatccacacttttgacttccccatctcggttaaggaagctgtccaggcccttgagaagttctttggggtctatgggacccgaacccatgatggtggtttctatggtaagaggacaaaacaaacaaacccacagaataaatgggtggcaaggactacccgagtaggccctctaataaaccacatctctatatttgacaaagtataatgactaattattcaactatgctattttttagatatgaaaaatcgacacagaccacttgccactactgagaaaatagccctggcaagttaagcatggggagcatatgtgactgaacaggaaagcaattcgattggaggagtagggcagcacacctgtccctccctcccagcagcatccttcctaggatggctgaacttcactagatcgtattaaagctaagatcagttcccataacaagatgttcaactctccagggcatttacacctatcgttaagtcctgtcttccctagttgctgataaatttggcttgaaaaacagcctatagcttgatagaaattgggccaatcttgggtgtttgagctaaatgtcttataagacttgagtcctttttatcttagcccattaagagtcataatcactacacatggcaagatatgtatcagctgaagtggtagatgatggagaacaaaacaaaacttgaaaacagaatccctccctaaggagatctgggagtaggtgccagagattgagacaaatggatgcatggaaatcaagcaggtcctcctagaccttgaatagactgtcactcattagccaaacactacacaagtttttactgtctctaagttaaaaggaagctagtggtttgtgctttcaaaagcaaagatgcgaatctggtcctctcctcaaaaatcacgctgtacaagatcccctaggaaagcctaaaactgaaaaccatggaacctaaaaagggaacagataaagccaaatgctagaaaaattcccttttaagcagctgttttagaccaggttgggaagggaattagttaaaagctaagctccttttatggaagggacaagccagaactgaagttccagaaaggtaatttaggatcaatatggttctgattgggatttttatctacactgcctctaaatacttgcttctaagacccaaaaaagaggctgggtgcagtggctcatgcctgtaatcccagcactttgggaggccaaggtgggcagattccttgagcgcaggagtttgaaaccagccttggcaacatggcgaaacctcatctctacaaaacataagtcgagtgtgatggtgtgcacctgtagtcccagctacccgggaggctgacgtgggaaaacgggaggactgcttgagcccagggatactgaggctacaatgagctgtgattgtgccactgcactccagcctgagagacagagtaagacgctgcctcaaaaacaaacaaacaaaaaaccaccaaaaaagaaagccacttcagcaatatctgcctttgggcaataaggcccacactgagtagcaaggaagaggcaagaacaaaaccttcctcatcctacatctagcacagaagtaacagacacaatcccagcagaagggtagaaaaatcagtattttacaaagatgagtagttttgtgccggaaaaaacacaggtttcttgtaagacaatgcaaattagttctacttgttctcaaacaaaagaaaaaacatagcataacaatctcagcctttttgtcctcccaacaaaaacgtcagtaagtttccaaatgtgtaggtcctaacaacctaggcgagcagcagcagaagcagggaggaggcagccaggaagggtaggagtataatcttggctctggagatcataacctgtgggctgaacagagggagagatgaggcaagaaatgttgagaagtcgctgctgccctggaacctccacaaatacaagtggaacctgaggtcagagaaaaaacattcaaggagaatactggaaaagattagatgtccgtgggccaaatccactcaagtgtggtgattcctacacacacagagacagacacagaaataaaggtattcttcccatgtagtgagatactataaagtgatctatagaaactataaagagatacgataaagggacacataaaacagatatcacatctgttggagactggaaaagcaatgtatgggttccaataacaacatatcataagcaatcaagagactaagaaatttttaaaactccctctctctatatatacacacatacctaccattagattcctaaagcaaaatatatgcaatttgacaaaaggccttgaattaaacatcatttcaaaccagttacccttgactgattcaaacccagagttgaatatatataaccctggagaattcctttttgcatatccaactacaagctaagccaataaatagacctactacccctatttccttcagacactaaataaactgtcatctgagctcaagtgttccttaagaggatgggagacaagaaagaagagccagtcttagaaaaatggaccaatgagtacaaagctaaattctgtccagtgccctctgctggaaatgggatccagggacttttttattcccacatgtataaacaagaataaaagacattaatagtcaaagggaagctaagagacaaagcaaaattagcgttaaatattcattttccactacttatattttggaaatataagtgaaattttgtctcatgagcaccaatcttgataaaatgtaagtgggttttctcatgatggccttccttcaggaagattagttcttatttaaaattaaggaccccaagtgtcttataacctagtttccttgctttgaagtcagtatattttggaaaaaaaccaaacaatttccaaggcgctcaagtggaaaggaatgtaaagtccaacatttcgggcacagggctacagcagagaaggcaaactgagttgatgaaggcaggcaggggccgtgactaagtgttgtaacattacctactcaagatctggagtctagaatgaaagcttaagaaagctttctggaaccacaagtaatccacggcatgattatgtcttcttttaatgagctgctattttcttgactgcagaacatacagaaggtggggagtgaggtagcaaccccctggcctacctccacctcatcctaagctatgcgttccttatggagaatgtttcaggcagagccatactctactggcacaaggcattggggaattttctaccatttttaccagagataaacgtctgtgacaccaactcctgccttcaaaatgaattttacttgagggttattcaattaaatagggtgaaaaaatatccagcatagctaaagttattccacacccatcaccaatgaaacaggactgaattggttcaggataaaaattctgtgcaagtcagagctctttaaaaaataactgtcttctaacaaaaggagaaaaaagtcccaaatttaccttaatttagaggcacttctggaaatgaaaatgatttgtacctaaccccttatgttccccttcctttcttcagtgttttaggcacttcctagtttgacacaatagtggactgaattatgtctctcaggtgattcatcacaaggtcatagctttcttccaagtagtaagcccctacccctcagtcattttgcaaacctgatacatgagctcctcaaaagcttatctgccttccaataaagatgcaaaatgatataccaccctgactcatagaaaaagaccccagactagaactctggccacaaactacaaggatcaggttttccaagattttctgaatggatgtggttcccctagtagacctggcttcccatctcccatgttaaggaagatcttctttattaatcccctggctcactagagatcaggaaccccagtgggtagaatgttcagctcccaaggaagatatgctgcagaggcacatggcaaactgcttaaaagaaaaaaacaaaacaaaacaaaaaaagcttgtagtcaacagacatgtgaagagtccctcccatccaatccagaagcttaagtaataatttgagaatctgtacccagtaggaagttagccctaagtctcacccaggtcaccagagggcagttatactttccaattctgcctagaacctccacgcttcagtgcaggacttttaaaaattaaaattatatggagagtctgataaagatttgactttgaaaaatttgggggaagaaaggaaccagacacccaataccaccctcagatagggcatggcttctgaacatgcaccaaatgccacagcactgcatgagttgaaaaatgaagaggacatcattttttcattaatgcttttaggaatttcttttagaagggaaggaaaaagaaattcaaaaaaggtggctctttggggaaaaaaaaaaaatgaaagttgtgaaatgtaataccagaaaggttttgcttaccagaaaccgtagcttgattccccctgccttgagtttacaactgccgcctcctttcctaaagattcacttcttatcctagtaccaatgtacaggaactaatcaagtgcagaacgtgatacagcactgaatacagtttatccccaaactgagaggtgggaatgagggcgatttagaagaaagtcctaaaagtacccaccttcccccgattctcattacacaaagcgaccaaatgcaggaggcccactggttcctaagcagaaatggcacacttcagtgtcattaggcccgtttatctccaagttactcttgcaagcccttgtgtctttcccatctccctctacacacatatatacatacacacacgctcacacacatcctcaaagcttcccagtcttaggtttgcctgttttttcacccctggcagctgaagtggggaaaaattacaagcagttgtgatgagtgaaggaaagtgaaaataaaaactggttctataaaaactagaactacacagagatggacagccttgatacttaattcctataagctcctatccctttaagatattttatataatgaaaataaggaaaatgtcttctccctagcagcaacgagcacaggcagtgcaaaagcatctgctcaggggtggagcttcaagagggtggagagaggaggaagaaagctgattacatcacctttcaaggctgctcctcccacttgaccaagtttctagggcggccctaagctcaggatggcaaaagggggagaaaaacaacaaagacggagggacgccattttgtaatggagaaagaggacttaaactaaaaagccacccggctctgccggtagcttcagttacattataaaacacctttttagtaaaaaaaaaaaaaaaaaaaatcaaaaaccagttccccatcgtgaataatctttgacctattttgatcagtaagagcgtagtgaaaattaaagcaattaaaatattaaaaagaacaattttctgcagggaagaactgaatttgcaacggaggttcaaccggctaccatcgaccacccccatcctccctatagagggaaagggggaggaaggacttggacccctctcaacaaatagggttgaggtgggaggacaggaaaaaaaatgggtcaagacacaacctgcaacgccgcttggaagacaaaaggacaaggaaagtcgccatattgaagcagggaagaaaaaaattccttttaacgacacaaatcttttagaaagctagcattcaattgcactaaatggcttttaaaattatactcctaaattccacatttcccaacctttccaccctctatttaactgtacctcccccaccaaaaaatatcaagttaaaatgttaatcactcttttgcttttaaatacctatgcaatctgcaacaattataagacattctttacctccccaactattatcttgtatgtactggcactaagattatattttgtcctaagtgtcttgcaatctttattcctagattgccacctattttaaccacacaaatataccccaagcaaattacattaaaattgagaggatttaacagtcatttaaaaagttatagcgagctattacttctctctgcccatctccttaccctgcaatctttatgtacagattgcttattaatctggcaaattgaaaggcaccctgcttgtctcacacacaaagaagtggtacttctgggccacaagatccaccatctcttgtatgtgagctcattaacccttttgaagactgctgctaaccagaggaaggtaaccattcctccttatataaacacatatggctttggcagtctggaaattggctggattaccaagggttaaccatcaaaatcctcacttgctggccctccctccaccctctctttgcctgcagcaaggcagggaagagataggtggtaggggagagagaacaagactgtttagacccacaggccctttttaatggagattaagtgaccagattggtccttctccagttctctatttgttctatggtctcatttcttcctctcattatttttggtttcacaacgggaaacgttgatttcttgttgcaaggctggtttttgaaaattcgacacttactatccaatttttttgcgacgtcagcacctcgggctcaggggggagggggtaaaattttggaggaaaaaaaataaaacaaccaaccaggacccaaaactcaattatttagggggcctcattggatcaaaaagtcttttaaaaaataaaggccaactcagtattcatttcccccccacccaactccatttagggaggggggtcgcagaaaaaagttctgagtggattcaaaaaagtaaacgctggatgagtgaatttgggtggtttgggaagggagggtggttgattatttttgaagttatgtagtgacggtccttcggccacagatttcaagtcccaagcagcgtgggctggtggggtgggcaagataggtgggaaggggcagaagacacaagtggttgggctggtggctgctgttttccctttcccccctctctcaggatcctttcaagggcttagatgttgctgcggcttgtttctgttttcctcgtggccggcctgtctttctccgagaaaattcaaacctgggataaaaggaacacaagggagaaagatgtaatcagtacgggttgcttcaaaacactcacaaatgccatctttgttgtccccaaacaaacctgtgtcccatcctgatcgcaaccgctttaagccgtggctctcaaatgaacccatccatccctatcccgcttcccagatccaacgctctccgcaaaattttacccactagacgacaaagtaggcaaacttacctctaaacgaaccccagaatggcggccgcccgctcgggtggagtcttttatacccggacgccgcccaacgcgcccaaacgtgctagtgaaacgcccttgtcgcgagacattatacgcgaggcgtgaactcattggtcaacccaaatgacaactcgccaactgattggctactctcacttcacctttgctccgcccctttccctggcactctcttccgcctccttcctgcctccctgtcgcgtgcgcgtgaccaggagcctagcacctccctttcctctgcttccgccacttccgccctggagaacatttctcacccaggattggtagaaacctaagagcgcatgcgcactgagaggataccgctaaaaatcgccttcaaaattgcttaaaaggcaaactttaacaatgcgatctaagagtcgtagtgactggccaaaaaaaaccgcaattttggggtctaattcgattgtgacgcagttgaaattagcttctcccccatgccttccctttcacgcttccgtcctgacgcaaacgtggggccgccttccgcactgcgggcttgtccttggccctgccctactcagtttcctgaagcatgcgcagttgcctttccgtcaattcctgtcctgggcgtacgtcaagatggcggcgtctgtattaaacaccgtgctgaggcggcttcctatgctatctctcttccgaggttctcacagagttcaggtaactcttcgaaagacattttgcacaacctcaagttggttataccttctcgaggttgtcgctccactgtcaggaatccacgagtggagaccttcccacgtgtgtcttagctgtctaggcagtacttcctgcaaccccccccccacaccccgcgcattttctaatcccgagccgaggactaaacgccagggttaggtatcatcctttttccaaaatgccatttcagtaaaataacttaagtgatggaattgacccctgtccaccctcagtcatgcataaccagctttttaaaaattatttaactaattaaggggccatgctaatctctgtatcgttgcaattttagcataacatatgtactccccaagcgagcgccacaaccagctgttaactatgcaagtggtgactaaatctgtgttgctctggaatgtccttggggaaattagggatcccaatttctaccaaccttgctatttctcaataaggtcaggatatattcttacgacctgaggacagtttctcagctctctttattaaatcagtttcttatcggagttatgagagcttaactccgtcctttgaattgaggtttccctccagtcttgtgtactcacctctctggaggttcttggtggggcacggtgagataggaaggcttgcccagctgccactccctaaagtgggactgaagagtggtgacagaggtcaacacagaaataataacagccttggtagctttaaaactagcgttaggactcaagtttgttctgccctgtagaatgttgaccttcagcttttatgaaaatgggcaactcagtgacttcattggattgatttggagactcacctgtcttctgcatcccctccccaccacacatcttagttccaagaacctagatatccttcctcttactttattcttccaccagagtcaatttatttccaaaaagcaagaataccttttatgtactagatttttttttcttttttctttacacgaaatctcactctgttgccaggttggagtgtagtggcgcaatcttggctcactgcaacctccgcctcccgggttcaagtgattctcttgcctcagcctcccgagtagctgggactacaggcgcatgccaccacgccgaactaatttttgtatttttagtagagataaggtttcaccatgttggccaggatggtctcgatgtcttgacctcatgatccgcctgcctgggcctcccaaagtgctgggattacagacgtgagccactgcgcccggccttgtactagactttttatttgtcttctgaaataagattgttttttaggcatatatcccctaacttagcttttctttcaggatccaattgtagaaaaggagagtggttgttgatttatgtcaatttaaacccaacaaaaatacttaacttacatatgcattcctgttatattccattaatgcagtatgtgtgcattcctcctttccaaagtgtgataagcaaaacaatttagtcctttccttaaactcattcttttatttttttcttctcctttgtaggttcccctccagactctttgcaccaaagctccctctgaggaagattctttgtcctcagttcccatttctccttataaggatgagccctggaaatatctggaatcagaaggtacctctaaagggggaaagggagggtcagataggatttgagataagtggacagagccacccactacactcccacccaggaataacttgtatgatctttcatttcagaataccaggagcgatatggttctcgccccgtctgggctgactaccgccgcaaccacaagggtggtgtacccccacagcggactcggaagacatgtattgtgagtttctgagagtgggatgtggagtgcggggaggccacaagtaacagtaacagcagcactttttctgacgtgtttgaacatccttaactgctgttttttttctctctacagcgtcggaataaagttgttgggaatccctgccccatctgtcgagatcacaagttgcatgttgactttagggtaaggagagtcttttctttttagggtaagaaaaataaagattaggggctgggcgcggtggctcacgcctgtaatcccagcactttgggaggccaaggcaggtggatcatgaggtcaggagatcaagaccatcctggctaacacggtgaaaccccgtctctactaaaaatacaaaaaattagccggttgtggtggcgggcgcctgtagtcccagctactcaggaggctgaggcaggagaatggcgtgaacccgggaggcagagcttgcggtgagctgagatcgcatcaccgcactctagcctgggcgacagagtgagactccgtctcaaaaaaaaaataaaataaaataaaaaaaattaaaaagaaaaataaagattaggagcccctttgcagtgccaaagagattactgtaggtgccccacacttcgtatatccaggaggccctacagtccgttttatagtaactgtttctggcattataaaaacatccctccagccttttaccttctactatggattgtactgaaagttttatcctatgcctatgaaatttacagtctaaattggcaggtaagagaaatggctgttttttttttttgagacggagtcttactctgttgccaaggctggagtgcagtggcgtgatctcagctcactgcaacctccgccttctgggttcaagcgattctcccgcctcagcctcccaagtagctgtaactacaggcttgtgccaccaagcccagctattttttgtatttttagtagagacagagtttcaccatattggccaggctggtctcaaactcctgaccttgtgacccacccgcctcggcctcccaaaatgctgggattacaggtgtgagccaccacacccagccagcgaaatggctatttctagtgggagagccaatatccaaagattcgtttgtattcattacagttattaccaaatatattggcccactttcttcctgaggttttctttatttccttgtcaatgttcagtgccatgctggcacctggggctggagggcaggtatatgaagcaagatagagtccattatttttcaaaaagccttcaatatgtgagaaggacaggatttgctccttaaagaatttgaaaacatattggctgggtgcggcggcccatgcctgtaatgctagcactttgggaggcccaggcaggtgcttcacctgaggtcaggagtttgagaccagcctggccaacgtggtgaaaccctgtctctactaaaaatacaaaaattagccaggcatggtggcaggcgcctataatcccagctacttgggaggctgaggcaggagaattgcttgaacccgggaggcggaggttgcagtgagctgagattgcaccactgcactccagcctgggcgaaagagtgaaactcctcaaagaaaaacaaaacaaaaagaatttgaaaacattatatcaataaaacagataatgggaaagtgttcttctgagcttgcagcaaaagtattagagcagaagctatatggctgatcatcagggaagtagtagagcatttggataacagtcagaaaatgggggtatttgactgcaataagaacccttctaacacaggttatttaggagtcccatagataatttcccagtttcaattgcatataattggttataaaaagagattatggccaggtgcggtggctcatgcttgtaatcccagcactttgggaggccaaggtgagtggatcacttgaggtcaggagtttgagaccagcctggccaacaaggtgaaacgccgtctctactaaaaatacaaaaaaaattagctgggtgtgatggcgggcgcctgtagtcccagcttctcaggaggctgaggcaggagaatcactggaacctgggagatggaggttacagtgaaccaagattgcaccactgcactccagcctgagcagcagagcgagactccgtctcaaaaacaaaacaaaacagagattataattaattacataactgagagagagaaatgttacaaatttagtagcatgggtgattctgcttgcattctactctacaatgtacctgcttttttttcaagagtctcatttcctagttaatttgctgagagagagttctatgtaaattgtaaaattattcttagtatataaattatattcagcatactattaaatacattagttgtttatacatacacattacaatatcattttttgggtgatttctgggatttccaatgaccagccccagtttttcacctaaaggctgacgttagaacttaacctctgcagcccaggcgcggtggctcatgcctgtaatcccagcactttctgaggccaaggtgggtgtatcactaggtcaggagttcaaggccagcttggccaagatggtgaaaccgcatctctactaaagatacaaaataattagccaggtgtggtggcaggcgcctgtaaccccagctactcgggaggctaaggcagagaattgcttgaacctgggaggcggaggttgtggtgagctgagatcgcgccactgcactccagcctgggcaacacagggagactctgtctcaaaaaaaaaaaaaaaaaaaaaaaaaagaacttaacctctgcataagagatttctatgggagcacagtgacagaatatgggatgtgcaaggatggattcagtgaattgatgaagccaaactgggacatgaaggaggatggcatctggagagctgtagaggggtgaaggtggtccatgtgggtgtgtagggattgtgtactttcgatgtccaaagatcctgctgctctccctgcctcttttcctcacgtttctctaccactttcccccacagaacgtgaagctcttggagcaatttgtctgcgcccacacgggtatcatcttctatgctccatacacaggttagcccatcatccctgcaccaccagagagcttttccttgtggcatgccttgtttatgtagttggccaataggtatttgttcagtggctcctgcttatagcctaaaaggtctggctgaaccttttggaaatcttggcttgctgggggctaaagtaattaaatgtggacaaaagaaaacaacaaatacagccaggcgtggtggctcatgcctgtaatcccagcactttgggaggccgaggcggctggatcacctgaggttgggagttcgagaccagcctgaccaacatggagaaaccctgtggtgatgcatgcctgtaatcccagctactcaggaggcggaggcaggagagtcgcttgaacccaggaggcacaggttgtggtgagccaacattgcgccattgcactccagcctgggcatcaagtgaagctccatctcaaaaaaaaaaaaggaaaaagaaaaaaacaagtacttctgtaagcaaactatctaaatgtagtttttaattgataaacagtgattaattcctttctatagggtcttttaacttttacaaaagacttctcacaaattgtcacataagttattttatatcattgtcaattggattagattttccaaacttggaatcgtaaatttaacaattcagaattatatttattccctaactacagtcacagggcaaatctggcccactgtcacgtccatttgttttcatattttctgcaattgcttccatgctacaatggcagagttgagtagctgagacagagaccacaggacctgcagagtttaaaatatttactatatgactctagacagaaaaattttgctaacccctgctctgaagcaagacaaatttgcagagaataattttttgttgttttttttttttgagacgaagtttcactcttgttgcccaggctggagtgcaatggtgcaatcttgcctcaccacaacctctgcctcccaagttcaagtgattctcctgcctcagccccctgagtagctgggattgcaggcacatgccaccatgtccggcaaatagagatggggtttctccatgttggtcaggctggtctcgaactccggatctcaggtgatccagctgccttggccttccaaagtgctgggatgacaggcatgagccaccgtgcccggcagagactaatctttgtttttgttttttttgggggggtgtgggtggggggatgaaatctcatttactctgtcacccaaggctggagtgcagtggcatgatcttggctcactgccgtctccacctcctgggttcaagcagttctcctgcctcagcctcccaagtagctgggattacaggcacgtgccactgtgcctggctaattttttttgtatttttagtagagacagggtttcaccattttggccagtctggtcttgaactcctgacctcaagtgatcctcccacctaagcctcccaaaatgctgggattataggcatgagccaccgtgcctggccttgcagagaataatctgaattcaccattgttgggggtggcagtacaatcagtgttcagtttgtcaagagtttcttatagtcaagctgtaaaggctgaagggactattattgttactctctcagattgccttccccaactctgaaatctcttttccctttattgaatctttgtggattgttcaactcaaccctctaattaaccacacttgcccattaaattgtgttctccctgtcttggaggttttaccattaaatggcttctctatagtggctagaccctcctaaatctttatcccagctctccaaaagatgggggagattctttcctttgggcagatggggaaactgaggtccatggaggggtcaggggaaaggggtcattaggtaaagccaatccttcccaatctacccctctgtcaccatatggaagcagttgtgttctattatttactgtgccttaaagaacaagatatttttctccccacaggagtctgtgtgaagcagcacaagcggttgacccaggccatccagaaagccagggatcatggtgagcatgagacggggcacacagcagttttgtttaggtataaggaagatgacttagggctagaaaatggatataaatgctcacacctgttcaagatggtagcacccagcatgttcttcctgacgttacattgtcccctgtcctttctcctgagtgtcttactttatcattgtcctgtctccttgttctttgtctttccatccttttccctcctattttacaactgctggtctcaatgccttaggaagttctttatataaatgtctggccctggactacatggcactgctgcataagttagtaaaaagtatacccctctgctagggcagatgcagcttcatagtccttgttcagcactgcacagctttgtaagcaagagccccagcagtatgtcagcccacacttgccctctgggccggtcacctgtttgcagtatacaacatgcataaatgtacctggtggctctgactggtccttccctttataatcctttttcttacttcatctaaaccaccctcctcattgcctcttaaatttcttttcttttttaatcccttaggtctcctcatttaccacatcccccaggttgaaccacgggaccttgacttcagtacctctcatggggctgtgagtgctactccgccagcccccaccctggtctcaggtgacccctggtacccatggtacaactggaaacagccaccggagagagaactgtctcgccttcgccggctttaccagggtcatctccaagaagagagtggccccccacctgagtcaatgcccaagatgccccctagaacaccagcggaagcctcctccactgggcagacaggccctcagagtgctctgtaggagctgtagactgggaagagaggccaggcgtggtggctcactcctgtaatcccagcactttgggaagccaaggtgggctgatcacttgatcccaggagtttgagaccagcctgggcaccatggtgaaacctcgtctttaccaaaaaatacaaaaattagctgggtgtggtggtgcacacctgtagtctcaactattggggaggctaaggtaggatcacttgatcccaggaggcggaggttgcagtgagttgcagtcacacccctgcactccagcctgggtgacagctagaccctgtctcaaaaaaaaaaaaaaagactgggaagagagctagagggactaggagataatgtgtatgtaggtttatgtgatgggatatcaccctgaagagttgtgtcttttgtggccagtgacaaatccaggaaatgaatgttgctgatagggataaatcttgaggctgagggcgggtggtacagatgtgtatgggaaaccccaacccctatatattgtaaatagatgggctgggctaaacattgttgccgtttcatacttctaccaactcagcttttacacaataaagctctactgtctctggtttgctttgggctgtttccgatgaatgccattagcggggggtgggctgagtgatggtcttttcatataagcaattgggtgatgctgtggggagataagtggtcaggcttaagccagccttgcctgtgacgcctgggactagaagccggggatgggcagctgtgccactctgtcaagatgccttgtgggcccccactccacagcatggcccactgttcactgaggggataaaaggttggacagtgagacactgggccaaggaagactacgttgccatggcactcactgccgtgggatgcagggatggaaaggagtggcactgctaggggcacagctggtttggcaagaaaaacgggggccctgtcagttgccaggacgctagggggcaaggtctacaggcggggctcctggaaataaagactccgagaggcggtgcggcgagaggaggggcggaagtgacgtcgtgtggggcgggtccgaccgcgcacaatgggccatggagttcccgttcgatgtggacgcgctgttcccggagcggatcacggtgctggaccagcacctgaggcccccagcccgccgacccggaaccacaacgccggcccggtgacagctcaaacccaccctctggcccttttctcccggttcctctccaaacctggtccaggcaccacgcccccttctcactgactagtgatcgccccttttgatgtccaggcctgcctttttggtgacctctgaccctgggcctagtgggattgatcagcgcttggatctgtgacctttcaccccgggcccaaaatgtcccaatcaaaggatgtggttgacctggcctttctgcttcctcacaataaccttaagggaggagggagtgtgccaccttgaaaggtgtgacagaagtttgggtttcagaagggtggggtgggaaatcagattggaagactcccaggcaaaggcagggagccttcagtgttaaacctgggttggagttgtggcccaggttcccaggactgactgcctaggacccgctaatttagtgagtatctgactctttatttcttctctttctctagtgttgatctacagcagcaaattatgaccattatagatgaactgggcaaggcttctgccaaggtactggagagtttttagatggagtaaagggaggacctctgtggggatggtatataagggaggcctgggtccttcggagagacttgcagaaagtctgacttaatcttccctgcaggcccagaatctttccgctcctatcactagtgcatcaaggatgcagagtaaccgccatgttgtttatattctcaaagacagttcagcccgaccgtgagtgccacatgctcttccatcccatacttaattccttccttcctcagcccttcccccatctttgactatctcttgcagatagataccactagcctgttcattattttccccgtcctacagggctggaaaaggagccattattggtttcatcaaagttggatacaagaagctctttgtactggtgagtgttattggatgctaggagttcgtataccttggtttctgagaacaaaagtgctggaggttagggggcagcagagatgccggggttcctaaaacatttttattgtttctctcttaggatgatcgtgaggctcataatgaggtagaaccactttgcatcctggacttttacatccatgagtctgtgcaacgccatggccatgggcgagaactcttccagtatatgttgcaggtatcactgacctcttcactggttcatccaaactaggggctcctttgccctgagcccttccagaagccctgcctcccaccccccatgttcccatgtcattctattcccttcccaggcttctggcttcctgttggcatgctttccccatacttcctcctaccctgagtctccttttccctgcagaaggagcgagtggaaccgcaccaactggcaattgaccgaccctcacagaagctgctgaaattcctgaataagcactacaatctggagaccacagtcccacaggttagaggtttcagagaatagatccccactgagcattcccattgaatttatttgttatttatggcaaagaagtagtgacttatttcctatcacataggtttcattttctacaaccaggctctttctttctcttgtggtaccatctctcatcctgtagtgacttctttctcatctattttgatttttttttttgagatggagtctcgccatgctgcccaggctggagtacagtggcgcaatctcagctcactgcaacctccacttcctggtttcaagcgattctcctgcttcagcctcctgagtagctgggactacaggcacccaccaccacacccagctaatttttatatctttagtggagacggagttacaccatactggccaggctggtctcaaactcctgaccttgtgatctgcccgccttggcctcccaaaatgctgggattacaggtgtgagccaccgcatctgactttttttttttttttttcaaagcagagtctcctgctgttgcccaagctggagtgctatggcaggatcttggctcactgcagcccaaccttctgggctcaagcgatactcctcccttagcctcctgagtagctgagactacaggcatgcaccaccatgcctggctaattttttattttttgtagagatgaggtctcactatgttgcactgggtggtcttgaactcctggctcaagagatccacctgcctcagcctcccaaagtgctgggattataggcgtgagccactgtacccagacttattttgattctttaccacaagttgtttcctacacctaatttttctttttttttttttttgtgagatgtagccttgctccatcgtccaggctggattgcagtggcacgatcacagctcactgcaacctctgcctccggggttcaagtgattcttgtgcctcagcctcctgagtagtagggattacaggcatgcaccatcatgcccagctaatttttgtatttttagtagagatggagtttcaccatgttggacagactggtcctgaactcatggcctcaagtgatgtgcccacctcagcctcccaaaagtgctgggattacaggtgtgagccaccgcacacaacccttatgcctaatttttttttgagacagagtcgctctgtcacccaggctggagtgcagtggcacgatctcagctcactgcaagctccgcctcccaggttcacggcattctcctgcctcagcctcccgagtagctgggactacaggtgcccaccaccatacccagctaattttttgtatttttagtagagatggggtttcaccgtgttagccaggatggtctagatctcctgaccttgtgatctgcccgcctcggcctcccaaagtgctgggattacaggcgtgagccaccgtgcccgaccccttatgactaattttcaacccaaacatagccagctcattttcacctccttgttttcacatagttcattactcatctggtcagtcagtatttattaagggtccagaataatatgcattccctgtcctcatggagctttggcctaatatagggaaggaagtcttgtttataactaagtgcagcaaaatgttactaatgctacccattcatccaataaacattgagtgcctggcagtgttctgggcactaggaatggtttactcaatgaaacagacaacagcctgggcaacatagcgaaactctgtctctacaaaaaatacaaaaaaaaattagccaggcgtggtggcacgagcctgtagtcccagctacttgggaggctgaaatgggagaatcgcttgagcctgggaggcagaggttgcagtgagccaagatcgcgccactgcattatagcctgggcaacagagagagaccctgtctccaaaaatgaaaacaaaaacagaaaaaaaggccaggtgcggtgcggtggcccatgcccgtaatcccagcactttgggaggctgacgtgggcgaatcacttgaggtcaggagtttgagaccagcctggtcaacatggtaaaaccccgtctctattaaaaatacaaaaattagcggggcatgatggtgggtacctgtaatcccagctacccaggaggctgaggcaggagaatcacttgaacccgggaggcagaggttgcagtgaaccaagattgcaccactgcactccagcctgagcgacagagtgaggactccatctcaaaaaagaaaaagaaaaagggccaggcatggtggctcatgcctgtaatccccacactttgggaggccaaggcaggaggatcacctgatatcaggagttcgagatcagcatgtggaacatagtgaaaccctgtctctactaaaaatataaaaattaactgggcatgatggcgtgcgcctgtaatcccagctactcgggaggctgaggcaggagaattgcttgaaccccggaggcagaggttacagtgagccgaggtcctgctacagcactccaccctgggggacgaagcgagactcttgtctcggaacaaaaaaaaaaaacagaaaaagaagggaacagacaaaagtccctgtcttagtggtggagcttatattctagctggagagacaaacaaacataataaacaatatggttaataagtgctctggaaaaatgagagcaagtaagggtttgggagtactcaagtaaggtggggatgggagtatgtgggattgcaggttgaaaggggatcatcactgagaaagtgtcatttgagcaataactgaaaggaagtaagagtaaaaactggccgggcacggtggctcatgcctgtaatcccagcactttgggaggccgaggcgcgcggatcacgaggtcaggagatctagaccatcctggctaacatggtgaaaccctgtctccactaaaaaaaatacaaaaaaattagctgggtgcctgtagtcccagctactcgggaggctgaggcaggagaatggcgtgaacctgggaggcagagcttgcagtgagccgagatcgcgccactgcactccagcctgggtgacagagcgagactccatctcaaaaaaaaagaataaaaaccaaggctgggcgtggtgacttacatctgcaatcctagtacttagggaggccgaggtgggtggatcacttgagcccaggagttcgagactagcctaggcaacatggtgaaaccccatctctacaaaaaacacaaaaattagccaggtgtagtggcacgcacctgtggtcccagctacttgggggtctgaggcaggaggattgcttaagcccaggaggtcgaagctgcagtgagccgagatggtaccactgcactgcagcctgggtaacaacgtgagactgtctcaaaacaaacaaacaaaaaaaaagagtaagagccaagaaatatctggagagagagcatcccagacagaaggtaccaccagtgtatggccgtgaggtgggagtgtgcctgaaagagcaaattggctgtgtccagagcagcatgagtcagcggaggagtatggtaggagatgagaccagagaggtaatgcggaggaggggccttataggctactgcaaagactggcttttattttaagtaaaaaataagatcaggccaggggtggcgactcacacctgtaatcccagcactttgggaggccgaggtaggtggatcacctgaggtctctactgaaaataccaaaattagctgggtgtgatggcaggtgcctgtaatcccagctgtttgggagtctgaggcaggagaatcactagaaccgggaggcggaggttgcagtgagccgctgaaattgtaccactgcactcctgcctgggcgacagagcaagactccttcttaaaaaaaaaaaaaaaaaaaaatagcgccaggtgtggtatctcattcctgtaatcccagcattttgggaggcccaggcaggtggatcacaaggtcaggagttcgagaccagcctggccatatggtgaaaccccatctctactaaaaatacaaaaattagccgggtgtggtggcgggcacctgtagccccagctacttgggaggctgagatagaagaatcgcttgaacctgggaggcagaggttgcagtgagctgagatcgcactactgcactccagcctggataacagaacgagactccatcaaagaaaaaagaaaaagatcattttggctgtgatcttgattttttcctttttaacaagatcactttggctgttaagaacaggcaatagccgggcacagtggctcacacctgtaatcctagcactttgggaggccgaggcaggtggattgcctgaggacttcaagaccagtctggctaacatggtgaaaccccatctctactaaaaatagaaaaaaaaattagccaggtgtggtggtgctcgcctgtaatcccagctactcgggagactgaggcaggggaattgcttgaatcagggaggtagaggttgcagtgagctgagattgtgccactgcactgcactctagcctggtgacagagtaagaccccatatcaaaaaaaaaaaaaaaatggaaacggcaataagggagccagagtagaagcaagtagactaattaggcagcaacaatcctggcgaaaaatggtggtggctcagaccaaggtggtagcagtagtgatggtaaagagtggtcaaattttaaatattttgaaggtaaagcaagtaagatttcctgacagattgtatgtggagaaagaggactttaggacaatgccaaagcctgagcagctggaagaatgaagttgctttaactgagatggtaggtagaccagctttgggggaaatactaggagtacatttttaatatgttaattggagatgtctgtgatatgtccaggtttgagtagacagttggatacttccctggagatcagggaggaggtttggggaggagagttttcagcatacatctggtatctaaagccaacagacaggatgcgatcaccatagaaagattatagatagagaagctgcccctttgggccctctttaagaagtgaggacccccaactggctgctctgaaaagccatctttgcattgttcctggttcggtgtcctgctcaccacagccacctccgccatgcacttcctctgctgcctcagagtctggcagcttaatcgacatagtccccaaactctcactttcttcttaatcccttgcatcggatcaccgctgtgccccaccatgtcagaggcagttgtggacacaagctccgtgatcaccaccaaggacttcaaggagaagttgtggaggaggcagaaagtggaagagacgcccatgctaacgggaacgctaatgaggaaaatggggagcaggaggctgacaacgaggtagatgaagaagaggaacagggtggggagaaagaggagaaggaagaggaaggtgatggtgaagaaaagaacggagatgaaaacgaagcagctgaggcggtatggacaaatgggcagctgatgatgatgaagatgacgatgttgataccaagcagcagaaggccagtgaggatgattagacagcaaaaaaagaaaagttaaactttaaattaaggccaccgtgacctattcaccctccacttcccatctcagaatctaaacatggttgccctcgagaggcctgcttgccctccacagacagtgccactgcagatgacaggcactcaccaccacccaacccaaaccagagaatttgcaacagaggaggaaaaaagaaccaaaacttccaaggtcttgctcttttaaaagtactttaaaaaggaagtttgtttgtattttttatttacattttatatttttgtacatattgttagggtcattttttttttctttgagacggagtctagctctgtcgccaggctcaagtgcagtggtgcgatcttggctcaccgcaagctccacctcctgggttcaagtgattctcctgcctcagcctcctgagtagctgggattacaggcgcccgccaccacacccagctaatttttgtatttttagcagagacaggctttcaccaggttggccaggatggtttctatctcctgaccttgtgatccacctacctcggcctcccaaagtgctcgaattacaggcgtgagccaccggcgcccagccaggttcagtcatttttaatgatctcagatgaccaagccagcctttggagggttctctgtcttacttctgactttacttgtggtgtgaccatattcattataatctcaaaggaggaaaaaaaaaaaaaaaaaaaaccttgtttaaaaaaaaaaaaaaagcctgggcgcggtggctcgcgcctgtaatcccagcactttgggaggccgaggtgggtggatcacgaggtcagaagatcgagaccatcctggctaacatggtgaaaccccctgtctactaaaaatacaaaaaattagccaggcgtggtggcgggagcctgtagtcccagctacttgggaggctgaggcaggagaatggcgtgaacccgggaggcagagcttgcagtgagccaagattgtgccactgcactccagcctgggcaacagagcgagactacatctcaaaaacaacaacaacaacaaaaagtctcgttctgagcattccagtagcttctttagtgtatgtagttagttgtaccataagtagttggtttgtgtgagatggttaaaaaggccaaagataaaatgtttcatttatttgccttttttgtctatgaaatggctgcttatttatttaggcctatttgatgtatgtgtgaaacaatattgtgcaacaataaacccaaattttattttgctgagttgttctaacagcaacaaaaagaagttaaggaagagaagaagaccagcaaatgcaaccacagagtgactagtgaagtagatgaaaactgaggccgggtgtggtggctcacacctgtaatcccagcactttgggaggccgagtcgggtggatcacctgaggtcaggagttcaagaccaacatggtgaaaccccatctctacaaaaaatacaaaattagccaggcgaggtggctcatgcctgtaatcccagctacttgggaggctgaggcaggacaatcacttgaatctgggaggtggaggttgcagtaagccgagatcatgccattgcactccagcctgggcaacaaagcgaaactccatctcaaaaaaaaaaaaaaagaaaagaaaactgaaaagtaaggtgacctcaaaggccactgaagaaagtgtttccaggaggaaggaatggtttacttggtcaaatgctgctgatcaaggagcaaagaggtctgagaagttaccattggatttatctgcgttaggccattggtgatcttaatgagcagttttggtgcagcggtgtttggaagcctggatgcagtgggtcttgtagactgagaagctaggaacacagcaagaataagctactcttttaaatcctgctttaatgggaatagaaatagagcaagagctggagagtgaagtggatcaaaagagttgatcttttgcagatgggagaacaaatagcattagaatgattcagtagagagaaaatattattatgtcagagaaagtggggagaactgttgaagtgatgtcattgaatgggcggcgggggcgttgagatttggttgacaagttagccttggataggaacatggacagttaatccattgtaacatgatttgatagatgtgattacagaggaggcataaggacatggatttgagtgctatcttgggctgggggttgggtaaagaaagatgacatgtctaatcttgaaaggcaagtgtttgtcaggtggacaaaaggctaaagtgcatttcatgtagaggaacaggcatgagcaaaggcagaaaggtattaaaccacctttcaggccaggcgtggtggctcacacctgtaatcccagcactttgggaggccaaggtaggcggatcacaaggtcaggagatcgagaccatcctggctaacacggtaaaaccccgtctctactaaaaatacaaaaaaaattagctgggcgtggtggcaggcgcctgtagtcccagctaatcaggaggctgaggcaggagaatggcgtgaacccaggaggcggagcttgcagtgagcccagatcatgccactgcactccagcctgggcgacagagcaagacactgtctcaaaaaaaataaataaataaataaaaataaaccacctttcaggacactacaagcagtgtggtgtggttggagtgctgggcatgtgcttgttggggggtgggggtgatgaggatgggctggtagacattacaacaaggtcaaggcaagggataggcagggtcttcctacagtatatttttccattaagaggcaacagagagcagtggaaggagcacagtttttttttgtttgtttgtttgtattttgagatggagtctcagtctgtcgcccaggctggagtgcagtggcacaatctcagctcactggaacctctgcctcctgagtccaagcaattctcttgcctcagcctcctgagtagctgggattagaggcgcccaccaccacacctggctaatttttgtgttgatgaggtttcaccatgttggccagacgtctcgaacttctgacctcaagtgatccgcccacctcggtctcccaaagtgctacgattacagccgtgagccaccatacccggtcctggagcacagtattcgatatgaaacacattacccagttaacatgtaaggccagagcagtatagagtgtaaataataattcacatttcatgggctctatgtggtatctatatgcatcatctcagtggattcttgcacatctttttgaggtaggtactattattaaacctattttgggtttatacaaattaatgacttaaccaaattcacacagccagtaaatagtagagtccacatttgaacccatagccatttgcacccagtgaactttttttttttttttctttttgaggcaaggtcttgctctgttgcctaggctggagtgcagtggcacgatcacggctcactgcagtctctacctcctaggctcaagagatcttccctaccagcctggccaacatggcgaaaccccatctctattaaaaatacaaaaataagccgggcgtggtggcatgtgcctgtaatcccagctactcaggaggctgagacaggagaagagcttgaacctgggaggtggaagttgcagggagccgagatgacaccattgcactccagcatgggcaacagagtgagattccatgttaaaaaaaaaaaaaggccggacgcattggctcgcgcctgtaaccccagcactttggaaggccaaggcgggcggatcacgaggtcaagagatcaagaccatcctggccaacatggtgaaaccctgtctctactgaaaatacaaaaattagctgggcatggtggcgcatgcctgtagtcccagctgctccggaggctgaggcaggagaatcgcttgaactcaggaggtggaggttgcagtgagctgagatcttgccactgaagtccagcctggcaacagagcgagactccatctcaaaaaagatcttcccacctcaacctcccaagtagttgggactacaggcgcccaccactatggctggctgattttttgtatttttagtagagacggggtttcaccgtgttagccagggtggtctcgatctcctgacctcgtgatcggcccgcctcggcctcccaaagtgctgggattacaggcttgagccactgggcccggcccacgcctggctaatttttaaaaatatttttgtagagatgaggtcttgctatattgcccaggctggtcttgaactcctgggctcaagctatccacatgagccaccatgcccagcccccattaaacttttttttttgagatggagtctcactctgtcacccaggctgaagtacagtggtgcaatctcagctcactacagcctctccctcctggggtcaatggattctcctgcctcagcctcctgagtagctaggattacaggcgcacgtcaccacacccagctaatttttgtatttttagtagagacagggtctcgaactcctgacctcaagtgatccacccgccttggcctcccaaattgttgggattacaggcgtgatccaccacgcctggcccccgagttttttttttttttttgagacggagtctctctctgtcgcccaggctggagtgcagtgttgccatctcggctcactgcaagctctcctcttgagtaaactcttaatggctacactattttcctggctaaaacactgcagctggaatcagaagtctgaaagttgaggcccagccctgccacttgtagctacttggcattggccaagcgaagccatgtctccaaggctgtatttcccccaaccttctttcaaatagtgacttccaggattgtgaaggccaaattaaatgtgaaaatataatgaagtaactctaaaattaatagttactagttatcaaagtagcatcctggcctccagcatgtcttcccctgactttccccaccccttggaaccctgctgaattttttatttatttatttatcctttgagacggagtctcattctcttgcccaggctggagtgcagtggcacgatctcagctcactgcaacctccgcctcctgggttcaagcgactctcctgcctcagcctcccaagtagctaggattacaggtgcacactgccatgcctggctaattttttgtatttataatagacacagggtttcaccatcttggccagaccggtcttgaactcctgacctcaagtgatgcctgccacagcctcccaaagtgctgggattacaggtgtgagccactgaacctggactttagcacctttttatgtgcttattggccatttgtgtatcttctttagagaaaagtttatacaagtcctttgtctgttcttaaattgtgttcttttttgttctgagagtttttcatatattctagatagaacgcacttatcagatgtatgacttgcaaacattttctcccattctgtagattgtcttttcactttctttctttttttttttttttgagacggagtcttgctccatcgcccaggctggagtgcagtggcacgatctcagctcactgcaagctctgcctcccgggttcacgccattctgctgcctcagcctcccgagtagctgggactacaggcgcccgccaccacatccggctaatttttttgtatttttagtagagatggggtttcaccatgttagccaggatggtctcgatctcctgacctcatgatccgcccgcctcggcctcccaaagtgctgggattacaggcgtgagccaccgcacctgacctttactgtaccttttctgtgttgaggtatgtttagatacatcagctgaaccattatgttagaattgcctacagctggctgagcatggtggctcacgtctataatcccaggacttttggaggctgaggcagaaggatcacatgagccctggagtttgagactggcctgggcatcatagtgagacccccatctctacaaaaagttaaaaaaaaattagtagccagatgtggtggcatgcacctgtggtcctagctacttgggaggctgaggtgggaggatcatttaagcccaggttgatgctgcagtgagctgtgatggcaccactgcactccagcctaggcaacagagcgagactctgcctctcaaaaaaaaaaaaaaattgcctacagcattcagtacagtaacatgctgtacaggtttgtagcctaggagcaataggctgtatgatatagtctgggtgtgttgtaggctatagtgtctaggtttgtgtaagtacactctgtgatgttcacacaatgaaatcacccaatgacgtatttctcagaatgtatccccatcgttaagtgatgcatgattgtattttgtttgtttcatcttccaggtgaacaactttgtgatctttgaaggcttctttgcccatcaacatcgtaagtttttgcattttgttggtcacgtagtcggggtgagggaaaggaaagagctggactcttggtcctgccgacccctcactgaggggccccgccgcttccttcctcacagggccccctgctccctctctgagggcaactcgacactctcgtgctgctgcagtcgatcccacgcccgctggtaaagcctgtattgaaggggtggaactgtagtgcagtgatggctacttactctagatgccacggggtacagtgccatctgtgggcaattttggaaaattctaaagcaacccaagtctccagcagtcatgactgtttgcctttgccctcatgggagctcagtgcattttatatttggcaagacttttaactaagcaagctcattgggagcctgtttgacagctgatatcaatggaccctcttgccagttcaggtccgtcaacataggccagagtcaggctcctttgtaaaccccaggcttctgttagccagtgagggacaggctggtgcaaacagcccttccatttgcagtcacagaatagtgacacaaatggcccaaaatttaaatgttacttttagaagataacactcagagtttataacatttccaaccagataatgaaattgatatggagaaaccaaacctcagaggcactaaaatgctgtccagattccccatcccatatacacacatacacacacacacacacacacaaacacacttactgacagtctgagccccactccttcctcttcctcaccacctccaccttaccaacttctgacagctgtacagtgcttgcttgcacagaagagcccccttcctgagctggctctgtggccaggaaaggatgtaaccaccatccaaacagcagtctgtaaccagctatgagcatcacagtgtcaggcactgagaggcacctcaactcgctttggtttccaaggcttctcccatttagcttgttcagaaccacaggctgtgagagggactgagggccaacaaggatggtgaggtctcaggcctgcaggggagggtgctgtggataaagcttaagtgaatttgctgagaagtctttcatttgccacacatacatgatggagaatctcttgagagggaaagccgggagcaagtagagaagtgaggagggggaggctgaactttggacattacatcagcctcctgcttactctgatagctccctttcagatgcccatatttattttcttttttttttttaacctaataaaacttcagtctcttcccattttcgtataggaaggagagattgtgccctccttccaaacctcccctgacctctccagagcaattcctgattaaccaagggctttgtccatctcatccagaggaacccagggtcctcgttggcccggctgggaccattccactgccccagaataccagggggccatgacagcacccactgacagtaagagctcacttcccttggctgcccttctcctgcatctcccaggcccccagagtctccccttcgatctttctccctagctctgtgtttggcctactccttctggctttcctcaacagtgttccacattcccctcaaattcccttttggtgtgctggcattgccatggtgctgctcctgcaagttctcaggaggaactgtggtgtcagggagcagaggtttggggttggggtatagtggctgggaggaggggtgcaaagtatgtctcctaacgcttaccctgcctatgtcccctccactgccagctccagcaaggaagctgccacccaagagagcagagggagacatcaagccatactcctctagtgaccgagaatgtaagaggggcaagggtcgggtgtctgggcctggggtaccttaacacaagggaagagaatgctcaggggacccagggaaaggattcgttctctctaaagactcagatttcttgggctgggcatggtggctcatgcctgtaatcccagcactttgagaggctaaggcaggcagatcgcctgagtccaggggttcaagaccagcctggccaacatggtgaaaccccgtctctactaaaaatacaaaaattagctgggcacggtggcacgtgcctgtaatcccagctacttgggaggctgaggcaggagaatggcttgaacccaggaggcggaagttgcagtgagccaagatcgtgccactgcactccagcttgggtgacagagtgagactccgtctcaaaaaagaaaaaaaaaaaaaagaaagactcagatttctctttttttctaccaaaacctttgctgtcatgactctcttccttttttcttctttttctgtcttgctcttcattctccctgtccccagttctgaaggtagctgtggagcctccttggcccctaaacagggcccctcgccgcgccacacctccagcccacccacccccccgctccagcagcctgggaaactcaccagaacgaggtcccctccgcccctttgtgccagagcaggagctgctgcgttccttgcgcctctgccccccacaccctaccgcccgccttctgttggctgctgaccctgggggcagcccagctcaacgtcgtcgcaccaggtaataggagttgaagggctaaggagcctcacagctataaaagaggatgttagaaatggcaaagggcaatttgaatccatcagagagatggatcaataagatgggtggcttggggggggtcctgaaacctttcaagaaaaatatttgtgcaagtgatctgggaaaaaaatgcagtgaaggagcagaataggaccttatatggagcctagggaccctggctttaatgtgagagttatgtggaatggtaggaagaacaccgagatccatcgagttgggggaacagagccttctaagattgggaaaatcttcgcttaatacttgctggggaaggggcagtgtctgacagagagtgggaagccactggcttgtgtgccaagagtccatcgcagcaggcagggagtgggcatttcctttatttctctccctttctcttcacctctgacttctctgtttttctctcccccgccccccgccatttcccatctcccttcctcccatccataacatccttccacagctcccttccccgctctgaggagagtcgatactaacagctaccctctccctgccctgggagacctggggtgggcagggaacccctccctgagaacctcagacccactcttccattgcatcctgtaggacccagtggaacctgacagagcccataggattccctcttctactttcttagacagcagggatgtcagggtctcaaactgcctaacactttgtagcttttcttaacacaaaagcaccccttctctcctaacttgggctctgaatactttcccaacaggaagtctgatctgttgccagacttcttggttagatggctcatacatttatctagagaagcacactcttgcttgctgtcaaactttagaccaccatggaaggtctaagggcatcctgtgccagggaaactttttaaggaattttatctatgggataaaccccatattccctctagtgtctactggtggctctaatactgctttgtgctgcctgccacacttgccctttgagcctgcgaatggccgctagtgagcaagctctgcttcagagcagtctagttaggtagaacagggacttaccagcttcccaaagggatctactcaccattgccaaactcttcatttccacattttgtgtaggtgtcagggaaccccaaactggtgttgctttggggtctctaaaggagattggctgacaccaccatttcccccagatccagattctctgagggaggttgtttcttgagagtagatccagagtgtcaaggatctgttagatcctggaatcccttcttgcatccatccctccctggtagctaggtcccgatatactcctgtcttgtgagattgtcgagatgagatgggggaccactcttcctctgtccttcctctctcctttcctccatagcaaggacgaccttccctgctccatgcccagagtatagctagatcccttcccctccctaccctctgaatgtgtgctagatcaggtgccccactgtgtttcctgaaatccttgggagccggatctccccatctcccctactcactcttcccttttcttctctcagtgttgtctgaataaagtgtgaaatcttttgtgttttctaaattgacattttcaatgaaaaaaagaatcacaaaaaaaaaagttgtcagcctcatttgtgcgtcatcccttattttcctgggatctcaggacctctgtccctctcatttctcacttctgagatctgcacatcttttacccaggagcctcagagctcctgagtctggtgtctgcctatccccatcttcactgttagtcctcctgcagattctgtgtctcctttcatgtaggtgctggatccctgtgtgtgggcttccgtatctactccctcattccctccaggaacctccagctctccccagtgacttctaccctttactctgggcgtgcctttgccaagatgtcaaagcttaccaacatctctggatccactaattacctcctgcctcctgtattcgtcttcccactctgattacctgacgtctgctccactaaaccgctggatctctctcaagacaaacccttacctccattgagagtgcaacacagtctgtcaccctatttacagaggcccccttccttttcctcctaaattcaaaattcagccttgtcacttcctatttccctctggtctaaggaatctttttttttttttttgagatggagtcttgctctgtcgccaggctggagtgcagtggcacaatctcagctcactgcaacctccgcctcctgggttcaagcgattctcctgccttagcctcccaagtagctgggattacagaagtgcaccaccgtgcccagctagtttgtgtatttttagtagagacagggtttcaccatgttggccaggttggtctcgatctcctgatcacgtgatctgcccgtcttggcctcccaaagtgctgggattacaagcctgagccaccgcgcccagcctggtctaaggaatcttatagttaaggtaaccctgttttccaaaccaaacaccagagtacccgatccaacacatttttgaccacatgtgagtctgttcttctgacatgatttggatcacacctagccatagatttaacacattacctcaactagaaagaatagagcaataaatcagaagcactccagaaaatcttgggtataaaatgaacttcccccgcccttttctggggcacagctttgattaaaacctgttaggaatgataattacccccttctctttgttcctgtgctattccttttactcctctcctctgattcctccatacccacccatctttcatccagtagcctcctccccatcatctcccatttcttctacagggggactcccccaggtctggtagcccaaagctgctgctacagccgccatgggggggtgaattcctcatcccccaatacaggtaagtattcactcctccctaccctcaaatcaagtaggccacattcactgtctactcctgccttcccattcacatgcctgatatttccacaggcaaccaagactccaagcagggagaacaggaaacaaagaataggtgaggtctaaacccctcccctaacagcctcccaccaccatctgactcccttcctaacatcattctcagtcacttcctactcttaaatcttattgtatgaactggacaccagctcctcccacaattccttctaccttacatcctgcaagcccctttcccccacaggttcaactctggtacttccctttggaatacggattctctgagaggttttaaatttggacatagcactaatggttccagcttcatacccatcatgtgtcctacattaaaacctggcccgagaccttgaagagtctgtaatcttaatttcctctttagtattcctataacccactctccatctccccacctaccaggtctgccagtgaggagcaggccttgtcacaggatgggtctggggagaagcccatgcacacagctcctccacaggccccggccccgccagcccagtcctggacagtgggtggggacatactcaacgccaggttcattcgaaacctgcaggaacgtcgcagcaccaggccttggtgaccgcagccccgtcaaacatcttcaaagtattatttctccctcactacaggaaagagccaaagcccaaccctcataatagatggatacattcattcattcattcattcagcaggcttatcagattcaagtcatttgtatcttttaaccagaccaataaaagtatttatttttatcacaagagctgttgaaaaatttgactcattatttcagccgcctcacccctcactgtcgttgcacccattcagccttcagccctgtttttgctcagctttttgctcaaaggcctcagctgtgaatacagcgcttgggggggcgggggaggctgtaacttgcgcaagcgcactcaggcagtctccgagcccgcgggcgcaggcgcgcttacagccgacagagcgcttcagccgcttccctcgagcctgcagtgcgcaagcgcgggacatctccgtttccctccctcagccccttccccccctacccccccgccccggcctcctttccccttcacgaagccggctctggggcgcgctcacccctgtgaggaggccggaggtcggactcaggaggctccttctccactcccggaagatcatgtaccagcccagccggggtgcggcccggcgtctcggcccttgcctgcgcgcctaccaggctcgaccccaggtgagcggaggagaagagggagggaggagagggggcggggagagaccctcctcaaagccggtgcgtggggcggagcgcgcgctgggttccgcgcaggcgcagagacacccgccgccccttcccacctgtgccctgcagcgcgtggacaggctaggggtcgcgggagcgggagggaggcgctgccgggcctgtcgcgcaaggacgtcggtcctcccaggtttgagggcggtcaggcggggtcaaggccaggcagcggggcgcgtctgcgttgcgcccgactctccgcggttacctgtgcctagaggtgatttgaagggcaggggccgagagattcgtagccctgctgcggcgccgtcccggagttccccggcccagaccagacccgcggggcgccctcagcagcccgcccgtcttgcactcggagagcggtcctggcaggaaggccggccagtgtgcacccggttcgggcccctgcgcccgggctggcaagatggccacgcccccagcagagacggcgcctctaggacaccatcggggaccgaggtacccgagcggtccgcccgccttccctgcagtgagacgatcccctggggggttccttgggagcggagggactcgggtgaggcctaactttgggtgacctccccttgcagtttcaacgtcggtaaacccaggagagtgaaggccagcctttaactgtctcctgaggttgtgtctgtcattagaggggcccgaaatgataatagcttccatttatgtactgctttctaggtcgctacgttttgtttacattcattatttcatataggcctcataacccagtgaggctttattgttctcatttataggacatttgtaggaagcggaggcatagggaatgagaatgcctaaagttacatgatagaattcagattcctagcttcagctggatattcttttttctctgtacatttgcctcgcacacttaatcatggagatgtacaggccacagcatttaatccacagtacaataaaacctgttattcgttaactcatcaagtatgtattacatgattcttgcgataagagaggtgaaactgcccccagtgttggaatctttttttttttttttttgaaatggagtcttgctccgtcacccaggctgaagtgcattggcaccatctcggctcactgcaatctccgtctcctgggttcaagcaattctccttcctcagcctcccgagtagctgggactacaggctcccgccaccacacccggctaattgttttgtatctttagtagagatggggtgtcaccatattggccaggctggtctcgaactcctagacctcgtgatccgcccgcctcggcttcccaaagtgctgggattacaggcgtgagccaccgcgcccggccacatttctttaagattccaacactgggccgggcacggtggctcacgcctgtaatcccagcactttgggaggccgaggtgggcggattacctgaggtcaggagttcgagaacagcctggccaacatggtgaaaccccatctgtaactaaaaatacaaaaattagccgggcgtggtgaagggtgcctgtaatcccagctactcgggaggctgaggcaggagaatggcttgaacccaggaggcggcggttgcagtgacccgagttcgcgccaatgcactccagcctgggcgacggtgagacttcgtctcaaaaaaagaaaaaaaagtaaaatgtctgctaggttttgggaggtgccggtatttatgtcacataaaacagtttgctcggctgggcgcggtggcccacgcctgtaatcccagcactttaggaggcagaggcgggtggatcacgaggtcaagagatgaaaaccatcctggctaacatggtgaaatcctgtctctactaaaaatacaaaaactagctgggcatggtggcgcgcgcctgtagtcccagctactcaggaggctgaggcaggaaaatcacttgaacccgggaggcggaggttgcagtgagctgagatcgtgctactgcactccagcctggcaacagagcgagactccatctcaaaataaataataaaataaaatggtttcctcctgttttcagtagagatggagatgaatccatcccttttttcctatagtaattccatccattctgtcaggaggaataggtattggaagcctgttgagcatccaggggatcaaggggtgttagacaagtggattcttatctttctcccttctgttctttctccttaggaccagctttatccagggactctaccattcccacccctttggccccactccacgacaaccacttccccatcttctcctctattctggtctcccctgcccccacgccttcccacccagcgtcttccccaggttcccccactacctctccctcagatccaggccctcagctcagcatgggtggttctccctccaggaaagggggaggagggaccaggacctgagttgcatagcggctgcctggatgggcttagaagcctttttgagggacctccctgcccctatcctggggcttggatacctttccaagtccctggaactgcccacccttcccctgccaccccgtcaggagatcctagtatggaggaacatctgtctgtcatgtatgagagactgagacaagaggtaagtcagtgcaaaagtggccttcgtctacagtgggaaggatgtgggtaatccttggacgtacagggatagtcaactggattcttttttggaaccatgaggcaggcatagaaatatattataaacattttcctgagaaaatgatgttccagccaggcacggtggctcaaagtgctgtaatcccagcactttgggaggcttaggcaggtggatcacctgaggtcaggagttcaagaccagcctggccaacatggtgaaaccccatctctactaaaaacacaaaaatcagccaggcatggtggcagacgcctataatcccagctactcaggaggctgaggcaggagaatcgcttgaacccaggaggcgcagtgaaaggagatatctccattgtactccagcctaggcaacagagcgagactccgtctcaaaaaaaaaaaaaagaaagaaaatgatgttcctcattttgggttaagggaggttaatcatgggatgagatctttcactccaagatgggagtaaggaggccttaaaaatagaaaactgggcctggcacatggctcacgcttataatcctagcactttgggaggccgaggcaggcggatcacaaggtcaggagttcaagaccagcctggccaacacagtgaaaccccgtctctactaaaaatacaaaaattagctgggcatggtggtgggtgcctgtaatcccagctactcgggaggctgaggcaggagaatcgcttgaacctgggaggcggaggttgcagtgagccgagattgtacctctgcactccagcctgggcgacagagctagactccatctcaagcctgtaatcccagctactcgggaggctgaggcaggagaatcgcttgaacctaggaggcggaggttgcagtgagctgagattgtacctctgtactccagcctgggcgacagagctagactccgtctcaaaaaaaaaaaaaaattagaaaactgaaaaataggattatcttttctttcccactgggttgatgccatcttcttccacctagcttcccaagctcttccttcagtcccacgactacagtctgtattccttggatgtggaattcatcaatgagatcctcaacatacgtaccaagtgagaattggggcacaggtagggcactggggaggaaaagcacccaaaggtatatacatgacccttttcacttcccagagaagttcctagactgcttctcacagctgttccccattccttagaagccagtttggttttctaattctgccatcatgagatttctttcccatcccttcttcacaggggccggacatggtacattctttcactgaccctctgccgtttcctggcctggaattattttgcacaccttcgtttggaggttttacagctgacccgccaccctgagaactggaccctgcaagcccggtggcggcttgtggggctgcccgtccacttgctctttttgcggttctacaagcgtgacaaagacgagcattaccggtaagagagaaatgagaaaggacccaaactataatcagttccttttttttttttttttgagacggagtctcactctgtcacccaggatggagtgcagtggcgtgatctcagctcactgcagcctctgcctcccggcttccagcaattctccagcctcagcctcctgggtagctggaattacaggcacaccatcacacccggctaatttttgtatttttagtagacagagggtttcaccatgttggccaggctggtctcgaactcctcaccttaggtgatccacctgccttagcttcccaaagtgctgagattacagatgatctagtctcccagacaacccttgacctatcctcacttgactgtttaaggacagggatcctgtttagtttatgttaatgttaaaaaaaaaatagagactgggtatattagaaaaacctctgagcttcagtttcttcctatacagtgcctagcacatggtaggtactcaaatacttactgaacagactgggtgtggtggctcatgcctgtaatgccagcactttgggaggccgaggtgggcggatcacttgaggtaaggagttggagacctgcctggccaacatggtaaaacccaaaaaaatacaaaaattagcccagtgtggtggtacacacctgtagttccagctacttgggaggctgagatgagagaatcacttcaacctgggaggttgaggttgcagtgagccgtgatcacattactggactccagcctgggtgacagagtgaaaccctgtcacacacacacacacacacacacacacacacacacacacacacaaaagtactgaacaaatgaaaagtcctgtctcatatgttgagccttacaacctggtaaatttccgcctgggagtagaatcccaataaattgttagactcagccacaaacattggatataagtttttaaaccagcagttcccaaactgctgcacagtagaaatgcccaaggatcgttaaaaaatattgacgccaaacactctgatttaattgagacagggcacaacctaagcactgagatgtttgtaagttgcccaggtgatctaatatgtagcagaatttagggactactcgtttaaacaaatgcttgaattcagctttgggaccagtcaccttctccctcagtaagcctccctctattccccaggacctatgatgcctactccactttctacctgaattccagtggcctcatttgtcgccatcgtctagataaagtgagtcctaggtagggctgggtggggtaaagggtagaacatttgtgtgcctcccccaactggcattaacctttctccctgcagctgatgccttcacactcacctccaacgcctgtgaagaagctgctagtgggagccctggtggccctggggctgtcagagccagaacctgacttaaacctgtgttccaagccctgatccttgaccttggagtggaggcagcactgaagactgctacgcccaagagaaggaggtggaggcagccaagaatctcaggagccagcttcctctcctcgtttctctccttccttcctttccatctcatgctgtgtaaagctgctgtgtaatttaacttgtaaataataaagtttaactgactatatgagatagaatttcacatatcactttctctagatcccaaatgttcccacaagctttattccaaaaataattttatttaataggtattaaataatgtatagaaggaaaaggagctggtgtcaggttctgtttacgtccttctcttaccctagctcttctcgtgttttgcctatttttttgggcattttcttagcatggggatcttctagctccttggccttataataatggggagccacctccagaagccaactgctctcaatctccagtacctaggagagagaaaagatcaatggagttcccttctttccaacatagatcttttgttgttgttatttttttttcttaaattgaaacagagtcttgctctattgcccaggctggactgcagtggcgtatcatggctcaaagcagtcctactgcctcagcctcccaagtagctgagactacaggcacacatcacagtgcaccattaattttttgtatagttggggtctcactatgttgcctgggctgatcttggcctcccaaagtgctgggatggtttacaaaaatgagccactatgcccagccccaacctagatccttatgtgtatggtcaaaagttatctttcctctttgactgcagggctaggtgtaaaggtgcctggctctattattatatacccaaagggcagatacacctctgtatgttattcaagataccaaataagctattcccaagaaaagtctagaacaacatgccaggcacagtggctcacacctgtaatcccaacactttgggaggccgtggcaggcggatcatgaggtcaggagttcgagatcagcctggccaacatggtgaaacccagtctctactaaaaatataaaattagctgggcgtggtggtgggcacctgtaatcccagctacactggaggctgaggcaggggaatcacttgaaaccgaaggcggaggttgcatgagctgagatggtgccactgcactccagcctgggctacaacagcacggaactctcaaaaaaaagaaaagcctagaacataaagactatactctgtgagaccagagactgctttgttcattatagccccagcacctatacagtagccattcaaatatttattgaataagtgtctagttctcagatcttggaagatgctgacacacctgttagaaaggatgtctttgggctgggcatggtggctcacacctgtaatccctgcactttgggaggccgaggcaggcatttgagaccagcctggccaacatggtgaaacctcatctctactaaaaataacaaaaattagccaggcctggaggcttgcgcctgtaatctcagctacttgggaggctgaggcatgagaatctcttgaaccccagaggcagaggttgcagtgaggctagattgcgccactgcactccagcctggacaacagagtgagactccgtctcaaaaaaaacaaaaaaaaacaaaggatgtctttctattttaccctaccttcctctttctgtaccagtcccagcaacttgaacctgggttcttagcttgccaggacaccatctctctacatagtctccacctgcgtgggcacaggatgttctcctcacctgtctcatgaactctttggtggtcaagacaagttcgtggtagagcagccagcgtggctgttgctcaaagagggaggagttgggatgaatgaagactgtctgctgctgtttcactgtgcggtagccactccgagtcaaccgtgccgtgtggtaaaagtaaccagcagtgatggcctaaggagcgggcaggaaagaaaatcaatggaaaaggcagacatctggggaccctaagaatgcactacctttttagttcaggcttcaggaaaactagagaggtaaggaatgcatgaagaacttcccaggaatgaaccttcagtggtctggggaagaaagggccctgggaggacacgtcatacacaaggggaagagggcatgctctcacgctggaggaaatgctgcatgcccccagagaagcttgctcctgggaaggtactgggggtggaaagcaggaggctgaagaaatgctgaccttgcgtacacggatatagtccccctggcaggaactgagaccaacttccacacgttccaagagcccttccagctgttcccgcacatcccgggctcggcgcatcgatctgaactgtacaaagttctcatagcaccactgggaagagtaaccactctcagcccactgggaagacagttaaaaagaaaggagagataattaagtatacagcaggactaaagtcccccagtgtctctcattcccactcacccaagcccagtgacctgtgtgtaaacatttagcagaaccaggtggtcaccgccagggagaaagaagttgacacgggcattgtcagcatggacgaccttgtcctttggtcggtagaagatggagttgttgacagagagcatggcagccactgtcaggatctcctctgaacagctgtacctgggacaggaaggggaaagcatgagttcaaagcaagacacataggaacagatatggtggagtggggagtgatcactgtgtgatggatgtttcctcatgtggggaaggctggttggcataatggctacaaagcagccagcagatagattctggcagcagcttgggggtcaaggaagtaggggccatagatgaaacacagtcacaaaggagggacatccatggaggcaggagcaggaaacaccggggaattctgaggcttctgcagaaagtgtgcattcactatgtgcatttggaaaagatctctgacagcagaggaatggcatttaaaggtcatccctccacagctacatctaaatgttctagttggaaaccttaggaacaagtaagttcctcaaggggccgggcgcagtggaatcaaggataggatcaagtgtcttacccttgtgggcctcaaaagggggcaatcagagttatctaatactttattatgtgttaagggatagtatgatgaacagaaaaagacagacaaaggggaccctggagacagaggaggcctggcctgtttgtgtgctgggggcccaggtggaggcgagggcttacttctcagaggctaagatcattttggacagcatggggtccaccggcagctctgccatctttcgaccagactaaggagaagagagagagagttgagcccagtcctccctcaggtttcccgctactactacaggggtccctggagccatcctgacccctatcatcctgcctccacccatgctgtcccccgactcaccgtggtgagctccccaaggtggttgagggctcccagagcatacagctgctccaaagccagcagcagtgtctcatatggtggagggtccaggaaatcaaagtgcattaggtcatggatccctagaaagaggtgtgatggatggaacagagtcccttcaaaggacagtgactccagcccctccctcctctctcaggtagcccaatcacctaagctcttgagcagcaacacgacattgcccaagctggtcctctggatctcaggcactgtggtttcctcaagctcgtgctgataggcccaggcggtatacaggcggaagcacttccctgcagccacccgacctgccctgccagctcgctgattggctgaggcctggaaagaaaggggaacaggctggctgacaatttggtcagggaaaagaaaaaggcagtatttatgcaagaaatctggaaggatgcaaactgctcatcccggttccctaggaagcccccaccctgcttctgagttggaccttctctgtgggccaactccacctcccccactcccatgcatccccaggctgaccttgctgcagggtgtgacagtgagcgattccatgcctgtgcgggggttgtagctcttctgcttacagaaccctggatccagcacataaatgatgccctcaatggtgagtgatgtctcagcaatgttcgttgccacaaccacctgagtgataggatatggggtcacccagtgaccccacctacctagttacccagaaaaagtaatcttggaaagttaggagtagtgaagcagttgcagtaaggggcaggagctgagggaattagtagtatccaaggtcaggagcaggggacaaggccagaagacaggggacagggaagtgggggctgggagtcagcagggccataggaggaaaggaaatggagaagaggatttagggttttttttttttttcagagatgggaaatgggggtgttcaagttcctgcccgatcctccccatcaccgctttcgtcttcacacaacacttcctgtaagagcctcctaacgtgtatccctgcttctgctcctagcctctgtcacatggcatccaggatggtccttttaaaatacaaacctgtcacatcactccccatccttcagtggcttcctatcctactctagaattcaatccaagccccttaaaagcctggatcacctaccccagctgcctttctgacctcatctgctagcactccaccacctccctcactcctcccacacactgctttgctctgcccaagtaagtgcactcctcactggatcatttgcatcagctattccctctgtctggcatactcttctcccagatatcagcctggctccctccctcacctggtttgggtctctattccactttccccttactgaagaggccctccctacaccccaaggaaaataccttcatgccagtcctcactcccaccccacagagtcaagttccatcctactatgctgccttgtatctcttcatagcactggccacaaattgacaatatgtatttatgcatccactgcttccccgatagaccacaagtgcaagtttgttaggctaaggactttgttttgttcatcactgtatcatcaacccctgtgtacctgacacacagaaggaactcattaaatatttgttgaatgaaagttatatctctgctcaaaatcctttgactgctactcagctgtctaaagtccaaacttcgccaagcacagtggctcatgcctgtaacccagcactttgagaggccaaggcaggcggatcacttgagtccaggagttcaagaccagcctggccaacatggcgaaaccccatctctactaaaaattagctgggtgttggccaggcatggtggctcacgcctataatcccagcactttgggaggccaaggtgggcagatcacctgaggtcaggagtttgagaccaacctggccaaaatagcgaaacctcatctctactaaaaatacaaaaaattggccaggcgtggtggagggcacctgtaatcccagctactggggggctgagacaggagaatcgcttgaacctgtgaggcagaggttgcagtgagcagagttggtgccactgcactccagcctgggcgacagagtgagactccatctcaaaaaaaaaaaaaaaaaaattagcttggggtggtggtacacacctgtaatcccagctacttgggaagctgaggcacaagaatcacttgagcctgggaggtggaggctgcagtgagccgagatcttgccactgcactccagcctgggcaacagagcgagactctgtctcaaaaaagaaaaataaataaagtccaaactttcctgtcatcaaaggccctccctaatcttagccccaaattgtttttagccttgtctcctactccttcaccacatgaacctcccactaagcctactagctcacactctgacctcaaacataccttgggccttcctctgatgacttctcagccatttttcttttttgagatggagtctcgcattgtcacccaggctggagtgcagtggcacaatctcagctcactgcaacctcctcctcctgggttcaagcgattctcatgactcagcctcctaaacaggtgggattataggcgcacgccaccatgccctgctgatttttgtattttcagtggaggcagggtttcaccacgttaggcagcctggtttcgaactactgacctcaagtgatccgcccacctcagcctccgaaagtcctgggattacaggcgtgagccaccgcacctgacctcagacatttctcttaaaggtccatatcaaatcccacctcttagcacatcaaggacttcccttctccactgaatctactgtgcatactttccagatcacatatttggctctctcttggttcacaccatatttctcctctcttcagtcccaggaacaagggactggctgctcctcagctgtgtgcagcagtgcgcaggactcaccttgcatggggcaggcacacagctttttcactactagttgtgggaagcataggggtgaagagtgtgggtttctccaactgacctttcgtgccccaggtggtgtgggctggaagatacgggcctgcatgtcagagggcagattggcataaatgggcagcaccaggagctcccggattttggagcccaggcggcggcagcgatcctggagcatctcacaggcagcctcaatctcctcctggatagagggtagggagagcagcaggggtcccagagtcacagaaggccaacatgccggccctgtcttcccctgggatacatcatcccctctccccaccatgtcaggcacctgtcctgtcaggaacaccaggatatccccagggggctgggtcacatggatctgcaacacagatactacacaagcttccaagtagtcagcctctggagcctggagagcagaaagagatggggtcacaggagggccacctgcttaggcaaacctttcctctcctcccaattcaacatacactttatcctagttcccctttgaaccttccattccatctttccctccacaggataaccttctccaaaggcctcagcttttctgccacagacttaagcccatcctccctgagggggcaccttggtgtagaagatgtccacaggaaacctgcgtccggggattcgaaacacaggggcgtcatcaaagaaggtggaaaaacgggcagtgtccattgtggctgaagccaccaggaccttgagctcaggtcggaagcgagcaacatccttgatcaatccaaagagaatgtctgtgtgtagggtcctttcgtgtgcctcatccaccatcaccacgctggggagggaataggagagcaatgagggaagagcgctaggcaatgcagtatcagacaccagagttaactggatgagaggggagtaatggacacaaagagttcaagaatgactgttgacggagggggctctaaggagaagtcagccatcccacttatgtagagcaacagaaagtcagagaaggccagggccccatgatctgcaacctatcccagcctcagcagataataggagacaagatgtagaggctgcacactgaggccaggacaagttagccataccctctagttcagtcaagagtctgcttagactcagcagctgctcttactagaaaaagttgaaggatatgttttaggctgggcatggtggtagctcacgcctgtaatcccagcaccttgggaggccgaggcaggtggatcacaaggtcaggagttcgagaccagtctggccaatacagtgaaaccccgtctcttctaaaaatacaaaaaaaattagccagatgtggtggtagacgcctgtagtcccagctacttgggaggctgaggcaggagaatcgcttgaacctgggaggcagaggttgcagtgagccaagatcgtgccactgcactccagcctgggtgacagagcgagactccatctaaaaaaagaaaaaagaaaaagtggaaggattttttttttgagacagtcttgctctgttgcaggctggagtgtagtggcatgatctcagctcactgcaagctccgcctcctgggttcacaccattctcctgcctcagcctcccaagtagctgggactacaggtgcctgccactgtgcctggctaattttttgtatttttagtagagacggagttttgaaacagagtctcactctgtcgcccaggctggagtacagtggcacgatctcggctcaccgcaagctccgcctcctgggttgcgttcacgccattctcctgcctcagcctcctgagtagctgggactacaggtgcccgccaccacgcccagctaattttttatattttttagtagagacggggtttcaccgtgttagccaggatggtcttgatctccttacctcgtgatccgcctgcctctgcctcccaaagtgctgggattacaggcgtgagccaccgctcccggctgatacgttttaaaggaaaaaaaaagtggaaggcagggtccctttcaataagggtgggccagcaaggctgactgggggtaatagacctgagctgctgtgattcaaatagcctagaagctcctggtgtcctgtgggacaactgctgctggcatcattcttgactgtttcttcttttggagacaggagcaagttaagcctttctacctcaactctcacaggactctgcatgctccttggtttcctcctaactcagttatgtgcatgacaccttctttctctttgttctttggcttttctgggtggcagccaagtcccaggaactcatccccatcttcccctacccacctccctgacctcaactctttgtgcctaaccctaactgtgatggtgaagtccccagccattccacaaagcaggctggctcgatgggcaaaaacatctgcatcagacactcttgcgctggctggctctccatgggttcttagagatcttttgcaagggatatgaaggataaaatcctatctgtccaattgctccactgtgatcttccaagaccagaaattcacagcctctgaagagtcaaaaaggcacatattgttcagctggcctgaccccacccccattacattcatgaatcccttttccccctcaacacatgttcaaccaacccctgcttggccatttccagcactaagagctcattattcacagaccaagctacccaagacttgtgtggagggccaagacccagagtccaaccactctgacaggccctgcaatctccaccactctgagggttactcagccattggtattgagttggaatctgtctccctgtaacctccccatggctcctagctatgtcgtgtagggtcacataaaacaatctgatccttctttccatgtaacagccttcacatatttagagggaaccaggatgcttcctgtttctccctctgagctgagcattccaagtgttttcaaatggtcttcacacggtatttcaagtctcggcagcaatgctctgctatcctggttgttttctaaaccctggagatgaatggggaaagaagaggctttctctacaatctcttctgtcctccagccccatctccgtggtacctggaggtcagttcaaggaccatttgaaccacaaagattcaagaacgggtggattaatcagaagacaatggctgaattggctgggtgggaagaagggagagaaaggccagagattagagatacctgtaactcgccaggtcaggctcagagaggaactcccggagaagcatcccatctgtcatgtagcggaggacagttcgctctgatgtgcagtcctcaaagcggatgctgtagccaacctggtcaagggaaccattagcaaccaagtgtgggctggtgtgccctgaaaggaacttggggaaaggtgaagtggggcagcaccaagacttctgctgtagggacctgagggaactgtagactgagtcacagaccccagactctaccccccggttccctagaaatctcacctcattcccaagcttcacacccatctcccgggccactcgggcggccacactcatggcagccactctccggggttgggtgcaggcaatcttcatacccttgtttgtataaccctgaatgacaaagaaaaaagaagaagtttgccctttactaaatatgcaccctgggaccaggtacatttcagagaaagaagttgtaaaaaccaggcaggagaaaaggaggaaaagacagatgctgaaaaccagaaaagaagggcaaatagataggatgacagacctagggccctcaaagggggtcctcacccagctctgggtaattaagttcatgactctgctagacttgagctggaaaagaacagattagctgagacagagccagctaaggtaaaaaagcaggaaggctgggcacagtggctcatgcctgtaatcctagtactttgggaggctgaggtgggaggatggcttgagctcaggagttcgagaccagcctgggcaacatagtgtgacaaaaaaattaaaaattcaaaattttgaccaggcacagtggctcacacctgcaattccagcactttgggaggccgaggcagacggatctcctgaggttgggagttcgagaccagcctggccaaaatggtgaaaccccgtctactaaaaatacaaaaaattagccgagcatggtggtgcatgcctgtatttccagctacttgggaggctgaggcaggagagtcgcttgaacctgggagacagaggttgcagtaagccaagatcatgccaccgcactccagcctgggcaacagagcaagactctgtctcaaaaaaaaaaaaaaaaaaatttcaggccaggcacagtggctaacacctgtaactccagcactttgggaggctgaggtgggcagatcacgaggtcaggagattgagaccatcctggccaacatggtgaaaccccatctctactaaaaatacaaaaattagctgggtgtggtggtacgcacctgtagtcccagctacttaggaggctgaggcaggagaatcacttgaacccaggaggtggaggttgcagtgagtcaagatcgcgccactgcactccagcctggtgacagagcaagactccacctcaaaaaaaaacaaaaaatgtttaatatgggcatggtggtgtgcacctcccagatactcaggaggctgaggtgggatgatctcttgagcccaggagtcccaggttgcagtgagtcatgatggtgccacatcactccagcttgggcatcagagcaagagcctgtctccaaaataaggcaggggctaggcacagtggctcacacctgtaatcccagcactttgggaggctgaggtggctggatcacttgaggtcaggagttcgagagcagcctggccaacatggtgaaaccccatctctactaaaaaattagccaggtgtggtggcgcatgcctgtaattccagctactctgaaggctgacgcaggagaattccttgaacccaggagtcagaggttgcagtaagccaagatcgcaccactgcactccagcctgggtgacagagcaagactccgtctccaaaaaaaaaaaaaaaaaactaacaaaaaggcaggaaaatagtcctttaactccttgttttttggccacgttggagcatagggaggtccacatttatacacgccccactccacctatccatctacccgtccttccaaatgaaatgaatgcaggaagtgagaacagaaatgtgaaaagggtatggtctttactctcaagaatttcacaatttagtggaaaagataggtaagtgactactaaaaatataatgtaaaaggagctctgacaggaatgaggacattgatgccaggtgccctggcaagctgaagggtgagatgactgtacctcctcaaagagatactgcgggatctgggtggtcttccctgagcctgtctcgccttcaatgatgaggacttggtgatttgcaatagcagccaggagctcctctcgaaatgggaacaccgggaggctgcggcggacggcctggatggactctttctgctgggcctgagttgaagtgggtggagctgacggctcctaaggaaagagaaggaggtgtgagctaaatagctcgctacgggtcttcctcagaaagtctcccagctcccctcttacctcatcaccctggagctgagtggcccggacaaactcaatggtctcctcctcctccagcaccagttgatacttgggctcctgagaggcagcatctcgggccccaaacttcagggacgctgccccaagccgcgcctcctcccagcgccgctgctcctccccaggggctcctgattcctcctccactagatccacagctcgggctggctacagagagaggggatatgtgaagactcaaaaacaggatgtcctctctgccctctcccctcttcccattactacccccgcccactgcccattgggaacggcaaggcaagaaaggggatgacccacgtgttgcccaatcccctgaagccttccccacaacttgtcttggggaccaaggctgaagcagacgccgcttcacctcacctgtcctcgggtttccttgggcatgtggtagcgattggtggcctccagcttctcctgctccccagctgcccggtactcccgggcgagatcccgcactcgccgcttatatttgagctcctgccgctcgtgccggctcagctccacgtccccaaaaaggaactcctcatcagccagctccgcctccaggtcctcaagcttctctcgctcccgcttagccaggtactctcggcgagatttcttccgcagctcagggacctgagttgggaaaggacagtcgaatcctcatcttgctggaggagcaacccctttctctaccaatccctacaagggaaaaatcccctgacaggcaggcatgagaacctcaggatgcaccctctaccttccctctgcaatgcacaaccaaaacaatgacatactcaaatctgggcctctttggatgctacatgctgaccccacatcgtatcttcctgcagcagaatccagctggaaagtcctcttaggcagcattatcatctttgttaatatagatgcactagggagatgtctgcgtagcttatattttactcttgccattttattcaaattagtggaaagggggaaaataaaaggctaatccagcatttagaagcacaggactcaaaccgaaaacaattcagacaaagatagaaaccagtgagggggccaacaggaggcaatcttcagccccagttagatgttctttggtcttaaacggaatgactgtagtttgaggaagggagaaaaactgattataaaaagttaggactacagcatcagagtgtttctgtaaggcaaatgtaatcagggatgtttggctttctggtactaacctctcttcaccatgctgtgtctcacttagtttctacacatttacctttgatacaaacttttcaggacacattatggatgacagcagaaaactggcaatatctataaggccctttcctgccaggagtcctcccactatgacatcatcctctctgtgatcacaacttcctctactgcaaggtcaaagcccctctggtggctgggtgggcgtggtgactcacacctgtaatcccagcactttgaaaggctgaggtgggtggatcacctaaggtcaggagttagagaccagcctggccaacatggtgaaatcccgtctctactgaaaatacaaaaattagctgggcatggtagtgggcacctgtaatcccagctactcgggaggctgaggcaggagaatcatttgaacccgggagacggaggttgcagtgagcttagctcacgccattgcactccagcctgagcaacaagaacaaaactgcatctttaaaaaaaaagcccctctgctgttctacccttaaggggcctggttctatttagttgtttggcttttcttgtttgttctgtaaagacttaaaatgcagtttatgatcatgacctaatctgggtaccacagtcaaatattccttccatggaagagccagatagattttttttttaatatgggcaaaaaatcagagccatttgagcattaaaaagaataatgatgtgagattataaaatactgaaaaataaaaattcatgagtccaatttgacacacacaaacaaaaaacaagggaaaaaaatctgtcaccagtgaaatgactgttacagcaaacgccttactctaaaaattcgtatttaaaaggaaacaaacatttaccctttttaagaaggaactgtagcttgttcctagttgttgaggaaaagctcttctttatagacaaattctagccaatacacgtaacaggaatgacagaatcaaaaaatcaccatttcggccgggcgcggtggctcacgcctgtaatcccagcactttgggaggctgaggcaagaggatcacgaagtcaggagatcgagaccatcctggctaacatggtgagaccccatctctactaaaaatacaaaaaattagccgggcgtggcagcaggcgcctgtagttctagctgctcaggaggctgaggcaggagaatggcatgaacccggaaggcagagcttgcagtgagccgagatcgcaccgttgcactccagcctgggcgacagagcgagactctgtctcaaaaaaaaaaaaaaaaaatcaccattttgcaatccccaataaaaataacatgttcaggaaaggattaccagtggcttctaaaagcatttgatgaaaggctattggtagaaaggatattaatactaatatatagatacacaactggatagtatgtccccgtgatatgacataatatgaagtgcacatcaccgcccaagaagtgttcctgccacaactgtttaatctgagtgtcaataagctttagacccaattcctgcttcaaagaaagcacagggcagagaagtacttaacaccacaagataagaatcaggcaaatccagaatgtaggacactgcaaggtgagacagacagagagagaaacaaacttaacatctaagacccaaatgcaatgcatgaaccttgactgcattcttgttaggaaaaagcagtcattaaagttattttgagggtaatgagggtatcttttattgtagagagatcttagtcgatacataagaattactgttcaacttcctgactgtgacaagagcattctgattttagaggacaatatctttatccttagcaggtacacactgatgtacttagagataaaacgccatgatgtctaagactcttttaaatggtctgaaaagaaaaaacataccacatttacaattacaatgcaaatactacccatagtattaaccatttttcaatctgaatagtgtctatgagtgttctttgttctattctttcaacttccctatgtgcttaaatatttttgtaatcgaaaaagaaaaattacagctgggcacagtggctcacgcctgtaatcttaacattttgggagaccgaggggggtggatcgccaaaggtcaggagtttgagatcagactggccaacatggtgaaaccctatctctactaaacatacaaaaatcagccaggcatgctagtgcatgtctgtagtcccagctgctcgggaggttgaggcaggagaatcacttgaacccgggaggcggaggttgcagtgagccgagatcatgccactgcactccagcctgggcgacagaatgagattctgtctcaaaaaaaacccgaaaaattaaattcaggccaaaacagtaacaccactaccaccacaactgcactgagatgtcccagaagcctaaccacagtcaatttcaggaagagatatgagataaattggtcaggagagacctgggaaccagtaggccattcttagaactccaaaagttggccgggcacgtggtgactcacgcctataatcccagcactttgggaggccgaggcaggtggatcacctgaggtcaggagttcaagaccagcctgaccaacatggagaaaccccatctctactaaaaatacaaaattagccaggcgaggtggctcatgcctgtaatcccagctactctggaggctgaggcaggagaatcgcttgaactcgggaggtggaagttgcagtgagccaagatcacgccactgcacttcagcctgagcaacaagtgcaaaactctgtttcaaaaaaataaataaatgaattttaaaaagtaaaaacggccaggcgtagtggctcatgcctataatcccaacactttgggaggccaaggcgggcagatcacaaggtcaagagatcaagaccatcctggccaacatgatgaaatctcctctactaaaaatacaaaaaattagccgagtgtggtactgcaggcctgtagtcccagctactcaggaggctgaggcaggagaatcgcttgattcctccaccagggaggcacaggttgtagtgagctgagatcgcaccaccacactccagcctggcaacagagtgagactccatctcaaaaataaataaataaaaataaaaaataaaacaaaacaaataaaaagaaggctgggcatggtggctcacgcctgtaattccagctctctgggaggccaaagcaggtggatcacaaggtcaggggttcgagaccaccctggccaacatggtgaaaccccgtctctactaaaggtacaaaaaattagccaggcgtggtggtgtgcgcctgtaatcccagctactcaggaggcggaggttgcagtgagccgagatcgcatcattgcactccagcctcggtgacagggcaagaccccgtttcaaaaaaaagaaaaaaggtttaaaaaaaaaaaaaaaaaaaaaaaggaacttcaagagtctcaaaattctattggggtattggggaatctaagtgtgactttacttgacaagaccaggcctttggaaaacagcttaccctacctagtttcacaccataaaaagtccagtttatgaattacaagggctctgtccctgtccagtgagaagacacagggagatcacaaagccacataaggggtgcaggaattaggtggtgggaaggtatttggagatggtgtgcctaagctgaatggtcagcacatccctgtacagtgggactgctgccctgcccttgccctccagcaaccttcttgacaacattccagctgcctcatatctcattaggactcaggaatagggaaagctcacaatttcattcactaatagagtatatttgatcctaaagttaagagtcaaggaggacttatgggtagcctccttccccctacaacttaagaaggatccttccctcaacaacataagtctatcctcagctggctcctaacaaccaagcccctcttctagaaacctgaccaccccatcagcatccacactgtgcttcctctgtatcctctctccctatacactctatcagaaagtctttccttttgtcttctgatcttggctccctaggccctgggactcaccatggccttccggtcttcctcggccatcttgaggcgcttctgagcctcttcataagcctagaagaaaaaacaagaatggaggggtgtgaggccaaagagcccccacactgacagctgctcccctctagaatcacaaggatcattcagatgcgccctaacacaaaaaatgtcccctctcagtgaggaatctctctgattgcaggtacagcagacagttgtcttagccacaggatgcacagggcttctctcaccacagaggtgaacatctcactagagacagccccttgtcttcccagagatcactatctctgcactcacagccaacctcagatttcaccctgggatcttggggatttacagaacatgctgctcctattcaccttcttgtctgaccgttccaggacatttcgagtccgatccttgtcccgctgtcgaacccgctcagcaaaggcatcacgctcctccaggtcctgaaggcgttcacgctctgtccgttcccactcatcttccgactctggcttctctgtctgctgtttactccccctgcagcccatccaggggattaaataagggcatagagaacacttcagcctgccccatcctctctcaccctgcttctgacttaccctgttttcttcttccctttctcagaagcctcttcctcctcttcttcctcacgcttcttcctgaggtgtttccgctttttacgtttcttctggaggctgcttccagccctactcacagtctcctcactgctctcttcactgtcttccagtaacctataagatcggttcttctccagcagggcccgggcctctcgctctgctgcccgagctggcttttctaccactgcctttcgtggtacctgtcagtagaggggaagataaggaggtctgagcaactcctgatctctgccctcccacttagctctgttcctaatttaagcaattacttagtctttcctgcccccgcggcccggccccactgtcaggcaatggcgtgatctcggctcacttcaacctccgcctcccaggttcaagcaattctcctgcctcagcctcccaagtagctgagattacaggcacatgccaccacgcccgactatttttgtatttttagtagagatgaggtttcaccatgttggccaggctggtctcaaactcctgacctcatgatccactcacctcagcctcccaaagtgctgggattacaggcatgagccaccacacccgggcacaattacttagttttaaaccagctaaccagcattcattctctttcttcctcatggcttcaccccatcttcatcatcctgaatggggttttttatttttttttacagacagggtttcactctgtccctcttgggctcaagggatcctcccacctcaggctcctaagtagctagaaacacaggtgcacactaccacgctcaactaatttttaatttttttgtaggacgaaggtttcgccatgttgcccaggctggtctcgaactcctgggctcaagtaatcctcctgcctcagcctcccggggtgctgggattacaggtgtgagccactgcacccggccccctctgttaattaaacgactgaaaggaagttcagaagatgaggggggccgggcatggtggctcacgcctgtaatctcagcactctgagggggctgagagaggattgcttgagctgaggagttagagaccagcctgcgcaacacaccaaggcctcatctctaaaaataaaaataaaaataaaagatattagccgggggtggtggcgcgcgcccgtagtcccagctaccggggaagatgaggtgggagggtcgcttcaaccagggaggtcgacgctgtagtgagccgtgatcttacgaccgcactccagcctgggcgacggggcgagcgagactgtgtctctcaaaaaaaaaaaaaagaaagaaagaaatgcagaaactaagatccctactgaatcgcaatctgcattttaacaagaaccttggatgcatgttaagagttcgagaaacaccgttctattgcgcttaacccgacacacctaagccctcctcaatcttctccactgagctgggcgtccagcagctagcacagtacctacgcgacaacggacaaagaataagtgcttgtgaactgagctttcttaacttctcgatggaccgttaggccagcctcaccgggacaaatcacagggcccctccccacccctgccgacaccttgttccagagtctcagggcgaagtcccgggccggcccactgagatccaaggtatcagtgtctcgtaggcgctgcacgaactcctcggcagaggtgcagcgctgtgcggtaccgatcagaaactgggcgacgtgccgctcgctcagccccaacaccgagtgcagctcgtcctgaacccagcgctccagacccgccggcgtcgccatggcgactcacgctccctgctcccggccctgaagcgtcgggcagccgcgctcactgctgggccggtcagaggcctggagccctcggctggagcctcagcttcgcaagtcagctaccttgggacctctaggatcttccgacatcccaaagctgtcttcccgtaccgcggagcccggaaggggctgtactttttcggcctctaagcactacggtggccgagcgagttcaaacctcgcggaaccatacctgaaaactcggggtaattcttttttcttcatttcgcctctgtccagtttctctgacgccccctgatggtcagtctgtgagtgcttcgctcacgcattcattcaacaagtgaaattaatttaatggatgcctaatgtgtgctcattgctttccgtccctgggatatagcagaggacaaatcaaaagttccttaccaaatttacattttgcggtgggggagggacaggatacataataaagaaagtatggaaattttatagagccaaaaactatacaaagtaagggaggaatgaaattctatttcagattggaagatcgggtccatgctcataaaacatattagcattgttggccgggcgcggtggctcatgcctgtaatcccagcactttgggaggccaaggcgggcggattatctgaggtcaggagttcgagaccagcctggccaagatggcgaaaccctgtctctactaaaaatataaaaattagcctggcgtggtggtgtgcgcctgtagtcccagccactcgggaggctgaggcaggagaatcatttgaacatgggaagcagagtttgcagtgagccgagatcccaccacggcactccagcctgagcaacagaggaagtctctgtctcaaacaaacaaaaaagtgaccgttgctaggactggtttgcctgcagcaggagtgaagacaggtcaggtataagggaagacctctaggcaggaagaaactggggaactggggaaagttgttaaagacaaaatctccaaactaaggaacaggcaaactgtgttctgcatttttgcttaacagcttgagaaaatcactggtggctgcttatttaaaagtaagcaaggccaggtgcagtggctcttgctgtaatcccagcactttgggaggctgaggcaggaggatatcttgagaccaggggtttgagaccagcctgggcaacagggtgagaccccaccatctctacaaaaaattagccaggtgtggaggtgtgcacctgtagtcccagctactctggagactgagacaggagaatttttttttttttttttggagacagagtctcgctctgttgcccagactggagtgcaatggcacgatctcggctcactgcaacttccgcctcccaggttcaagtgattctcctgcctcagcctcctgagtagctggaattacaagtgtgacaagcacatgccatcacgcccagctagtttttgtatttttaatacagatggggttttaccatgttggtcaggctggtctcaaactcctgacctcatgatccgcccgtctcggcctcccaaagtgctgggattacaggcgtgagccaccgcactgggcctgagacaggagaatctcttgagcccaggagccagaggttgcagtgagccgaggtcaggcactccaacctaggcaacagaccaagactatgctcaaaaaaaaaaaacaaacaaaacaaaaagctgaatttgttactcgatgctctgctgtctgatttgtttgatcctgcatcatacttttgtgattaattgcagttaccaggcactactgttaggaaatgaaacattgttcttattaatagccacaagtggatctacatcactgacttttttttttttttttttggaaagggagtctcggagtctcactctgtcgcccaggctggaatgcagtggcgtgatcttggctcactgcagcctccacctcctgggttcaagcaattctcctgcctcagcctcctgagtaggcgggactacaggtgcgtgccaccacgtccagctaattttttgtattttagtagagacggggtttcatcatgttgcccaggctggtctcaaactcctcagatgaggcagtccacccgccttggcatcccaaagtgttaggattacaggcatgagccaccacacctggcctgacctcttgaatgcattgttttctgtttctgagatggactgtgagcacccctggcacctcggagcttcctaactctgttttcctgggtcacaactggaaactttttaagacctttacctaacaggctactaatataatcattctgtttccttccctacccagaccttctctgaactggctgagtcttttgacacctggcttgttctcttgctagtaaattgaaaacctttggcgtatgcttaagttcaatttgtctcatatattttgttttatagtaaaggtgtggggcctcctctgaccagtctgagaggagcaacttgtagtggtagaaggactataactattcaaccatatctttgttagcctggagagctaacaacaaacaaacaaattttcctgatgagtaaaatattgatgttccacatttgtataagatattctttgaaatgggaaaattccaaatatcaactacatgggcaccaaagccatgcactatcaagatggtttttaaacctttttttttttttttgagatggagtctcactctgctgcccaggctggagtgtaatggcgcaatctcagctcactgcaagctccacctcccgggttcatgccattctcctgcctcagcctcccgagtagctgggactacaggtgcccaccactatgccccgctaattttttgtatttttagtagagacggggtttcaccgtgttagccaggatggtctcaatctcctgaccttatgatccgcctgcctcggcctcccaaagtgctgggatcacaggcgtgagccaccgtgcccggcctttaggcctttaacgatataaaatccattgtctatcagaggggaaccttttccaggaaactgactcttgtacatacttacttcattttgcagcaatttcagatttagtattcgtagccccagctctttaagtaagtatccctggattagccacatgggttgtgtcatacactacctagctgccttcatggcagcaggcttctgaatactagaacccttcaactcaaagtgtcctctgtaatattttaacccttttcttctattcattcatttgttgtcattcattctagaaataattccgtgtctactagttgacaggtacaggatattgcagtgaatccagctgatgtagtcagccctcatggcacttccagtctagtggacacttcaactgccctttctcatgtcacctgcttgtcctgcgtgaaacccacgtgcagcttcccagaccccttttgacatgtcagtgccgagttcctggttcatcccccatcattttcctctcccccagccaccagagcctcccctcacataccctttttttttcccaaagaaggagaagcagacgagttgaagagaactccattttattatggaaagttaaaaaacaaacaaaacaaaacaggcaattgataaaggcggcacaatggggaaggagaggtgaggtgtctccttagccacccgacaccatctcaattcagttcaattgtgaaccactaggagaaacagaattaaataactatcaaggggtacagagttaagagttccagccttccctcttggggaaaactaaggcaaagtaatactgagaaaaagtggaggaagccacaccttcaggtcactccaatgaggagactggaggggacagaggagagaattccacgcagacacagcaagtaagcgtggcttgtaaacctgggactttggcaggtggggctgggagctgatggaatttgtaaaccaggctgtggtcaagggaggaggcaggagctgtaaacaaaggggcagtgacctaggaaatgaaggagatgtgcctataaatggagtggggtctgggcctcccagagagacgagtgcttaaatcccgagagtccccacgggatggtggggaggaaggctgtggggagagtgtaccctgccatggggggcaggtgctccatctccaccctccagggagttctgtgccccttctcaggacttggcgctcactcttggatgacctaggatgcaccagcacgtttaaccccacccacaccagggactttggattagggtagaaattgggcaattggctctgcccccagaaacagggtggggaaagcaagttacaagatgttggttgcccttccctgccaggctcattatcagggtctgtctgccctgaatcttccgggctccaggatcttcagttataagaaggagggaggtatatccctatgttggaagatggtcaccgccggcaggactcatctgtgggagagggggcaataatgttagagaatgagtgagagcctctgccttctgcccacccttcccccccacacaaattgaagggcagttggcatgcaggaagtcctataatatcttccatatctaaagcatgttaccaccagtaaccacatccatcactcatttagctcggactctgtgccaggcatccttataactgtttaatctcaccataactccaggagagattaagtaatatgatatccagctgtggctcttggtgcttcacaaaaaattacttaatcttggcctggagcacctgtaatccaagcaatttgggaggctgaggcaggaggatcacttgaggtcaggagttcaagaccagcctgaccaacatggggaaaccctgtctctactaaaaatataaaaactagccaggtgtgatggtacacatctgtaatcccagctactagagaggctgaggcacaagaatcgcttgaatttgggaggcagaggttgcagtgagccaaggttgtgccactgcattccagtccaggcgacagagggagacgctgtctcaaaataaataaataaataaataaataaaattacttaatattttctacaagtctaggaggtagtttttggtttctgtttttttgagacagaatttcactctgtcacccaggctggagtgtagtggcgtcatctcggctcactgcaacctctgcttcccgggttcaagtgattctcctgcctcagactcccgagtagcagggattacaggtgtccacctccatgcctagctaatttttgtatttttagtagagatgggttttcactatgttggccaggctggtcttgaacttctgaccttgagtgatccacctgcctcggcctcccaaagtgctgagattacaggcgtgagccaccgtgcctggcctgtttgtttcttttgagacaggtcttcctttgttgcccaggctggagtgcagtgggtggtgcaatattggttcactgcagcctccaactcctgaggtcaaacgatgctcccacctcagccttccaagtacctggaaccacagctgcgcactgccacacctggctaatttttttttttttttttgagacggagtctcactctgttgtcaaggctggagtgcagtggcacgacctcggctcactgcaagctccgcctcccaggttcacgccattctcctgcctcagcctcccaagtagttgggactacaggtgcccgccaccacgcccagctaatttttttttgtatttttagtagagatggggtttcaccgtgttagccaggatggtctcgatctcctgacttcgtgatccgcccgcctcggcctcccaaagtgctgggatcacaggcgtgagccaccgtgcccggcccacacctggataatttttcaatttttttgtagagacaggattttgccatgttgcccagggtggtcttgaactcctgggctcaagcgatccacccgtcttggcttcccgaagtgctgggattacaggcatgagccacaggaggtagttattattaacttcatttcataaataataaactaaagcaagagatcagatggtttccctgagatcacacaattaaagagacaagctggaattccaactcaggcctgtcgacccaccctgtgattttgaccagattacagcactcaggaagagttctcgttttgaaacctgaagactcaatgtgtacttcactgccggggacctcagtttgcccatctgttaaaggagcatgttgaaccagaggacccgccaagccccttccgagtgcctacatgtaatcctccctcctctctcctggaccacagcgcccgctctgacagcagggggcgccctcgggccggcggagcctccgcttacccacaatcagggccttggtgcgcagcccgccctggagctctggctgcagcagcagcagctcttcctcatcctcttcgtcgtcgggttgggctgctggagggttgggggcactggggacctcaggctccgggcccagctcctccagtaccgaactctcggaggggtattggtacgtggtctccagggctgtctcgctgaaggagatcttaagctgaaggagggagaaaaagggggcaggaggcaaggtcagcaggggagaagcccgcgggggttgagggagagaaagcgggggcggggggggcggagtctgcaagggagcaggtgggactggcggaacgtgggggtgggggctggactcaggtgccccactcactctccccatccactctgggatccagttttcctttccatactggctctccaattctagagtttccctcttcgatcatatcatttcaaaacatcagactttgccctgtacgttggcaggggcttgggaggcagaagtgaataatataagaccaaggtccctgctatttcgagtgtgggaggcagaggggtaaaaagaaattaaaatacatggcgataagtcttgtgatcagaaccgagtctttgggcaccttgggggcaatcgagtgaacttcccagaggagcccagcagactggccagtggggaaagaactggctggggagcgagtctcagacaaaagcaaggttttcatacccacagccccttgctgtcctatgcaaaacccaggaccctgggcacctgttccctcctactctcctcattcctctcctatccatagcaaagggagtctagggcctaggaagagatgggagatgaacagaaaggccgagaggaaccaagagactccagcaacacacaggggaaagatgagccgctgacaccctgaaggctgggggagatgacaagggcagaaaggaaagtccacacaaacctggggtgggggtccacagtgtgcccaaagggacaggcacagagacaaaataccagacagggcacagaaaacccttggtaatcacactgtcccaagagcaggcgagtcccagctgttctcactgcctttctacccttcccctttgccctattaagaagctcagggggaaggggcagggtgggattaagtctaggagccaaagggattagggagacagcaggaggattccatatgaactacttggaaaggtccaaatgatctactcaggccttccctggcatctgtttgggaagacttggggtcagccgtacatccctgagtcccctaatgaactgaggtatgaaaagagagaagccagaagggtggctgggcaggtggttgttaagagctgcatcaatatgacaccagtcaggcatggtggctcacacctgtagccccagcactttgggaggttgaggcgggaggatttcttgagcccaggagttcgagaccagcctgggcaatagagtgacactgtctctaaaaaagaaaaaaaaagaaaaccagatatgacacctgggtccccatgggaaggtagaactcaggaactgtatatgttactccttgttggctctgaaccctgcagtgtctccccatctcacttggagcaaaaagtctactccaggctgggcgcggtggttcatgcctataatcccagaactttgggaggccgaggcgggcggatcacaaggtcaagagattgagaccatcctggccaacatggtgaaacctgtctctactaaaaatacaaaaaaattagctgggcatggtggcgtgcacctgtagtcccagctactcgagaggacgaggcaggagaattgcttgaacccgggaggcggaggttgcagtgagccgaggtcgcgccactgctctacggcttgggcaacagagcaagactctgtctcaaaaaaaaaaaaaaaaaaaagtctacttgattgcccccaaggtgcccagagcctgaccaaagcctacagggtgctcccagtatgccaccctccccttgcctctctggcctcttcctccactccagccacactggccttggttccctccacgcactcctacctcaggaccagaacagtactagctattccttctgcctggaacactcccccaaaatatccccatggctctgaccctcctgatcaccctattttgaagtctccatattcactccccctacctcctgaccctctaagttccactgttctatttttttttccataatcacttaccaccttctaacttactagataatttactaatatattatactcatgtctgctgttgaaaggagcttggggccgggtaaggtggctcacccctgtaatcccagcactttgggaggccaagacaggtggatcacttgaggtcaggagttcgagaccagcctggctaacatggtgaaaccccgtctctactaaaaatactaaaattagccgggtatggtggcgtgcgcctgtaattccagctactcaggaggctgaggctggagaatcacttgaacccgggaggtggaggttgcagtgagccgaaatctcaccattgaactccaggctgggagacagcgagactgtctcagaaaaaaaaaagaaaagaaaagaaaaaagaaaggagcttagaagttggtacaatgcaagaggttagggtttgttcagacctcacatgaggtgccatcagaggaccaatgctggggaaacgatctgcgggtggtccagcctgtacacatttgacccccagttcatgtctgtggaactgctggtagaatctagtgacagcagccagactgcttatatcccaagttctcagaagggaccgcttaggtttctgtaactgacagatttacccacatttctgggaacccatttttgttttcttctcatatcctcttttggaataataacctctgtactttattttctactctgaaaatgacttattttatttgctctcggtctatgtttatatctccccccctaccctgcctgtctcctcaccccccaccaacttctgactgggcttctcagaaatgcacagcctgcatgggagtgggggggtagagagggggtgactcactcgctcctctcccatcagctatataaggtcacaatggggctggtctctcagcccaaccaagaggcctctggggtagggcaccagccacagccatcccctgggctccagtggcagggctgggatttctctcctgatggcagggataaatttgatggaattagcctgcaaacgagttatttagggaaggtgaagcgggggttggtggcagggtcctcctatctcctattcctgagccagtgtgttgcagcagagctgggacaaggcacccagtccctgaagaacaggttgctgacagggggtagagggtggagggtgaggcgtctgggtcagaggaactctgtgctgcctcctccccacccccacccaagcagcggctgcttccttattctctcaccacatcctgagcacagatctggcaggcccagggcccagggcccagggttccccactcagccccaccagccttccggcccccaccccaggcttcctgtttgggcgatctgcttccggctcccctgctctctggcctaggtatggtcaccagcacaggtcctgccctgcacttgcttcctggctcccctgggatgctccctgggctttgggccccaaagcttcatgcttccctctgctcattcttccccagaggcacaagcctctctcagtaggaagtgacttttctgaacacctcacccgggtagcatttccggacttctgtttttttcatctgcccagccctgaggggaacaggctggtagcagtcagagggctgagggtaggttcccaagaaccatggcttagaggtgggagcttacgcttcatgtgaagatgaattgggggatcaaatgaacccccctccacccaaggcttaacccgtatctttagtccctgtggttccccactgacactgaggacacaaaaaaatcaaatctgaggatgttaacacatgggatgagaatgagactgggcttcccaggctctggggagatgtgtgtgactggagggacttcctaagtctgagatgtctgagtgtgggacctctgtctccctagagattttcaagctggaaacagatggatgtgcacagggaagaagtgaggccagggccagggggagtcatcctggctgcccccactttcctgcaggtctttgttgcaagtctaacctctgaccctctgctggcctcagccccaacccctgtccagaactcccactgtgctccctggccagtgcctgttctcaaaactgtctccaaattcacttctctcttttgctaccctaaggggagggaaagtccaggatggcaggaaaagaggggaaaaccgatccctgagccagttcttgggagggaggggaaacccagggaggaaggacaggggagtgaggggcgggggtattttggaagaggagaaggcttttcttgtcccaagagagaagggagcactgtctgaagcagtggcccagctgggggtgtgcaaccccgaggtcacccacttcaaatggcctctctgtgtctctcccatggggcagactcggggttcaaaagccttctctctgatctttggccggcccggttccatctcccctctcccctccatcctaggatgtccctattcagctctgccctccttcccacggggcagttggacctttctccattcacttctccctgcagtttctccctagaacacaaacccaccccaccccctccaccaccccaggctccctatcccttctccccagaaaaactgcaagtgctctcaccctggtgaccctgccctcactgattcaagctcgtcactttaggctctcccactggatgggctggggcaggtcacactcaggaaaggaaggaaagaaaagggggttggaaactcagagcccaagggaagggagaatgagcagcctggcacaccctgaaagagacacacccagagacagcctttgctggggcaggatcttttgggctcaaaatggaaaaggagggctctgagaaggaagggtgtatgtgcagagcgaggaagggtggtggcaggaattaacaagaaagaatagaggaagacaagaaaacaggggtataaaaaagaaagagaccagagtccagagaaaattgacaagtggacttctaagaagtctggcttggctgcttccctacctgtttgtggtgtctttcgggggaccccttggcaaggcagctgcggctgagacggaggtagccccccagaaccaagatctcctcggcagttgggtaccgcttcttcccagcccccgggactgcagcatcaactgtggctggagaggttggggtggctggggtcgcagggggcacagaccgccgggggttgacggtgaaggtgtgtccactgcggcggggggcccccacccctggccctgccttcaccccatagaacaggcggctcatgaggggatccccaggaggttggggggcagttggggctgggggtgggggagacagaggggctggtggtgggggctggagctccactgcttcctcttcctgctgtctcaggcctccagtcccagcgtcctctggtgggaggggggagggcacagagcagcagttctgcagggctctcagaggcctgccctgagcccccgcctcctccttctcagcctccccttctccagcctccacaccgggagattccagaagcttctctgctgactctggaggttctggtttctgagtttgagcctctatgtccctgggtgtccattctcgagccttcccggagttcagggtccatttccacccttctgttggcttcatgcccctctcgccatcttccacaggcctctgctctgctgcctccactcctgcggaactgttgccttgggcctcccttgtcagggtctcggacagctctgcagtctcttttggagctacccctggaactggccactcttcttttctcccacattcttccgagtagtcttgtctttcttctcctgacctcagcctccactctgttgcctccagttgtaccaaactctgttcctgagactctctggagtcaggtctccatttatgggcctctgtcaggcccaacttctggtaggcagattcccctgggctcagtctactttccacctcttttctcctggggctttgctctcgagactctgctagtctcagactccgctctggagtttctccaggactcagcctccatttccatgcctctgacagtcgggagctcctgtctcccacctctcctgggctttgcctccagtcccgagcctccagaggcctcaggctcaactcttgggctccccctatccccagcctcctctctctggtctccctcggacttagtctctcttctcttgactctcttcccttggggctctgatcccgcatctccccagggctgggtctccgctcccgggcctccagaggcccaggctttctctctgctagcagctcttcactccgttgttgttgctgctgctgctgctgccgctcctgccggatgaatcggttctggtgcactggcccgatggcctccagaaggaccgcagactcatccgggtctggaggtccagcctctacagtccctagcacagggctaggctccccaggggacagcccaagcttggcccggcggcgctccaggagccctcgtttccaggctggcatctgggacaggcgctcccgttctgctttctctcggcctcgaacggacgcctcctcctgccggcgccgggctagcagctgtagcttccagtctgggatggtggccatggtcgtcttgaggtgagggtagggagcactggggacagagaacaggaaggagaggctccagagagtgagacagcccgggggtgagactgagggtgggaggagaggaagtggagggggagaggtgggacacaaagcagggcagaggggctaaggatgaggacagagggaaagacggaaggcagagaactggggaaatggaaaaagtgaagagaagttgtgagcccaagttgggggtggtgggggtgatgtgagaggaagagtccggattggaggcaatgagggcaggagccagatgtggcagcacagggttaatgcgtattaaagaccgtctctaggatgtgagaaagagagagaagggcgaaaaggaaagttggcgtgagggagaagagagaaatgtggcaggggtgaggggaacctgggtgcaggccaggctgcctcagcgataccccagggaggctagtgtgggaaggaaggaccaggaatccctgaaaggaccaggaggcaacgggacctgagggggtgttggggaggcaaggaggggcggagagcgaacaggtctagaggagaagggaaaccagggaagaggggaaaggagggcggcggcagcagccgggcgcgtctcagcgcgggccccaaaggtcccggctccgcttccagcaccgctcgggccacgcctctccccagcccccacccctctgccccgcactccgcccccgaggcgggtcgggggaaatagccacccccgagactttcggaacccgggcgtcagggctgccagcgcgttcccagaaccctggcgtccacccccaccctgtcctgtcaccaccgcctgcctcccccaccgactgccccacgcgaccccagagtgccaagggccggctccatgtctcttctccccggcgcctgcaagtcctgcgccccgtccccgctctcatgaagccgtgacagagccggccgtctccaccccgctgtagccgcacagactgacaatctcggcacaaagaggagacagccaaggtccgggccagggacgggagcaaggacaggggcgaggagacacccactccccaagtctgagcccctcagtcaactcacaggccgcgggacccccgggggagggggtgcggaggagccgggcgtccagagagaggaagaggaggagagagggaccgagggagatccggagactggagggaggggaggagggagggagaggaggagggaaagaggcagcaaaggaggagggacggagacagagaccagggggccgggcgggggcggcgaccgctttgtctaaggacaatgaggagagggaagggggcgcagggcggagccgaggagagggcggggcctagatccctcccaccccgcgtgggactcgctgcgggactgccctcttctcgccccaaccactggtcctccgctctgtccccaggggccctcaccagcttcccgcccggacacgccaggtgtccagatcccttcccccagctcgccgacccagggcggtggcccgtgactcaggcccctcgtgggactttgggaggaagcggcagctgctccgagcggggcccgcccttcccatctcctgccgctcctccctacgcttttgccttctcatctgggtctgtaggtccagcctctgaagtcctttgttttgcggggtcgagggcagccgccaggctgtggggggctttgtggatgggcggcaggagaggcgctcagaagccagaggttttggatgctccctcccctaccagagctgctgccccgactctttctagcttcaacctgtctcccttgggtctacaggtcggctgccgggaaaaaggggatttgaaggaatgggaatggggacccggccgctctggcaaagtgggggcgggtctgcgggggtggccgaaccccagcggttgccagagggcgtggtggctgcccagactccagttcggtgctcccaggctccctctggctttctttcccaaactcagccctgtagcttgggagacactgacagactgcatgccatatgtagaaaaaggctgacttttattttcctgcagagcatcttcctcgggagagcagggagccccaagtcatcgagttaagagcaggagaatccccttgactaggttggggtctgagcccagaggcagggcctaaggaggtgcagagactagggccgggagtggtgaggcaaggttggggcctggagggacagctatgaccgttgaacttgcagaccctggtccaccttcttggagtggaagccagcggtgcagaaggggacccctgaggcgcagaggcaagtaacagtgccaggggagtggtcagggcagatcctttccttctcaggaggctgttgagggggagagtgtcatgctctaaacagtgaagggacagatgacttccataccccactcttccttgctggtgagaagtggaccttggagttcagtggctgaaactcagaatttagggtatggagctggacccagagaataaagtctcaagtagtagaaggggcatctccttcagtccatggatttgggcctctggcatgaagcagccagggcctggatgttaaggatttagaattcagtgggagaggaagaacagggcttgtaaccagagtgagctcctcactctgcctccccatcctggggccgagagagcaggtggagttttctttgtagctgggcccggaggtagcggaggtcttgctgatcaagcccgtgagccaggcccaggtagagggtaaggaggaaagcaaggaggagacggtccgtgcccagggtaggcaccacccacagcactgtcagcagctccacacacactgggtggcgcaggtgggagaagagtctgagagcccggggagacttcagggccagaggctcgcccagccccagcacatggtagtatacctaagagagggagaagagcttagaaatggagtcaagcccttttctcatcttgggcacttctttcctcctcttccaggcaccacccttctagaactcaggcccaggaaccccccttctgagacttggatccctgatcctgacttctgatccatgtaccttccccaggcccaggaggcccatgcttgctgcccttacgagggaaagtcaaagggaagggccacgagggagaagcagggagacagtagaagagcatgggaggagggaaacccttgaaagggaacgaggagttctaaaatgggtcagaggtcataggtagggatctcggagcctcacctgtttgaggcccatgagctcagcatagtcaaagacgagaaggatgctaaagatgaggagccaggagatgacatggagcacaaagcagaggagcggcacccaggtggcccatggctcagcccgagcctcccacaacacagggcctttgggtatgggctcccagtaccgcatcaccagctgtggaaggataaggggctgggtatcccagtggcctagtctgcccgaccttgggagacccagacccagatctgcccccaccacaggctagcctgcaactctcccccacctctctcctaagcatcaccaccaaatattcaccatgtggagggtgcgtgctgggtgaggtcccaaagatgtaaggatggcctgtctctaccctgagaacttatagaatagatggggtgacctgatagctacgcaaagtagtagcctgtgccaaccacccagtgaaaagacagacaaggccttctcttcagacctagggaagtggttttgaagaaagggtaggactgaagagaagggatctcaagcaggacataaacaaagttgcagaggtgagaagcatatcttgtgcttagggaaggacaagtacacccttcttgataaaaagtaggatatgtgctgtggaggaatggaagctgagattagttcctcaattctcctcctgaacccatattttgcccctccaatccacggcacccctcccacacttggtctcccttggggactcaactgccaggatttcatacctgcaaggccagggcctcatacctgcaaggccagggcagtgcaggccacatacagtgacctctgaaggaccccaaagtaccgggatgtccatgccttcactctttcagctgccatgaggctgtgctgcccaacaaatagaagcaggagccccagatcccatgccaggggggcaaggatgctgcggtcctgcagggcagccagccatccctggcgggcatctacaggaagttgagggaaaaagagacaaaagatcgaaacagtggcagaatgtttcccccaccctcatctcctcttggatccccaggccatgtcccttactgctttcaagagccttaatgcttcctctctaggctgtgcccatctcacttttccatccctagtttctgccctcttccctaggcctcctgcaaacctggggaagaggatttatagaacaccacatgttaggcagttgcaaaaagcatggctggagaggccacgctggattgcccctcttacttcggttctccaaatgctccttctttttaacactctcctctcaacagtcctctctacaaaacactttacttagaatactccggtcaccgcccttttcggctccctcagtcctcactctcccgcctctccaaaactctaatccttgagttcctaatttagaactcaggtctccctcccctgtagcttctcggccgctttcaaggttcgagttccctctcttggacttcccctgtcatttgtttccaagccccgccctcaatccctctcctacggctccaccttcctcctcccagttcatcctcgatccctcccgctcacccggaccaccagactccgggatccctccaagaagtggccgaagggaggtaaagcgcacgaactccactccggtgccaaaggccaggatgaaagaggcgagggcagcagggatcaggagcagtgcaggggccatggcgagaaatggaggggtggggaaaggggcggggtcgggattcccgctgccacaggccccgcccgcggccccgcccccggctgaatccagcccaggagggcggggctcctgcacgccaccgccaggcttccggcccgcctggcgcagccttccccatccagctgtggatccgtcctgggatgcgtgtcccggcctgctgtctctccgtcacagaagggaatgttagaatcccgagagagagctgttaagggtagcggctctgcagccgctcacgtgggttgaatctcagctcgtctagttttcccatctaaaatgaaaagttactgttttaccacaaaataaattaatgtatggaatacattgtacagaatacaatatacagaataaattctgtaacttactataaagttgagttgttgactggccagttgctaagaatggcaaataacttctctgtaaatactgaaaggtttgttgtaatagtgccagagattgttgattagtaaccacgagaataaacatgttaaaatatttgtgatagtaacctttgtcagaattaaagatcatgcagctaaggaccttgtcacagtagacgtacacatagtagggaccttagatatcattagactaattccatcaacttatagatagaagaaacaggtccagagagataattgcctgagttaggaagctgctaatcctgtaggctaagggaccagataattgctgagcagcctctcgcaggctttacattccttctccgtctcctgggctcagtactcccaccctcctctgaatcaatgctgttgtatgctgtaccagacatcttatgttttcccttgaattcagtctccaccctgctttctgcttcagtaagttgtcccaaatggacggtatcaatgaaagtcacagtttttattgagaaagtcctctcgccgggcgcggtggctcacgcctgtaatcccagcagtttgggaggccgaggcgggtggatcacgaggtcaggagatcgagaccacggtgaaaccccgtctctactaaaaatacaaaaaaaattagccgggcgcggtggcgggcgcttgtagtcacagctgctcaggaggctgaggcagaagaatggcgtgaacccgggaggcagagcttgcagtgagccgagatcgcgccactgcactccagcctgggcgacagagcaagactccatctcaaaaaaaaaaaaaaaaaaaaagaaaagaaaaaaaaaaaaagaaagtcctctctacacgactgctctgtcctcatctttttgagcttggaggtgatcacaacagagctgtgggtactaaggcactgcactattctttctgatttccctacaccctgcctacttctttgtaattatcactttattaaactctcccccaaattatcctaatttcactgtgctattcatttcctgctaggaccatgaatagagacacttaccacacaaagcaatgtgctacaagctatggggttcattggaagtgtaagaggccagactcggtggctcacgcctgtaatcccagcaattcgggaggctgaggtgggtggatcactttagaccagaagctggagaccagaatggccaacgtggtgaaaccccatttctactaaaaaattttaaaaattagctgggtgtggtggtatgcgcctgtaatcccagctacttgggaggctgaggcaggagaatccactgggtgatggagcaagattctgtctcaaacaaaaaaataaataaataaaatacaaggaagtgtaagaaaagatccctaatctctagatgtttaacctgaggcatttaaatagtaccactcatgaagagggagtgtagctgagtgctacatggtgctctacagacagcaggtatggtaagaaatcaaggtctctggctgggcgcagtggctcacagctgtaatcccagcacttgggaggccgaggcagttggatcatctgaggtcaggagtttgagaccagcctggccaacatggtgaaacctcgtctccacttaaaagacaaaaattagccaggtgtggtggcaggagcctgtaatcccagcttctcgggaggctgaggcaggagaatcgcttgaacccgggaggtggaggttgcgataagctgagatctcgccactggactccagcctgggtgacagagtgagactccgtctcaaaaaaaaaaaaaaaggagctgggcgcggtggctcatgcctgttatcccagcactatgggaggcctaggtgggtggatcacgaggtcaggggttagagaccagcctgaccaacatggcgaaaccccgtctctactaaaaatacaaaaattagccgggtgtggtggcacacacctgtagtcccaactacttgggaggctgaggcaggagaattgcttgaacctgggaggcggaggttgcagtaagccgagatcgcgccactgcactccagcctgggcaacagaacaagactccatctcaacaacaacaacaaaaaaaaaaggagccgggtgcagtggctcacgcctgtaatcccagcactttgcgaggccaaggtgggtggatcacctgaggtcgggagttcgagaccagcctgaccaacatggagaaaccctgtctctaccaaaaatacaaaattagctgggcgtggtggtgcatgcctgtaatcccagctactcagaaagctgaggcaggagaatcacttgaacccgagaggcggaggctgcagtgagccgagatcacgccattgaacccagcctgggcaacaagagtgaaactctgtctcaaaaaaaaaaaaaaaaaaatggaaagaaagaaatcagggcctccgggacatggacaattttagagtatgaaagctttgagttgtgcaaggggactaatatttatctgggtcatactgtctgccacccccacaatggctgtgcttaatgtatattatgagattagatatgtttaatagccagcaaaatgcttggcaaatctcatgctatttctactacaccaaagttttccaaacttaagtattacttacatgcagaaaagtgtacataagtaatcaactattttttaaaaattgaaattcatgcaacataaaattaacctttttttttttttgagttgcggtccaggctggagtgcagtggtatgatcacagctcactgcaacctcgaacttctgggcaaatggtcctcttgcctcagcctcctgagtagttgggactacaggcatgcgccaccacattcagctaactttttattttttgtagtgatggggtctcactatgatacccaggttggtctcaaactccttggctcaagtgatcctgctgccttagcctcccagggtgccaccatgccttgcctaaccactttattgtatttatttatttatttatttttgagacagagtttcgctcttattgcccaggctggagtgcaatggcgcgatcttggctcactgcaacctccgcctcttgggttcatgtgattctcctgcctcagcctcccaagtagctgggattacaggcgcccaccaccacatctggccaatttttgtatttttaatagagatagggtttcaccatgttggccaggctagtctcaatcaaactcctgacctcaggtgatccacccaccttggcctcccacagtgctgggattacaggcgtgagccaccacacccggcctagcctaaccactttaaagagaataatataatggtatttagtacattagtatattagtaataggtacaaccaccacctctatctaatttcaaaacattttttttttgagatggagctttgctcttattgcccatgctggagtgcaatggctgatctccgctcactgcaacctctgccacccaggttcaagcaattctcctgctcagcctcccaagtagctgggattacaggcatgtgccaccacgcctggctaattttgtatttttagtagtgacagggtttcaccatgttggtccagctagtctcgaactcctgacctcaagtgatccacctgccccagcctcccaaagtgctgggattacaggcatgagccaccacgctgggccttcaaaacattttcatcacccccaaataaaactccatacccatgaagttactccccattttctcatctcccccaccccacagccactggcaaccacaaatctgctcttgttctctatgggtttacctattctggatattccttacatgtgtaatcacataatatgtgttctgtttctggctttccttcacttagcaaaatattttgatattcatcctcaaaatattgtagcatatatcagtatttcatccttttctatggttgaataatatttgattatatggatatatcacaattgtttatccactcatttgctgatgaatatttgtgttgtttccacctttttggctattgtaaaaagtgctgatatgaacactcacgtacaagaatttgtttgaataactgttttcttttccttttttttttttttttttggagacagagtcgtgctctgttacccaggctggaatgtagttgcacaatcatggctcattgcagccttgacctcctcccacctcagcattccaagtagctgggattacaggcatgtgccaccacacctggctaaattttttttttttttttgagagagagtctttctctgtcacccaggctggagtgcagtggcatgatctcagctcactgcaacctctgcttcccgggttcacgtgattctgcagcctcagcctccccagtagctgggattacagccacatgccaccatgcccagctaatttttttattattattattattattttttgagacagagtctccctctatagccaggctcgagtgcagtggcatgatcttggctcactgcaaactctgactctctggttcaagtgattcttctgcctcagcctcacgagtagctgggactacaggcgcacgccaccacgcccagctaatttttgtatttttagtagagagggggtttcaccatgttggacaggatggtcttgatctcctgacctcatgatccacccgcctcagcctcccaaagtgttgggattacaggcgtgagccaccaggcccagttaatttttttttttttttagacggagttttgctcttgttgcaacggcatgatcttggctcaccacaatctccacctcccaggttcaagtgattctcctgcctcagcctccggagtagctgggattaccggcatgcaccaccacgcccagctaattttgtattttttagtagagacgggtttctccatgttggtcaggctggtatcgaactcctgacctcaggtgatccaaccaccttcggcctcccaaaatgctgggattacaggcatgagccaccacacccggctaatttttgtattttttagtagagatggggttttgccatgttggccaggctcgtcttgaactcctgacctcaggtgatctacccaccttgcctcccaaagtgctaggattataggcgtgagccaccgcacctagcccatttttgtattttttgtagtgacagggttttgccatgttgcccagactggttgcccgtgaagtcctgggctcatgcaatcctcccactttggcctcccaaactgctgggattataggcataagccaccccacccagcctggacacctgatttaaattcttttgggtgtacacctaggagcagaattgctggactgttcggtaattccgtatttaactttcttttttttcctccaatttgagagcaggtactgcttaagtgcttagattagaaaaacaatcacagtagacaccttagctcattcttctaataagtctgttgatccggttctccctgttgccagcatgtccactttctacaaaatgggtggtctttttctttactctaccttgtggagaggataatttgaagggctacaggaagttatttgcttctttgaagcattttccaacagtatagatctcaagaatcagatcctccatgcaggtgatgccatatttaccaagagataaagcaatcaaagtgtcatctgtcaaagcaatttgcttcttattgatttttgccataaccatgctggtagattagttcatttactgacttcagctttgggtacccccatgccatatatggttctacaatcctcagcatgttcattgaagccttgttgagcttcacaaaggttccactgaagatttaacaaaggcgaagaagctgcaacacctttcggacctttgggttcacaccactgatacctctgatcctgatgacaaacggcaatttgggttttgcaggtacatagaagttgccagcttttctggccatcctagccattcgaatttcagttctgtacatctgcctatattccttgtgatagtgcttcactttttcatagataagcttcctccttgccttttgaatcatcttttgggcaaatttctttctcgggcctttgatcttcagctctgggaaattccttcgctttttaagggtttctggcatagcaagaacctccttctttttctctctctttttttttttaagacggggtcttgctctgtctcccatgctggagtgcaatggtgcgatctcgactcaatgcaacctccccctcctgcattcaagcaattctcctgcctcagcctcctgagtagctgggatcacaggggctggccaccatgcccggctaattttgttttgaatttttagtagagacggggttttgtcatgttggccagcctggtcttgaactcctgacctcaggtgacctgcccacctcggcctcccaaagtgttgggattacaggtgtgagccactgcaccccggccctctccttcttatctacaacactctacatgagggttccagccagaaaagaggctacttttttttttttgttttttttttgagagggagtctcgctctgtcgccaggctggagtacagtggagcagtcttggctcactgcaacctccacctcccgggttcaagcgattctcctgcctcagcctcccgagtagctaggactacaggcgcctgccaccacgcctagctaattttttgtatttttagtagagacggggtttctccatgttagccaggatggtctcaatctcctgatcttgtgatctgcccaccttggcctcccaaagtgctaggattacaggggtgagccaccacgcctggcctttttttttttagatggagtcttgttctgttgcccaggctggagtgcagtggcacgatctcagctcactgcaacctccacttcccgggttccagcaattcttctgcctcagcctcccaagtagctgggattgcaggcacatgccaccacgcccggctaatttttgtattttaagtagagacgggatttcaccatgttggccaggctggtctctaactcctgacctcaggtgatccacctgtcttgacttcccaaagtgctgggattacaggcatgagctgccgtgactggccttttatttttttgagacaaggtctcactctgttgcccaggctgaagtgcagtggctcgtgtccacccactgcagccttgacctcctgggctcaaacgattttcctcttagcctcccaagtagctgggaccataggtgtgtgccaccatgcccagtgaatttttgtatttttggtagagacgaggttttgtcatgttgcccggctggccgtgaacttctgagctcaagtgatctgccagccttggcctccaaagtgctgggattacatgtgtgagccactgtgcccatccatatgtttaactttttgaggaaccatcaaactgtttaccacagaggctgaaccatttaacattcctaccagcaatgtataaggattctaatttctccacatccttgtaatcaaccaacttttaaaatttaaatctggctgggcacggtggctcaagcctgtaatcccagcacttttggaggctgaggtgggtggctcacttgaggtcacgagttagagaccagcttgggcaacatgacaaaacctcgtctctaccaaaaatacaaaattcatcgggcatggttgcacacacctatggtcccagctacttgggaggctgagaggaaaatcgtttgagcccaggaggtcaaggctgcagtaagccgacatcgagccactgcacttcagcctgggcaacagagtgacaccttgactcaaaaagataaaaggccagtcatggcggctcatgcctgttatcccagcactttgggaagtcaagacaggtggatcacctgaggtcaggagttcgagaccagcatggccaacatggtgaaaccccgtctctactacaaatacaaaaattagccgggtgtggtggcatgtgcctgtaatcccagctactcgggaggctgaggtgggtggatcacttgaggtcagaagttagagaccagcctgggcaacatgacaaaacctcatctctaccaaaaatacaaaaatttagtagagccccgtctctactaaacaataaaaaaaagaaaattagccaggcatggtggtgtgtgcctgcagtcctagctactcaggaggctgaggtgggactattgcttgaactgggaggtggaggttgcagtgagccaagatggtgccactgcactccagcctaggtgacagagatgagaccctgtctcaagaaaaaaaaaaaaatcttaagaaatgtcatacaaattgtcctaaatagaagataatgatgaattaaatacaagtctatgacttttttttttttaagtttgtgtcttgagacctagacattttaaaaaactacactacaccataaggcacagagtgaatatttatttatcacagaggtcaagccgaagctctaattttataaatcctggaaaagctggccagaaaagtacagagacttgcccaaagtcaaagctaaagatgcttccagaggccaggagagaagaaaatgttttagtagcactccataactggaccctcaaatctactcactccaagcatcccttcaagttcctgaccccaaagtaagaatctcagtaagaaaaaaatagagatggtttccaaataggaggtaggacaccatgagtggcatcgagcaataactgcaacagtctggctaaagatagctgccacttatgacatctgagcatgaaactagctaattttaaaatggccatttaatacatgcatgtaagaaatcttgtatcccctaaatctatacaaataaaaaactataaatacaaataaaataaaatggccattaaaaaaacaaacaaacaaacaaaaaacaacctgtggcttccaaatcccttatcttttcatttattcataaagatttctggtcccacccatgttccaggacaagttgtatcaatataccccaatcctttctaacgccctgagttctttcttccacatatcttctaattcgtggtctgggagggaaaagggtagtggagttctcaggtggatgacatctccaaaggggagaggacaaaggcctctggcttggcttcctgcttcagcactccagtcagcaggaactcaggcgagaggaggggcagcccaacccgtagtggaatggagcaatgagggaagtcctgagggcatgtgatcacaactctctgaggctggggaagacagagcaaaggcaaaatcaggtgaaaaagaatcctagaaatgggttcaggacccactaaccagtcttaccatcactaaaataatacctcctaatatgaagccaagtgaagcacaccgcatactgtctatgaaatactcttgctaggccgggcgcagtggctcatgcctgtaattacacagcactttgggaggctgaggcgggtggatcacgaggtcaggagatcaagaccacggtgaaaccctgtctctactaaaaatacaaaaaaaaaaaaaaaaaaaaattagccgggcgcgctgacgggtgcctgtcgtcccagctactcgggaggctggggcaggagaatggcgtgaaaacccaggaggcggagcttgcagtgagccgagatcgcgccactgcactccagcctgggctacagagcaagactccatctcaaaagaaaaaaaaaaagaaaaaaaaaaaagaaatactcttgctagaggccaggcacagtggctcacgcctataatcccagcactttgggaggccgaggtgggtggatcacgaggtcaagagatcgagaccatcctggccaacatggtgaaaccccgtctttagtaaaaataaaaaaattagctgggcgtggtggtgtgcgcctgtagtcccagctactcgggaggttgaggcaggagaacagcttgaacccgggagatggaggttgcagtgagccaagactgctccactgtactccagcctggcgacagagtgagactctctcaaaaaaaaaaaatacttttgctagaaagatgaacctgaatttattcaagcttttacaattatctgcaatttccaggaaatatggagtacagaggaacaagataaattatatgacaaggaggcaaacccaaaattccagactgaggaacattctaaaggacaagtgacccagcttctgcaggaaatagatggcataaaaaaagctgggtgggttaagggatgctctagagtaaagataattaagaagataataggtgtggcagtatgtggaccttatttgaatcctgatttgaacaactgtatagagacatttttcagacaatgggagaaattttattaatggagtgtgagcaaatgaccaataaactactgttaattttgcttaggatcaataatggcattgtgattatgaaataaaatgtacgtatttcttagagatatatatttaagtatgtaggaagaaataatataatattggcagtttgctttaaaatatttcagcaaagaaagagaaaggaaaaaaagaaagaataaagaaaaataaaaagaaatgaaatacttcagcaaagaaaatcaaaggaaaaagccgggcgcggtggctcacgcctgtaatcccagcactttgagaggccgaggcgggcagatcatgacctcaggagatcaagaccatcctggctaacacagtgaaaccccatctctactaaaaatacaaaagaattagccgggcgtggtggcgggcacctgtagtcccagctactcgggaggctgaggcaggagaatggtgtgaacccaggaggcggagattgtagtgagccgagattgtgccactgcactccagcctgagagtgagactccatctcaaaaaaaaaaaaaaaaaaaaaaaaagaaaatcaaaggaaaaaagggatagatggagcaaatgtagcataatctaaattaagctgctgctgaatctcggtgattgttatatgggggtatcagcagatctgtcccctcattcctatccctttctataccataggtcttttcccccaccctctcactactttatattcctttctgaacctccatttttttccctccaatctttgccattccagccacctctttaactgccactgccacctcacccagacccagaacatcctaagcataccttataggaccgaggcatgctgggtaggtatgtgcctccacagcagctaataatctctcccatctgaggtggtggtggctggactccaggggtcacatagatctcatagccctaagagaaagaaatgatggagatggtattgtagattgggaagcactggagggagggctgaagcacaggttaaaagatagcctctcacctctagcagccttcgctcccgagccctgctcagtgcgtcttgaaggctaaagccaaagttcttctcttgctcagggtcggtcaccacatattcatccgggggtaagaagaaaccagccttgcgggactaaggacggcagcagtcagcatcaaagctcagcccagcccctcaatcagctctgctgcctagcatttagagagagctcacaaaatgtcttttaaatcaatgcaggcttctggctcaccaatgcccctgtcttcctgtaacgcctcttcccttccaccactttctagggcactatatgagcagtcttgccactatatcggtctgtcatcatcccttggcctctcacctgatgcagccagtccagggacagaatggggattccccgccccagggcacacaggaacttgactgtccggcggatgcgatcagtgaccaggtgggaagcctctgccgctgaaccagccagacttccccccagtgccagcacagcccgctctccccgagcatccaccactcctgtgaagagcacctgtggaagggttgacctgaggtggttacggcaacccatgccatcagcacccatctctacaatcctctaggtctccttgcatcctcccctcatctctgtctcccacaaagtcccatgcctttgtctcttactttgggggctgttgattcttggttaagtttggtccgtcggaggctgcggcttggtattctgttgggctcctcctctgcctggtctctctttctcttgcctggttttggagtcacgacatcctgagattgagaaaaatcttggtgggagtttcagagccctgaagtcatttttcccagctttgtggtcccaaccctctcctcacctcttccttccctggcttctctgcagtatcttcttcctcttccttgataatcactgtcttctgggagacttcccctctttggggctgtttttgatgtggtggtgaatccatggtagctaaagacctcttgcggctttgagaggccttaggctggagctccggggtgaacctagatctacctgctggttccaccttttggatctgggaggcatgaattggtgtctcaagaagctggggagaggcaggctcaggaatggctgtaagggattcagctgctctcactgctccccatctttggttccttgaggcctgggatttaggttccaagggtgcagagcaaggcttatggtcaatgggagctgcgagggagccagggttcccagcggctctctgcctcttgatgcaactgggttgagtaataggctcaggggaaataggctggtctgtggtgacaggagattggaattcaggggtggtaggaaccggcatagctcttactgtggaagacctcagtgttttgctctgaccaccctgagctatggcctcaggggtgacggactggtctgtgggggtaaaaggctcaagatcagaggctgctggttcaactggtttgggagtcttgacagaggacctatttgtctttctcctagtggccctagatgtgagcttgggggtgacaggctggtctgtggaggtggtaggatggggctcaggggctgtggggacaactggctcaggggtcttgacagaggacctatttgtcctgcacctagtggcccgagatgtgggctcaggggtgacaagctggtttctggaggtggaaggctgaagctcaggggctatagggacaattgattcaggggtcttgacagaggacctatttgtcctgcccctagtggcccgagatgtgggctcaggggtgacaggttggtctgtggaggtggaaggctggagctcaggggctgcgggcacaactgtttcaggggtcttgacagaggaccgattttttcttcccctagtggtccgagatgtgggctcagaggtgacaggctggtctgtggaggcggaagcctgtagctcaggggctgtggggacaactgtttcaggagtcttgacagaggatctatctgttcttcccctagtagcctgagacgtaggctcaggggtaacaggctggtctgtggaggtggaaggctggagctcaggggctgtggggacaactgtttcaggggtcttcacagaggacctatttgtcctgcccctggtggcctgagatgtgggctcaggagtgacaggttggtctgtggaagtggaaggctcgagcttaggggctgtggggacaagtgtttcaggggtcttgccagaggatctattttttcttcccctagtagcccgagatgtgggctcaggggtgacaggctgctctgtggaggtggaaggtgggagctcaggggctatagggacagttgattcagggttcttcacagaggacatatttgtcctgctcctagtggtccgagatgtgggcttaggggtgacaggttggtctgtggaggtggaaatctggagctcaggggctgtggggacaactgtttcaggggtcttgacagaggacatatttgtcctgctcctagtggtccgagatgtgggcttgggggtgacaggtcggtctgtggaggtggaaggccggagctcaggggctgtgggcacaactggttcaggggtcttgacagaggatctattttttcttcccctagtagcctgatatgtgggctcagaagtgacaggctggtctgtggaggtggaaggctggagctcaggggctgtggggacaactggttcaggggtcttgacagaggatctattttttcttcccctagtagcctgagaggtgggttcagaggtgacaggtcggtcggtggaggtggaaggctggagctcaagggctgtgggcacaactgtttcaggggtcttgacagaggatctactttttcttcccctagtaacctgagatgtgggctcagaggtgacaggctggtctgtggaggtggaaggctggagctcaggggctgtggggacaactggttcaggggtcttgacagaggacctatttgtcctgctcctagtggcctgagatgtgggcttgggagtgactggctgggctgtggaggtggaagggtggggctcaggggcagcagaggtagctggaaagggtgtcattctggaggacttccgagttctaattttaggctttgggtggaaaggctccagctctgaggacaagggagcctctggagcttcctgactcccatcttgcctggtcttacgaacggttggcttgatagaaggtaaaaggggagaaagaaggggcggaggtgcaagatgtttctggctctgagagttaaggggcttttggggtggggctggggcttcaggtactgtaggaggcagacaagcatctggagattcctgatcgccctagggagaaacagaagcaagtgagggggaggaggtggagaaaagagatagaacttggatactgttcttgatacttgtttatggttagataggcttaccagatttccaccgggcgtggtggctcacggctataatcccagcactttgggaggccgaggcgggcggatcacgaggtcaggagttcaagaccagcctggccaacatagtgaaaccccgtctctactaaaaatacaaaaaaaaaggccaggcatggtggctgatgcctgtaatcccagcactttgggaggccgaggcgggtggatcacaaggtcaggaaaccgagaccatcctggctaacacggtgaaaccccgtctctactaaaaaatacaaaaaattagccgggcgtggtggcgggcgcctgtagtcccagctacttggaaggctgaggcaggagaatggcgtgaactcgggaggcggagcttgcagtgagccgagatggtgccactgcactccagcctgggggacagagcaagactctgtctaaaaaaaaaaaaaaaaaaaaaaaaaattagctaggtgtgttggcaggcgcctagtagtcccagctacctgggaggctgagggaggagagtcgcttgaacccgggaggcagaggttgcagtgagccaagatcgcgccactgcactccagcctgggtgacagagtgagactgtctcaaaaaaaacaaaaaaatacacaaaaattagccgggtgacatgcgcctgtagtcccagctacttgggaggctgcggcaggaaaattgtttgaacccaagagacggaggttacagtaagctgagatcacgccactgcacactccagcctgggtgacagagacagactctgtctcaaaaaagaacaaaaacaaaaaatatgctcactggattttcctttctgtctatgatctctcctccattagactgggatctacctgggaagctacctttttcccacagacctgtctccataatgctactatagtgttctccacacgtggatgatggtaaggaaaaggatggctggggcaaagaaagaagaaacacgaagggtctttcttttgagtcaggtaggagatacaacttaggaaacagatatggaaaacaacgggtgccgaggataaaggaatagaagccaatcaaggcgtgacaaaaatggaagaaaactgaataatgagaaaggaatagattaaagtgaggctaggtgaaagagcattggagaagatatagagatgacttgtggaataggaggtagaaaaagtagctctcaccctggaaaccttctcagcagctctgatcctggaagccttctcagcaggtggcatcttgcaattcaggaggcctagacagaaagtaaacacaaaggtggctgagttccaagcagctggttgcccaggggttgattatcacgaggcctgtgtatcaccttgggttcccctctgccttcacttacctttctgatgcctcctggggctcactggggatccccttccacctgactggctcccagaaggtacgggggctgaggtaggtcccggaaggtcccccgcccccaccccaggctctggtgttgggctggaggcctgccctttctggtcctggctccctccctctggctcccctctctgtgtatctctctccaggatcactttgggcaccttctcttctaactcggctggatcgcactctctgtttgctactggtctctctacttctctctcaaatgctttgcttggaagggtctgcttctgtacttgtttctcttgtatttcctcagatgtctcaatttctaccttcaaactctccctatctctttcaggacttgcactttccccatttttgtcagattcttgtctctgggtgtctctagctaacaactgtttttgttctctgtcctgtttccccttggttaattcttcctctcctgtcacatctgtctgtctttctggtagcagtttctcagtttctctctccaatggccctctctcagggcccaccctctctgctgtttcttttggtatacccatgactttatccacagtctgcctccctctgccttgaatccccattggctctgtgtgaactgggctctctggatgttggtctcctggtattgccctaggtggagacaggcaaggtccataggcctcaaggtgcgtgtcaaaaggctgggtctcagagtcctcagactctctcagacagaatggctgtgtagccaggacctcccatggttcatctagggtacctggaaggggaggaaggaagagagagagagggagagggagagaaaagagggagaggaagagggaaagggaagtacaggttgacataataaatatgatgagaaaggatttagataaactcatgaataataaatctgaacaggttattaaaggtaagctgggaataagggtggtagttataacatttaacgtttgtctcaaaaaggtcatagccttaggcgggcatggtggctcagacatgtaatcccaggactttgggaggccaagacatgaggattgcttgaggccaggagtttgagactagcctggacaacatggcaaaaccccatctctacaaaaaatacaaaaaaattaggtgtggggacggggacctgtagtcctgtagtctcagctacccgggaggctgaggtaggagaactacttgaaccccaaaggtcaagactgtagtgagctgtgatcataccactgcacttcagcctgagtgacagagactctgtctcaaaaaaaaaaaaaaaaaaaaacccaagagaaaaagaaaaacatcatagcctaatatgagttccctgaatagtctctcatcataccactgcattccagcctgagtgacagagaccctgtctcaaaaaaagaaagaaagaaagaaagaaagaaaaacatcatagcctaataagagagttccctgaatagtctctctctctcaagacagtttcactctgtcacccaggctggagtgcagtggcatgatgttggctcactgcaactcccaactgctgggctcaggagatcctcccacctcagcctcccaagtagctgggactacggcatgtgccaaagtgcccggctaattttttgtatttgttgtagagatggggtttggtcttgaactcttagactcaagtgatccacccacattggtctcccaaagtgctgggattacaggtgtgagccaccatgcttggctggaatttccttctttttaaaggctgaatagtattccactgtgtatatataccacattttcttttttcttcattgacacataataattgtacatatttatggggtacctgtgctattttgactcatgcatacaatgtacaatgataaaaccaagataattgggatatccactatctcaaacatttatcatttctttgtcttggaaacatatcaaatctcttctagctattttgaaatacacaataaattattaactatagtaacactactgtggaactgaacactagaacttattcattcaatctgactggatttttgtattcattaaccaacctctttatgcattctgtccctctacccttcctagcctttggtaaccaccattctactctctacttccatgagatccatgtttttagctcccacatgagtgagcatacaatatttgcctttctgtgctgacttatttcacttaacataatgtcctcagggttcatccatgttgctgcagatgacaggatttcattctcttctgttgctgaatactgttccactgtgtatatatacacattttcttttttttttagattgagtcttgctctgtcacccagtttggagtgcagtggcatgacctcagctcactgcaacctctgcgtcttaggcagcaatcctcccatcttagcctcccgagtagctaagactacaggtgcatgccaccatgcccagctaaattttgtattttgagccactgcacccagcctatatacacattttctttttttttattattagagatgaagtctcactctgttgcccatgttggagtgcagtggtgtgaccttggctcactgcaacctctgcctccggggttcaaatgagtctcctgcttcagtctcccgagtagctgggactacaggcacctgccaccatgcccagctaatttttgtatttttagtagagacagggtttcaccatgttggccaggctggtctcaaactcctgacctcatgtgatccacccacttcggcttcccaaagtgctgggattacaggcatgaggcactgtgcccggcctacattttcttttctttcgtttttttgagacagagtttcactcttgttgcccaggccagagtgcgatggcacaatctcagctcactgcaacctctgcctcctgggttcaagggattctcctgactcagtctcctgagtagctgggattacaggcatgcaccaccacacccggctaattttgtatttttagtagagacggggtttctccatgttggtcaggctggtctcaagctcccgatctcaggtgatctgcctgccttggcctcccaaagtgttgggattagaggtgtgagccactgtgcccgaccccggcctacattttctttatccattcatctgttgatggacatttagtttgatttcatatctgcctattgtgaacagtgctgcaatagtgtgtgtgtgttttttttaagagacattgggggtgggggttgagggatgggctattgcccagactgggctcaactgatcttcccatcctggcctcccatgtaactgggactacaggtgctcactactatgctgggctaattttttcatttttgtggagaccaggtctctctctgttgcccaggccagtccctaaatattttcaacctgcagctggttgaattcacggacgcaaactcgcatacacagagggctcactgtaatcagagtatgaaagaaacatgtaggaaggcaaatcaagaaagaacgcaggccgggcgcagtggcttacgcctgcaattccagcattttgggaggccgaggcaggcggatcacttgaggtcgggagtttgtgaccagcctggccaacatggtgaaaccctgtctctactaaacatacaaaaaattagccaggcatggtcatggacagctgtaatcccagctacctgggaagctgaaggaagagaaaccgcctgggaggcggaggttacagtgagccgagactgcaccactgtaatccagcctgagtgacagaggaaaaaaaagagaatgcagaattggggacacagaggagggaagagtttcttatacctgttgtctggaagctgcaatgggaagggccaagctcttggggtggagtcaacatgaaggcctgggtaggttcatcctccatgctctggactgctgtacaggaaaagatggcctaagttcatctcctccatactactgtagggttccattcctggtctcctaccctacccatactagcctttacccttcaaggaccaccagtctaatctcccagctcccactggtacaggattcaaataacacagaagtcctcaccttccaggccctgattctccagaaagcactgggtagcttgtaggtccagatcttcagaatctggtcggggaggaatataagacagtttaaaacaaaaatcatacctgacactaaactccttaaataatctctacctttctctccccaaccccagctgttagaaccctggttgatttcagaggtctaggaaggaaggccagcacttaccaccatagttgtcttcagagtccttggtcccacccacatgttgttctctctcccttcctgtggggacctgggctccctctctctgtggctgggtggattcccctagagtgtctgtgtccaccaccagatctgtgaggttctctcttgagatagggaggtcctgctccacttgtgccacaggtggcccaccctgggcccccacctcatgagctctctcctgcttaagaacagctgcagcccactctgccccagcatccccttctgctggaagctggctctttcttacatctgcaactactgaggctgttagggaggtgccctcctctgcatctgtttcacagtccccatgcagaggccaggcttcctctagagataccacaagcagctttgctggtcccccaactgctttcacatctgtttgatttgtcccctccacagacacctgatgcttctttatatgtataatggctgaccctggcgggacttccttctccacttgtgtgttgatgtccactgtggtggaggcttggcttctctccaggtggatcccaggtgagctcttatctgcttccacactgtcatcactgtccccaaaaggaggttggtccttttctgaatgtgctctaacaagggctctaatctttgtgtgatccttgaggacagcttctctattttccactgggagctcttcctcctccacgtctgtgtcactgtctctctcagtggtggtttggcttcgctgcagaaggaccacacgttggggcatgtcctcttctgcatctctgttccatatagcaggctggctctctttcagatgtgccaaagtcagcgctgctgagacttcttcctcgtcatctgtatcgctgttgataaccatggaagcttggcttttctccagagggacagcctgtggggccttgccttcttccacatctgtatcactaccagcctggctctcctgcagatgggccaggcctggtgctccaggaccccttgtacctactccatggaagatcttcctcttcttcataggaatgacaactggggttgctgggatcctctcttcttccgcatcagtgtcgctgtcgatgaagccaaaaggctgagccctttccaaatggacctcagctggccttccaggaggcctgctgtcatcatccacatctgtgtcactgtcctctccaggaggttggctcctctccagaatcaccccagctggaaccaccccattccctgcacccctcttgacttttgtatcattgtccctctccttcactaaaggctgatccttttcaagctggatttcagttacaacttcagcttcagactgctttgcctctacagtggcacctcttctggcagctgaggaggcctcctctgtggctggttgctgaccttcttccacatctgtgtcactgttcaaattgaaggcaaaaggcggcccaaggccgcccaggaccggggaatgcccctcttcatcactgtgaagggaagaaaagagagtctatagaatttatttccctggaagggataccccaactcaactgtgagctccttgaggggagacacaaggtagcatatttcttcttctgtttccaatttgttttccacttggcacatcagatgtgctccataaaaattcagctgagtgaatgaatatgtatggttccccagccccaactctcatgataatcatctcttttagagattgatcctccagcccctggttcttcctcattttgaagactcaggtgtctgactctttggcactcacctctctggaactatcacagaggaagatgtggtccttgatttttttaccatacgcctttcagaaagaaaatctgtcaagaacagaaaggaatgagttgacaattgtacactcattattcctgtctcctcattctccctgccaatatacaaacttacctacttcctcctccgagtcctcagccaacagaagcctctggggttgagtttctccctgtactctgggtgtctcttctactgtcagagggccccgggagacaaagggcagagagacatccaggcgatggtactggcagagcaagtcagcaaagagaatcaattcctggtccctcagacggtgactcaccccagggctcaaaaccttaggaggtctcaggatttgagtaccattaaggctcccacagtctcggaggataggtgccttgtcccaggctaagatttcaatctctgcatgttgtttggagatagatggaaagggcagggccacagagcagtcaggcattcggcctaccacattcttcccgaggtgtagtgggaaatctaagaattagagaggtagataagctccaagatcagagtcctggcctgtcattaggaaaaagtgcctattaggtactctactactcactcaaggcctccatatgcattagaaaaataaaaggccctaggacatctaggcactgaaagagtatatgcgataccccatccatccacaatggatgtttttttactgttataaaatacacataacacaaaatgtatcaccttaataattttaagtgtatagttcagtggcattaagtgcattcacactgttgtgcaatcatcactaccatccatctccagagcacacaattggattttatttgattttttttttttttttgagacagggtctcattctgtcacccaggctagaatgcagtgtcatgatcatagatcagtgcaatcttgaactcttgggttcaagtgatcatctggctcagcctcccaagtaggtgggactgcagatgtgaaatgaaccaccacacctggctaatttttaaatttttcgtagagacagggttttgctatgctacccaggctggtctctaactcctagtctcaagtgatccttctgccttggcctctcaaagcacgggaattacaggtgtgagtcactgcacccagcttcatttcaatctcttaattttcttttatcaaagtaaaatcacttccagtgagtccagggtagtagtctgcaactatcaactcaatcggccccatctcttccattcatgaaaaaaaaaaattcacatctcattgaaacatacataagcttcttgcaaccctccaaataccttaccacaaaaataaaagatctatatcaatacttgaacatccaataccctctgacctttttctggtccatgggcaccactaaagatatgtagccgccctactggctccacgttacacctcaaggattcactggattgctctgtctcctcctcttcttcaacatcccagtcaatagcctgggtgtcctccatgatctgggaaggatacacattatcaattatcctcattattggttcacacaaacagcatcagagttatcagactgaaaactagggggtaaactggatcattatgaacgttgatgcttctctttccaccaatctttctgttgttaaccttctgaagcacttaaaacatttttttcttttttgtgatggagtctcgttctgctccccaggctggcatgcagtggtaagatcttgggcccacggcaacctctgcctcccgggtttcaagcaattctctcacctcagcctcccaagtagctgagattacaggcacctgccaccatgcctggctaatttttgtatttttagaagagatggggttttgccatattggccagggtggactcgaactcttgaccttgggtgatccgcccaccttggcctcccaaagtgctgggattacaggcgtgagccactgcgccccgttgtttttctttcttttttagcccatgctttttatacttttaccagaccacctcagtttgatcagatgcaactgcaaaaaatgataataaaagatgacatatatagaagcttcctatgtgtcaagcactgttctaattactttatatcgactctgactcatttaatcttcacaagaaccttgtaaagtagtattactatcttccatttcttcagataaagaaactgcaacatagctgggttaagattttcagatctccttgaaacatacataagcatatataaggttaagacttgccccaaatcactcagatgtctctcctctaaaatcttgatggtttttcgtgcacacagaataaaatctaaactccttagcgagaccctccatgatctgaacttcacatcttgtaacgcctacccctcgcccgcaaaagcctatggttcagccagacattttccccagtcttcgaacacactgttcttgtcttcccacatcttcatgccttagcccaattccttggctttttcccacctagttttctggtccaacttctaccatcctttaagattcagttcaaatgtcactttctttcttttttttttttttgagatggaatctcgctctgtcgtccaggctggactgcagtggtgctatcttggctcactgcaacctctgcctccaggcttcaagcgattctcctgcctcagcctcccgagcagctgggattacaggcgcccggcatcacgcctggctaatttttgtatttttagtagagacggggtttcaccacggtctcgagctcctgacctcaggtgatccgcccaccttggccacccaaagtgttgggattacagcagtgagcaaccgcgcccggcctcaaatgtcactttctcagcaaaccctttcctggcgtgttccctgccttctcgtgttcctggtgtatcctgcctgttccacagtggtcaatggatttgtgcttactctaagatctctcgctatattgtaaccattactttccatttctgccttcacactcacccacctccaggactggattaggggaaccgtgtctttcccctagggtccatcatattcattcaatggttatggtatacctgtttgaagtatttggtatacatctgtgaaccaaacatgaaatcgaccctgccctcgggaaggctcatcaccgagcctactgatgaaggaacaaatgagatggaaagaaaatagcataaatggaattcacctgaaaatatgccactctagagggaaactgttgacaggtagggaaagtaggatgccccatggataaagtgtcaactccgtctttatgacaggccaactcagcgggtgcccaccacgcttggctccaattcaaagagccaccatctttggtccccacctcagtgggttcccttgtggcccgacgtctccctgtgtcttcatacctaaactcggagcggggcgccaggtaaggatgagtattacagtccgagaagcgaacttccaagtcacctccgcccagtcgcacccaaggtacgcccctcccgccttctgggggaaccaagatggctcccggggagccgtgggccaggcccctagaactcacctactttaagtccccgcgcgcgccaccagtaacggtcgcgacccaggtggagcgactgcgtgtgccgaaaaagagcttatttgctgattggcttctgccgctgtctttcacaaccgcagccagtcgagcggaggcacacccaaagccccgcccccttagagttcaaataggtggtgtctcccaggctgctgagatcagttaatgagacggtaattgaaggccgccgtgcgccaacagaataatgcacgtcgattgggcagctccaagggacaacccactaccgcttgcccgcccaccacccacttcccgcgcagttccaaaccgcgaccagagagtctggcgccagctgccggcaacggatagaggggctgtgtcatagacgtccgacgtgtctggtaaggccagagcgcctttcctcggtcctcctagacatggtgtccgctgactcatgagaaatgaaagtgggttgcgcgttgcagtcgtggctggaggctgcagtttggagaacagcccgtaggcgtggcagttcactcctgttgcattggaatttcatttccttttgatttggtttgtagtagaagtaatatctttcttcctgggaatacgtctctgacggacattttgaggtcattttcttaaatccaagatcctaaagatctgtagtcgaacagagaaaactggtttgctctctgtcttaaaggctgtccccacctttcgaggggcgagggaaggatcataaaatcatttatttttattttttaattaactaatttatctattttttgagatggagttttgctcttgttgcccaggctggagtgcaatggcgcgatctcgactcaccgcaacctctgcctcccaggttcaagcgattctcctgcctcaacctcccaagtagctgggattacaggcatgcgccaccacgcccagcttatttttgtatttttagtagagacgtggtttctccatgttggtcaggctggtctcgaacttctgacctcaggtgatccgcccgcctcggcctctcaaagtggtgggattacaggcgtaaaccaccgcatgcggccatctatattttattttttgagacggactttcgctcttgttgcctaggctggagtgcaatggcgcgatctcgactcaccgcaacctccgccttctgggttcaagcaattctcctgtctcagcctcccgagtagctgggattacaggcatgcgctaccacgcccggctaattttgtatttttagtagagacggggtttctccatgttggtcagtctggtctcaaactccggacctcaggtgattctcccgcctgggcctcccaatgtgctgggattacaggcgtaagccactgcgcccggcctattttatctcacaataagacatgaagaaaatggtaactataacacttgcataattcataaagtcctttctgttggttatctcaattctgtgcacaacagtcaaataagcagattttacaaacgaggagctggagccctgcaaagttaaaggactttcctaggatcctacagctaatatagagacaaattgaaacaagttatctgattgtgtattttgagttatttctactcccacaaaatgactgtgttcatttccctaaaacgtaaagcattatattttaagtgggtagagagggcttacacaagttgatgttccctcatttagaaggcaacttagaaatacattgatctgcccagcgcggtggctcacgcctgtaatcccagcactttgggaggcaaaggcgggcgaatcacgaggtgaggagatcgagaccatcctggctaacacagtgaaaccctgtctctactaaaaatacaaaaaaaaaaaaaagaaatacattgatctgtgtgatcgaatgtgaattaacaatgacgttgacttgatactacatttctgagtggttaccacattttattgattgtatgcttctcaccagactgcaacatcctggaggacagggagctaattcttaatcattttgtaaccatagctcctaatttggtggatacatagtaactatcaaataagtgaataataaatctatgggaagaagcagatggactccgtcttgaacccactcaatttttcccccatcaattacccctctctcgtttttcaatactgggtctcttgcagagttgcagtggcggccacctggtcagtgaaatcagcgaattgaaaaaccactgacttcattaacatgtctaaagaggcaggctgaaaaaactgaaaatctatcaggcatctcattccatagttccctgtttgacaagaagaccaaggtgtcttcaaagtctgccctaaggtccagatctcctacccacgtaggagacttctagtttcacaaatccccgatgtcggtttctctaaactattttattctttgaacatactctccagacaacatcgctatcctgaaaagcccttgctgcaattttgtttctctttcaaaacaatggctcgaaaatttccaaggaaatagcaagagggcgattcccttcttgaagtatttgagggagcagaagcttactgaagttcatgccttgggtcaccaaaggccaggggaggcagagcacggtgccagacttctccccatttttcgctgaactaagcaatcctttctcccctagaggtactgcagctgggagctttcagggcgtgtcttccccaccacccaacttctggaaccccagacttctcaattcctgtacccccaagaactgctcactttttgtacaaaaacctcaggcatagaggaaaggaatcttgcgcaaggtcgtttttcatttacaaaacaaaaaccccatgaaaaccaaaccggtacccacccattcgtcacttcattttgcagcatggacaacaataggggactacaactcccaaagaggactgcgctcgtccactggctcagaggccaatggacgcctggtacatgaccggcatcgactaatcagggccaggctcgatgaggctttgtctccctaccgcgcgcggggccgattctcccgcctcccagccccggcgcacgcgcgccccgcccagcctgctttccctccgcgccctcccctctcctttctccctctcagaaccttcctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaaggtaagaattttacacctcttttatttctttttacaaggaaaaatccaggtaagttatgaaaaaatggttgtggggcatttgcacccgctatccttaatcaagatttgcccctctcaagtttgttacatttatatatataacaattgtagctagcatttgcctttggaaagctgggaatcatttttcttggcaggcacattttggagaaactagtaaaagggctcttcgggtttgggggcgggaagaccgaggacttataagatgttacttaaaagggcttctaacggtccgagaaccgggcagggagagagatgcggaaacggtcgcagacaaagcggggcgaggttttgcccatgtgcatcccgcccaacccccctgcggggtacttagggccaaaccggagcgggaaggggtgaggccatcgggcggctgcagagagctccagcgcaagggtggggggcgatgcgccagggtgggctgcgctgggcgctacctttcacaaaagaccagggaccccaacgcgcccgcgaccccagagggccggtcctgtatttgttcctgggtggaaggagaataagaacgggattaattttacttgctttcatggcccctaagagagacttttttagggcgtgaacagatatgtcgagaaaatgggggtgtgtggttttctttaatgagtccctcaggacttaatgggagagaaagaatcctttaaatcaaggggtagaaatgtagcgaaggaataaaaattccgaggccaagggggattttttttttttgcgcgcggttacagtgtagcgggggaggggcgggaggaagtgcggctgctacgttgtagcagaagggcggggccctgcggggcggggccggggcgccgtgggcgcgcggggacaatgcggcgttgcccgccggcaggggcgcgctaccttgggccccgcccctcgcgcgcggaatttttgtccctggccccgcccacgcgcgaagtcttttgtcggcggctcgacctgcgcgtgcgccgcagtcacgtggagggcggggggggtggtcgactgcggcggcagctctttcctcagacccccagccttttgtgcgccgcgcggtggggcggtgcccagcttgggggaaggagagcggcgcttatcgaagtgtggtcgacctccatccgcccaccgagcacttgggacccgctgcacatatccagagcagggaaagctgtggctttctcgggggagcgagtgtctaggggaagggtgtggcaggcccacgggatgccatgccctagaacaacggcctgagcgcttgtggaattaaaatgggagatgtggggccgaggtgggcgaattgggatccctccaggtcaggggttcgagaccatcctgggcaacaaagcgagaccctcccccatgccacgtttctacaaaaaataaaagtaaaaaattagctgggcgtggtggcgcgcgtctgtggtcccagctactcgagaggctgagatgggaggatcggttgagcctgggagttccacgctgtagtcatccgtgattgcaccactgcactgcaggctgggcaacaggaagaccctgtcttaaaaattagaagaagctgggcgcggtggctcacccttgtaatcccagcactttgggaggccaaggtgggcggatcacgaggtcaagagatctagaccatcctggccaacatggtgaaacccgtctctactaaaaatacaaaaagtagctgggcgtgttggtgcgcgcctatagtcccagctactccgggggctgaggcaggagaatcgcttgaacccgggaagcagaggttgcagtgagccgagatagcgccactgcactccagcctggtgacagagcgagactccgtctcaaaaaaaattaagaaaaagatgaaataaaatggtagttggggacatagttggctgggacttgacctgttgtggtctcgttgctccccctcggcagttctgggaggtgatcagtgatgaacatggcatcgaccccaccggcacctaccacggggacagcgacctgcagctggaccgcatctctgtgtactacaatgaagccacaggtaagggcaggagcccgggcagctcaggttcccttccctgtctcccacttatctgggatctctttccatttctgggcacgccttatcccctttgggtgaatctgtcattttgtccctttcgtgaaccaccgtcggggccaaagacgtctgctgccacctggtggcgggacctggaatgacaagtctctgatccctgctgtctcccatttccagtatatctataaaccttcccttctgccagatttcacagctcttaactttattctctgtaggtggcaaatatgttcctcgtgccatcctggtggatctagaacctgggaccatggactctgttcgctcaggtccttttggccagatctttagaccagacaactttgtatttggtgagttatacagatgatattagcagatgatataccatcgtgttcaacttatttgggtgcaaggacacagcaaaagttaggagatgattgttgtattggagtgctaatacagaaatgtgttctgaaatctaacggagggtagaggtagtgcctactattgctggtaaattatggggcagtagggggagaatatatcacagtgaaggagaaagaagatacatccgagggaattatttgaaaagttgaaagatggaaacatcatgtatcttccataccctgttaattgagcttttctcctgactgcattccaggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctggggggggtctagaacagtgcctggcacatagtaggcgctcaataaatacttgtttgttgaatgtctcctctctctttccactctgggaaacctaggtttctgccattctgggtgaccctgtatttctttctggtgcccattccatttgtccagttaatacttcctcttaaaaatctccaagaagctgggtctccagatcccatttagaaccaaccaggtgctgaaaacacatgtagataatggccatcatcctaagcccaaagtagaaaatggtagaaggtagtgggtagaagtcactatataaggaaggggatgggattttccattctaaaagttttggagagggaaatccaggctattaaagtcactaaatttctaagtatgtccatttcccatctcagcttcaagggaggtgtcagcagtattatctccactttcaatctccctccaagctctactctggaggagtctgtcccactctgtcaagtggaatccttccctttccaactctacctccctcactcagctcctttcccctgatcagagaaagggatcaagggggttgggaggggggaaagagaccagccttggtccctaagcctccagaaacgtcttcttaatccccaccttttcttactcccaaaaaagaatgaacacccctgactctggagtggtgtatactgccacatcagtgtttgagtcagtccccagaggagaggggaaccctcctccatcttttttgcaacatctcatttcttccttttgctgttgcttcccccctcacacacttggttttgttctatcctacatttgagatttctattttatgttgaacttgctgctttttttcatattgaaaagatgacatcgccccaagagccaaaaataaatgggaattgaaaaaagctgcgagatgtgtgcttatttagggaaacacggctggctgatggaggcatggggcctgagttcagttgcactgctctccttaaattgacacttaatattgagtccctgtcctacggattcaaccaactggatattgggaaaagagttgtactggacatgtatagacttctcattattccctaaacaataatagtataaattatttacataatatttgcattagattaggtattacaagtaacgtagagatgatttgaagtacacaggttatatgcaagtactacattttatatgagggacttgggtgtctgccgatttggtatctcagggaggtactggtaaggacactgactgctttatagaccctcacatcattgtttctggtacccaaactgctctgagcaccagtcagtctttactgtagtctctgacagctcactacagccttgatgtcctgggctcaaacaatccatctcattctcccaagcagctgggactgtaggcataagccaggtgagccagtgcaccaggcccaccaatgagtcttaactggggaaggcataggcttagatgcaggatccagggatggaaaatggaagctgagaagaatgacaaatcacgtgtaactggtttccagaccagcatccacatcctctgggaacttgcagaaataaatgcaagtttttcatcccacccagatgtactgaaccataaatggttgaactggccttggccacccagcccaggattcctttgggttatgtgtacccatggccatttcctgtgatcctgtgggcttagtcaacctatgacaccaagataactagtgaagccctggtatggtggctcccacttgtaatcccagcactctggggggccgaggcaggaggatggcttgagcccaggagttccacaccagcctgggcagcagtgaaccatctaacaaaaaaaaaagctgggcatggtggtgcatgcctgtagtcccagctgctggggtagaggggggtggtggttgttgggggtaggggggtggggattggatgggaggattgcctgagcctgggaggtagaggctgcaatgagccctgaccctacccctgcaccccagcctgggtgacagagcaagaccttgtctttttttttcttttttcttgagatggagtcttgctatgttgcccaggttggagcacattggcgcgatcttggctcgctacaacctctgcctcccgggttcaaggaattctgcctcagcttcccaagtagctgggattacaggcacccaccatcacgccgggctaatttttgtattttagtagagatggggtttcaccacgttggccaggactggtctcaaactcctgacctcaagtgatccacccgtctcagcctcccaaaaagttctgggactacaagcatgagccaccgtgcccggcccaagcccaagaccttgtctttaaaaaaaaaaaaggataactaggcgggattgctaccttatggtcccattctaaaacaatctgtaccatctactacctcatacttttaagttcacaatgcaagtctcaaagctaccctgaaaacaataattccttttgccatgttttcaggaattctaggaactagtattattcccaacattccttctattttagcatgcttttctgactataatacactgttggggggaaaaattaactctaaaactcttgacagtatataagtaacttgcttttctcccattctagaaagcctattgtatgcaagaaagcctattgtatgcaagggaagaagctacattctagcattcattttctttctaatagagccaggatcttgctttgtcacccaggctggaatgcagtggtgtgatcatggctcactacagccttagactcctgagctcaagtgatcctcccaccttagcctcccaagtagctaggactataggcaagagtcaccatacctgagtctagcattcattttttttctctttttttttgaaacagtctcactctgtcacctaggctagagtgcagtggtgcgatcttggctcactgcaacctctgcttcccaggttcaagtaattctcctgcctcagcctcccaagtagctgggactactacttggcatgtttcaccctgcctggctaatttttgtatttttggtagagacaaggtttcgtcatgttggccaggctggtcttgaactcctgacctcagatgatctgcctgccttggcctcccaaagtgctgggattacaggcatgagccactgtgccgggccaagcattaatttccagttgcttctgttttattagtacttacttacagcaatttatttgggtagcaaagttgaaaacctccagcccatccctcagtcttggtcaggaaaatattctagacaacaggctcaaacagtctgatttaattaggaagttaaataagttgaggtggggtggagtgggatcatcagaaggctgacatgggaccgctggagttggcaatcatagcagtgtgaggttggcaaggggagcaacccccttcaagacaaggcacaaactatttggcaaggagagatgaggggtgggacctcactgtcaatggacatgctcagggaggccagtgggttacatgcaacaggaggatcattcaggcaacttcagctatgaggctgggcatctgtgagggctgaaggctcaggctgttctcaaaggcttgtgattcacctggcaaaaagacaacagtagatgacacttgggaacattcgggaggctgaggcccctactctcccgggccccagtttagacgaatgggctataggcagaacacacacggccagggttctttctggtgccctaccacctgtttccccaaacaaagacatcaggacccacatacaataaatcactgaagagaggagagggggcagagccttgtttgcacactctccttagctctgaatattctactgcaggcctccaggaggctccaaggaacccagcttgaaggtcattggtatgatccagtgcttttatttacatacgctttttttttttctttttttttttgagacggaatctcactctatcacccaggctagaatgcagtggtgcgatcttggcttactgcagcctccgcctcctgagttcaagtgattctcctgcctcagcctcccgagtagctgggattacaggtatgcgccaccatacccagctaatttttgtatttttggtagagatggggtatcaccatgttggccagggtgatctcaaacttctgacctcagctgatcgtccaccctggcctcccaaagttctgggattacaagtgtgagccacagcacccagcccgaatatgcatttctttctctttttttttttgagacagagtcttgctctgttgcctaggatggagtgcagtggtgctatctcggctcactgcaagctctgcctcccaggttcacaccattctcctgcctcagcctccccagcagctgggactacaggcacacaccgccacgcccggctgttttgtatttttagtagagacggggtttcactgtgttagccaggatggtctcaatctcctgacctcgtgatccgcccgcctcagcctcccaaagtgctgggattacaggcatgagctaccgcgcctggaatttttttttttttttgagatagagtcttattctgtcacccaggctggagtgcagtggtgtgatctcagctcactgcaaccttcggctcctgggttccagcaattctcctgcctcagcttcccgagtagctgagattacaggcatgcaccaccaagcctggctaatttttttttgtatttttagtaaagatggtgtttcaccatgttggccaggctggtctccaactcctaacctcaggtgatctgcctgcctcagcctcccaaagtgctgggattacaggcgtaagccactgcacctggccccatttctttaacatacacataatgcttactatataccaggcactattctaaacactgcaaatatttgctcgagcccctcaacaattcaacagggtagtttctaattattaacccaattttaagatgaggaaacaggtatagagaggttgattacttgtccaagattacagctagcaggcattgtagctaggattcgcaacaaaacagtggttccagagcctgtttgctgacttctaccatgatctacaggtgaattaactggggcgctgagaaaagcagtgatatgccctagaattaattaactgtcaataggctgcaactagttccctatactagtggggtgaccacaagcacaggttgcagagacagtcgacctggatttcactccagctgcactagcagaatgagtaggaacatgctggatgttgagtttctggactttgtaaaatcctatataccctaatggtagtttgatttaaaacaactcatttatgtagaagcttagcactgtgtctggcacacagaaagtgattaataaacatcaatgactcccaggcctggatgctggttaaatgctaggcatactgtgtcacacaacacaggaacctagcaattctcctcagctccaacctgagacctcacctgggagatgctcacgcctgtgagtctttccacactctctggcaggcgagttagaatgtccagtacttccccagtcactttggctgcccccatggtcccactgccgctggacaccagtgtgatcttattggctgaagtcaagggaccactgatctcctctgccacctggcaggagagagacacccactcagtgcccatgatctgaccacattcctcataaaacaacttactctgggttttaaggtcctcgttccactgatcatccttcctcactttggtcactaataattcccacccctaatttagagtccccctaggctgtttctccctaagcccctcactacaccccaccccttagtccctggttctatttcctcctttcttggtgcccacatgacctccagacctggggcagcttctctagcagcatgtccagctgagcagcctcttggtacagctggaaggcttctgccttcttggccatctgctcagcctcggctcgggctcgggcccctatggcaaaggcctcagcttccccacgcatctgagggttaaggatgcttgtgagattgacggaaatcattaagaacaagaaatccccgatcaagcagcaacccccaccctctccacaagccagcatggaactgcctcttaactcacccgcacagacgcggcttctgcctccgcctgcataattagttgggacctgtggacagaagggaagtggagggtggagcccagcagcccttactcccaggagaaaggcccagtgctgcagaggcagacgctcctgaaacctgaaatccataggagtccaggtggtgaaggcttcagcactccatcttggggtgcctaggtggcaagtgagctaggcagggtcagggaggggacatttacttctctgcctcggctaggcgctccagcttgtagcgctccgcttccgctggcttccgcacccgggcctccagctccttctcccgccgggcgatctcctgctcctgcactgccacctgctgggcccgctccaccacctgcacctgcacccgctgctcctcaatctgctgcttagtcttggccacctgggtaggagggtgaagtcaggttcacgctctgagtcagaggtgaagagcaagtgcccgggaaccagagctccagagtgggatataaaaataggagccggtggccgggcgcggtggctcacgcctgtaatcctagcgctttgggaggccaaggagggtggattgcctgagttcaggagctcgagaccagcctggccaacatggtgaaaccctgtctctactaaaatacaaaaaattagccaggtgtggtggcgaatgcctgtagtcccagccacccgggaggctgaggcaggagaattgcttgaacctgggaggcgaaggttgcagtgagctgggatcacgccactgcactccaccctgggcaacagagtaagactccatctccaaaaaaaaaaaaaaaaaaaaaggagcaggtgcatgaaggtgggttccctcctgtctgcttggccagtccagtggagtccagtgtttctctgatgagcccccgtttaatctatttttcccacgtgtgcccccttctagagtataaataccttgagggcactgagcacatgttggctttctgctatctccagtcttgctcaaatccccccactgttgctgcgataaccttagtgctagcctaggctactgcaatagctgacttattttttgtgggggtggggacaggtgatcttttttgtcttttgcacatggtgcagatttaacagaaaaaaaagtgaaccacgaggcttcttcctcattctccaaaccacctgggtccctttcccagagaaaccaccaagaccagcttcttgtgtatccttccagggatactctgaacatctacaagaatgtgtgtattcatagaattcctcttatttaggcagatttctttctttttttttgaggcagtttcgctctattgcccaggctggagtgcagtggcacgatcagctcagtgcaaccttcacctcccaggttcaagctaatctcttgcctcagcctctcaagtagctgggactacaggcatgtgctaccatgtctggctaatttttgtattttttttagtagagacggggtttcaccatgttggccaggctggtctcaaactcctgatctcaagtgatccatccgcctcagtttcccaaagtgctgggattacaggcatgagccatcgcacccagcctagatttcatcttcttattccttgcagtgtgagggaatcagaaggctcttatcaagatgctagtgaggagaggtgccaggcaaggaacacattttttttttctttttgagacatcatcttactctgtcacccaggttcaatggcgtaatcatggctcactgcagccttgacctgcctgggctcagatgatcctcccgcctccccctctagagtagctgggactacaggtgtgaaccagcacacccggctattttttgtactttttgtagagacagggttttctatgttgcccaggctgatctcaaactcctgggctcacgtgatccacctgcctcggcttcccaaagtgttggggttacaggcatgtgccatcacacccagccagaacacatgccttcgttgtcccattgctcaggctcagccatgcaccatcatcattgtaggtctcatcaatacatgtgatgcttcccctgcctcctaccttcccccgggcccatctgttcactccagagagaagcatagctctggagacggcactctgtactgtctttcaccctaaattttcaaacccgttccaaactggcctcgttgccctctacaccggtgtgcaggatcacctctctcctgtgtcccttaggcaaccatttgtctgtttctttttccttcctgtctatgcccaccttttggtgaaactcaacctccagaagcttcctcagaaagaatataaagacaatattttttctgaggtcttgctttctctgagatttttattctacctttttttgagatggaatttcgctcttggcacccaggctggagtgcagtgacgcagtcttggctcactgcaatctccatctcccaggttcaagcaattctcctgcctcagcctcccatgtatctgggattataggtgcctgccaccacgctcagctaatttttgtgtttttaatagagatggggttccaccacattggccaggctggtcttgaactccttatctcaggtgatccacctgcttcggcttcccaaagtgctgggattacaggcgttagccactgcacccggcctctacccttctattttaataccagttaggctgaaagcaggctgctatgttgggattaactttccatcagaattctgaaggcattcctccatggttttctagctttttaagaaatctgggcttgggccagtcatggtggctcatgcctgtcatcccagcactttgggaggctgaggtgggcagatcacctgaggtcaggagttcatgaccagcctggtcaacgtggtgaaaccccgtctctactaaaaatacaaaaattagccagcaatggtggcacatacctgtagtcccagctacttgggaagctgaggtaggagaatcgcttgaacccaggaggcagaggttgcagtagctgagatcacgccattgcactccagcctgggtgacaagagcaaaaatccatctcaaaaaaaaaaaaaaagaaaagaaagctgggcttgatgcagtggctcatgcctataatcccagcactttgggaggctaaggtgggaggataacttgaacccaggagttcaagaccagcctgtgcaatatggcaagatctcacctctagaaaaaaatttaaaaattagctgggcgtggtggtgtgcccctgtggtcccaactactggggaggctgaggtgggagaatcacttgagcctgggaggttgaggttacagtgagccttgtttatgccactgtattggacaacagagcaagaccctgtctctgaaaaaaaaaaaaaaaaaaaaaaaaaaggaatctgaagtcattttgaagcctgcctctttgagatctctctctctctagaagctttcatattttttgtcctcagcattcttaagtttcacagtgttatgtttcaatgtatatatttttcattcattgcattgggcacttagtagaccatttcaatctaaaacctcatttttatataatttttctcagaatgtttctgctcccaataagtcatgccacatttgcatgtgcttgacttttttttttttttttggagatggagtctcgctctgtcacccaggctggagtgcagtggcatgatctcatctcactgcaacctctgcctcccaggttcaagtgattctcctgcctcagcctcccgagtagctgggactgcaggcgcgtaccaccacgcctggctaattttttgtatttttatagagttggggtttcaccgtgttagccaggatggtctcgatctcctgacctcgtgagccacccaccttggcctcccaaagtgctgggattacaggcatgagccaacacccctggccctgcttgactcttattagtccctttcccttacttccctgcttctttctgtggggttttatttttcccctttgtcagctcttgccaggttaccaagcataccctgtccctggctttcttggttgctcccaaatctgtgatggcttgctctgttgcccaggctggaatgaaatggcacgatctcagctcactgcaacctctgcctcccggattcaagtgattctcctgcctcagcctcctgagtagctgggattacagtcaccatttcagctaatttttgtgtttttagtagagacggggtttcaccatgttggccaggctggtttcaaactcctttgtcatctgctcagagggaagaaggtctcaacactgaaaggaagctctgagtatgtgggtgaggcttgctgactttgagcttcaccctacggtgatctggataggccatgtacggagaaacatctgattcaggattttaagttatttctttttggattggtcatgttccccagagcagtcttctgatctcttttttggaagatggaagttctgggagctgagtggggttgagggggttggggttggggttggctctcagtatttagcattcatgaaagttatagtcatttcatgcccctgttactggtaaactatctaggtcctcacctgtgctgggccagcccccatcacatcctctagtctactctcttcagataatagacttccaatggcaggtatggtaactcacacctgtaatcccagcacattgtgaggctgaggtggatggatcacttgaggctagcagttcgagaccagcctggccgacatggtgaaacccctctctactaaaaaaaaaaaaaaaaatacaaaaattacctgggcgtggtggtgggcacttgtaatcccagttgaggattacttgggagggtgaggcacgagaatcatttgaacccaggaggcagaggttgcagtgagccgagactgcgccactgcacctgcactccagcctggacaacagagtgagagaccctgtctcaaaaaaaacataaataaaatagataaataagataataaacctccagatgtctgttggagcagggcaggaaccattacccagaggcagtgaggggctctgagaaggtgcttttcacatgttcctcttatttaaccagtctaccacagctggagaagcactgggtgctgccagctcctgagcctcagatcatttcattgttttcccttttgcaggtttcaagctcagctgtgtcatacctgcttagtcaattactactgacttccagtttccaaaatgatgctctggtttccgttcctattttctccatcttttttttttttaaagcctagtcagctgggcatggtggctcacgcctgtaatcctagcattttgggaggctgaggcgggaaggatcctttgagcccaggagtttgagaccagcctgggcaacatggtgaaattccgtctctacaaaacatacaaaaattagccaggcgtggtggcatatgtttgtagaccaagctactcaggaagctgaggtgggagtattgcttgagcccaggcagttgaagctgtagtgagctgagattgtaccgctgcactctagcctgggggaccgagtaagacccggtctcaaagaggagaggagagaagaaagaagagaagagaaggaaagaaaggaagaaagaaagactaatcaagtgcaatagtgagaagtaggtaaagagtagaacaaggagttcaatctgtaactgactgaacaatcaattgagataactcactacctttggacaagcctctatctttaccttaaaaaaaatcattttagatcgcgccactgcactccagcctgggcgacagagcgagactccatctcaaaaaaaaaaaaaatcattttggctttagtgaggttttaggagagagtaaaattagctacatttgtttaatccatcatctctgaaaaagagcccaactcatcttttgcttttttttttgagacagagtctcactctgtcatccaggctggagtgcagtggcgcgatctcggctcactgcaagctccgcctcccgggtttatgccattcttctgcctcagcctcccgagtagctgggactacaggtgcctgccaccacgcccagctaattttttgtatttttagtagagacggggtttcaccatgttagccaggatggtctcgatctcctgacctcgtgatctgcccacctcggcctcccaaagtgttgggattacaggtgtgaaccaccgcacccggccttgcttcctctctttgcccgttctccacaaggcaaccagactgatccctatacaaatataaataagaccatggcacctttctgcttgaagttctccaatagctttccactgtgctttcagttctcttctgtgtctccatcgtgaccacacaaaccctttgtgatctggccctgcctgcctttcctcctcactcacagcacaccagcgcccccagatcagaaacctcctttctgactccacctcacagcctttgcacttactggtcccctgcctagccacaagccacgtatgactgactgactgactgactgtctgtcgtccgtccgtccgtccgtccgtccgtccgtccgtccgtccatccgtccatccatccatccatatatctatcttagaaggagtctcgctctgtcgcccaggctggagtgcggtggcgcaatctcggctcactgtgccttctggattcaagcgattctcacgcctcagcctcccaagtagctggaactgcaggctcaaaccaccacacccggctaatattttttgtatttttggtagagacagggtttcactgttggccagactggtctcaaactcccggcctcaagtgatcttcctgtctcagcctctcaaagtgttgggattacaggcatgaaccaccgcgcccagccactttttaagtatgactacttaaaaagcacaggctagaatattcttggctcagaactgtacattgttccttcttatctccaagtctgatctcaaacaccacttcctcatagaaactttctctaccacccgctaacctaatatactaactcccctcccacagtttttcacatcaccctgtttatttccttcacagcacctaaacaagaattatagcctgggaaggtcatttacttgcttactagctgtttcctgtgtcataatgtaagctgcataagggcaggaatcttttctgcctcacctccatatttatagcctcacctccaaaatggtgtctagcacatagaaggcacttaacagatatttgttgaataaatccttctttcctgaacacctagcacactgcctggtgcataacgagaaactgataaaagttgaaaagagtccaaccagtccaatcccttaatctgcagacaagtaaggtcatgtttagaaggttaagaaccttatccatagcttcactgcaagctagcagtttccatcatggtaacccttttcaaactcaaactccaatgtgcatacaaatcacctaggaattcaccttgagattttgttaaaatgcaggttctgattcagctggtcagggccagggcctgcaattttgtatttctaacaagcttcgcagtgatgctgcagctgctgctgggtagaacacagtttgagttgcaaagctgtatgccatgttcaacctgtcaagtcacccaggaatttaacataataacaaaagatgtttttaccttcattatgctttcagcctgtaccaactcttggcaaaaacaaaatgcataatattgctatcctttgggtaaaggtctcaaagtacagttgattttcattgttcttggtagttctgttctataaagtagccatgaatgctgaattagttaatacctaatttgttcctagaagaaatacaggctaggttcccgtgagcctctggtcaaaacattttcatcaactgatcaacatagagccttgctttatatgtgtttctgtttaaagacaccttatgtaaaatatattgttgattcattaacactgaactcacagctaacagcagtataacttatgcatgaacgaagcttacctaacacatgtatttctcccataaggcacatcatagcccgcttgcactaaaggacactagacagcactacagcactgatgcttgggggccattttaaagagtgaattcaccaataaaaagcacaaaaatgcaaaaaacacggcagtaaatatactgtgaaaataacacggcttacggtatgagagctgaaacaaggcagcagagcatctccttgatcaacctcacctgggtactgtgcgtgtctgcaaaagatcctgaaagtgctgcgactttattggtaaccttttgaggttaccaatacattttagtgaataggcaaattctcagatacgaataatgaagaatgaagatcaactatacttcctggcaatatcaagggctgcccatatctcactttgcaggattcaatgtccaagtccatgttttccttcttcatacccttttttaattaaccagggctgccgctagcccatagcatgcctctgtgcaaatcagaaattcctctgtgtagatgcagacccatgtcagaatgcactgcttgattagaggggcatgggccggatctgagctcggatccactttctcagtcagatgcctttgcacgggcacagcctgctccaaacatatgatcagccttattgatcatatcccttcttggccttctcttttttttttttctttttttgagatggagtctcactctgtcacccaggctggagtgcaatggcgtggtctcagctcactgcaacctctgtctcccgggttcaagcaattctccggcctcagcctcccaagtagctgggactacaggtgcgtgccaccatacctggctaatttttgtatttttagtagaaacagggtttcactatgttggccaggctagtctcgaactcttgaccttgtgatccacctgccttggcctaccaaagtgctgggattacaggcatgagccaccgcgcgtggccttttttttctcttttttggacaggatttcactgtcacccaggctggagtgcagtagtgtgatctcgactcactgcaacctgcgcatcctggctcaagcaatcctcctgcctcataccccaagtagctgtgactacaggcccgagctgccatgcctggctaatgtttgtatttttcgcatagacacggtttcaccatgttgcccaggctggccttgaactcctgaggtcaagcaatcagcccgccttggcctcccaaagtgctgggattacaggcatgagtcaccacacccggctggccttttctttaaagcttttcagctgtaacgtctgagtcttttaaatctctcctcatatgggggagttggtccagagatggagagccagaataagaccaaagttaaagtatgagaaatagtgtagtggtgtcctgagatggacagcctgagaggaatggggaaggggcagagagtggcctggcagtggctctgacctgaagctgataggccaggtcagcctgtgctcggcgggtgttgacctcgatgtcataggcggccttcttcagttcgtaatctctctgtgccttggccatctcgatctcactcaggtactgagcagacaccttttcctgcttggctttagcttcctgtccaagcagagatcaggtaggaaatgtcagggcagggggagaaaggccacggtgacagcctgcttcccaccaaggttctctttctgcctcatgtattttccctgctcacccagcacccctgcttcttctcagttgtgccacttctatcccctttcccactaagcaacccccatctctctcacccggatcccagcatctctcttggcctctgcttctccaatccgtgcatctttttggacttgagctgttcgagccttccccaaagagtgcaaatagtcctgtgggagagatgtagaaattagtcctttggagggcttaagagatgggagcaaggaagtggggaaggatcaattgcctagttttacctggtcatcgtgaatgtccttcagagtgtagctaaccacactgatgcccatgttgaccaggtctgaggaggccactttgaaaacctgttctgagaatttctgcctgtccttatagatctcctgtgataacaggatggtggggagaagggatgtaagttttttttttttttttttttttgctcactgcaacctctgcctcctgggttcaagtgattctcctgcctcagcctcccaagtagctgggattaccgacacccatcaccatacccagctaatttttgtatttgtagtagagaaggggtttcaccaggttggctaggctggtctcgaactcctgacctcaagtgatctgcccaccttggcatcccaaagtgctgggattacaggcatgaaccaccctgcccggccgggatgtatgctcttggatccactgtctctcacagactagtgtgggccttgggcccccctcattttgacatccttccagatggttccctgcccctaggccaacctccacagtcatgtgggccatgatggccctctggtggccctctaacgtctccagggcaatgtgggcaatctcagcctccgtcttccccaggaacatctgacaggcggccgccaacatctccttgttctgcccctggatttttacctgtagccagagtaggggtaggaaaggtgtggtgggggtctcatgaagtcagagaaaaagcagagagagaagggagagccctctaagaaatgcttcttccatttcagggaaagaaaggaggaggaggcaagtgccttggggtgcctggaaaagatgagactagcagaggaacttctctgcaggcaagggttgagaagactgtggccagaagatgtcttaatgtctgggagagagggtgatggggaagtggactgtggggaaaaggctctgaaagcttcacctgggcaatgccagtgactgagatggggaccccatggcgagtgtaaaccttttcactcttgacattgagggtcagtgtgttgagagagatcctaggggaaaaagaagggacagacagtaagaagaggaggaaaaagagaaaacggaggtcccccttccctggttcccttcttgcctacctctggatctgttggatgcagggcaggacaaagacacgccctccagccaccatgactggggggcttcggcagaaccctgcaaggtgtggggcagtgaggaacggtggcagagcttgaatgtggaagactgaggaactggcgggggtgaggggacagcaacccacaggagagaatctgggagctggaggggaagcagtctgggccttggaatggtgggaatcaaactgggcagttcgtggccatcaaggggcagaagtctggtgctgggaagttggtagggagagggagaaggggcagaggccagactcacaggggttctggggtcactggctgggaagggaacaacagtacttaccggagaccaccatggcctcatttgggccacaagtgaaaaacatggttcaggctggagctggaggagagggagggaaagcctttgcggatggggaaggcgcgctgtggcgtccacaggggcccatcctttccctttcccgtcaggccctcccagtctgcatccgccacggcccgtcccttctacacccatgggtccgctaaggcttttccctacaaaatccttaagatccccagctacctcttctccgcctgcgtatggtccctcccttcccctcgccgctccctttgataaaggtcccccgcgcccagaggcctgcagacctttcccctctctccctgcttctcggcagccccaggctccatctcccctcccccactcaccttccgggacgcgggcggcagcccggctggggtctcgggaagggcggggtcgcgcagggacctgggagccgggcaggggccgctcgcagaccagctttcctgggagctggccccgctcccgcgttccccaccctgccgcaccccgttgctgcggcagacgcgaccccgccccccgcaacggactaagcacccccacttcgccccgcctcggcccagtgcgctcggcccgcccctttcccggcaggccccgctagagtccgcagcccgcccgcccgctggctctcgggcccagccgggctgcctggttagcccggggagggccacatccctgccgccccagtcaccgcccttcttgagccgggaatcccgcccacgccgcgccacgctccgcccccgggtgagggacttgacctccgcctggcaccctggcgtaagggtgattgccacatctcggattcgccgcggggcaactacctgggaaaaccgcagactgggcaatgaaagactacatccggcaaccggatgctgggttctgtgactccaggaaaaggggctcctgggcccagggaggtgcgcgggctggggactcggccacggcgcctcccgccggtccttgccatctgaaggccgggaggagtggggagtcggcgcttgcaaagatacactcaagactgcagacagtaaatcaattttatttgtgttcacagaacatactaggcgatctcgacagtcgctccgtgacagcccaccaacccccaaccctctacctcgcagccaccctaaaggcgacttcaagaagatggaaggatctcacggatctcattcctaatggtccgccgaagtctcacacagtagacagacggagttgagatgctggaggatgcagtcacctcctaaacttacgacccaccaccagacttcatcccagccgggacgtcctcccccacccgagtcctccccatttcttctcctactttgccgcagttccaggtgtcctgcttccaccagtcccacaaagctcaataaataccaagagacctgcatttacagcagggggaacatctcacacccttgcataagttaaaataaatattacgtacacatctccatcacctaggaggacgtacataaatacatataaatattaattaggagcaataagaaataaattaacgacgctctccttcccaccgggcctagccccagctgggctgtgcctcggtctctatgcgcctcggtctctgtgcgcctcggtcccgcctcaagcaccgggtggcgtctccgctgtagtgttctgagttcaagttgcctcggaagtcccagttggggatacgctctcgcgcaccaggtacgcctggtgtttctttgtggtttttcggattctttttggggagtgcggggagtcacagttagaaggcggccgggtgttgctggaggaaagtgctgaggtccagagcgtagtccgagggctccgaagtcagattaaagggctcgaggacggcggacacaggggtgggcgccagggatgcggcgttaggggcgtcctctggaggcaggggcgccggcacaccctcttcagccatcaggatctggcagaagacgatggtgagcagcagaaagagaagccttttggctgggttcggttcctcgactggcagctggcgccggacctaaggggagacaaaacaggagacaggtcaggtcgaggcctctggagtcgggtcgttccccagtgactccagggcagcgcaccccgcgaatgcccacttcggcgatactcaccactcgagggtagagaaccctgcggctgcgctttcggtgcccgcgagaggcgctggggcgcccggcaggggccgctgcgggctccgggagagggtcgaaggtgaagatctcaggaccggagccccgccggggtcccgggatggtggagggggccggggtcggggcctgcaggatggtcatggtcgggtggcagctgcgagagtgacacatggtgagccgagcggagtgtaaggccaagtgagggtcggctgccggcagaggtaatttatgtgctcctgaaaattgggcgggtccttctaactcctcctcccgcagctggggagcggttggcagcagcgggctggaaattccgacgattaaacaaagggagtgggtggagacttgacatgcacaatcctaggcgcccaactgcacgttgtgagtgtgtgagtcgtgagtgggggtgggtgagatcccgggctgcaggcacatgtcgaggcatgtggcacctggagaggggctcactttagccacaggatccctcacaggcctttttttttttttttttttggagatggagcagtctcgttcggtcgccaggctggaatgcagaggcgcgatctcggctcactgcaacccctgactccctggttcaagcgattttcctgcctcagcttcctgagtagctgggaatacaggcacgcgccaccacgcccagctaatttttgtatttttagtagagacggggtttcaccctgttggccagggtggtctcgatttcctgacctcgtgatctgcctcgctccctccgtccttcttctagtagtctcaagttgctattgttgccatctttacgtccacgagttcccaatgtttggttcccacttataagtgagaatgtatggtatttggtttgcccgcctcggcctcccaaagtgctgggattacaggcgtgagccaccgtgccctgccaagagggctttttattggagatcaggccatcctgctgcaatactgacccagttatatgcacgcattcatgcacttgtaggtatccttagaatataaactccccaagaaggaaattgttacagaaatagtcaagattaagggagaaatgaacacactagcacacacagacacaaacctgcctgcctgagcacacatgaagacacacaccgcgtagccatacaaaagaacaaaattatgtgctttgcagcaacatggatgcggctggtggccattatcctaagcggattaactcaggaacagaaaaccaaataccacacattctcacttataagtgggaaccaaacattgggaactcatggacataaagatggcaacaatagcaacttgagaccagtagaagaaggacggagggagtaaggcaaaggttgaaacactaactattgggtactatgctcagtacctgggtgacaggatcattcataccccaaacctcagcatcatgcagtatacctaggtaacaaacctgcacatataccccagaatttaaaataaaagttggggagggagggaaggatagaaagattaaaaaagtaatacacaatggtggggcatggtggctcttgcctgtaatcctagcattttggggggctaaggtgggaggatcacttgagctcaggagcctgggcaacatagtgagaccttgtcactataaaataacaacaacaacaacaacaatacacaattaaatattattcagccataaaaagaatgcaatcctggaaaaaaaggaaaacataccacgtacacctaccaacacacatgtacacagtaaaggtgcaaagactgtatagggacagttcagcaaaactactctcttaggagcgtgcagaaatattcacataaaggctggtgcagagggccacaaatacaaaggcaataggttagcagccacccagatttgccccttgctgtaagtcaaacaaccaaatttatgggacaaacattctaaattgtgagacattatacaaatgttacagtaatggtaattactcaacttaaagcagattcacatttccataacttccttacagacagctgctcatggacacagaatttaactttttttttttgttttgagacaggatctggctttgtcgcccaggttgaagtgcagtggcatgatctcggctgactgcaacctctgcctcttggctcaagccatactcctacctcagcctcctgagtagctgggaccacaggtgagcaccaccatgcctggctaatatatatatatatatatatatatatatatatatatatatatatatatatataaaattttttgtagagccagggttttgccatgttgcccaggctggtcttgaactcctgagctcaaccaatctgcctgcctcggcctcccaaagtgctggcagccaccgtgcagaatttaacatcttttgagcattcacctgtttcaggcgccctctgttgagggtactactgttgagagtcctgaggctagtttcagtataagtgctgtgccatgcagctgcctgaggaaagccagataaagctgatactccagccatgagggccttaccctccggcatgaggagggaaccatggccaggagagctctctatctgtctgtctctgttgctctctctctctctctttttttgttatattgagtttctgcctgaaggaaaggcaagctttcttgaagatcctaagaaaggccaggcacggtggttcacacctgtaatcccaacactttggcaggccgaggcgggtggatcatttgaggtcaggagttcgagaccagcctggtcaacatggtgaaaccctgtttctactaaaaatacaaaaattagccaagcatggtggcgcatgtctgtaatcccagctactcgggaggctgaggcaggagaatcgcttgaactcaggaggcagaggttgcagcaagctgagagcgtgccactgcactccagcctgggtgacagagtgagaccctgtctcaaaaaaacaagaacaaaacaaaaaacaaaaacaaaaacaaaaaaacctaagaaaactgaagactaagtgttaagggggggacccaaaagagctagtgttcacatctgtccaatcaatcaggggaggcttcatggaagagtggcactgaaggtgaccttgaacagtgggtgggatatgacaaattcagatgtggaggatgactgtaagaatggaattagcaaagaccttgagctggaaaagtacaggatgtgtttggggaatcacaagaaaaacaatctcagagtaagtttcctgtaacggagtagtgggaagtaataatggctggaaaggagtggaattgggcagagtggggagagcagagctgccaggtcaggagcctgggtttcactctagactgtagagcttgtgggttgctggatgagataaagggaggaaaattcaagcaggaaactgattgggatgaggagtgatgctctggacgggtagagactaaggcagtagacaggaggctattggaggggctcaggtagatgataacaagagcctgagaaggtggccctaagagacattcctagcataagataatcagaattgggcaatgagatggatatcattaggggaagggagcatgggagagggagagttgccgacagcaagaggatgaaaagatctgagatgactccagagatttgaaatacatctggctcagatctttctaccatcattttaagcctggtgcacaaagtgaatacatatatgatctcttccactggaggctgtgtcatacacatctttgtgtcctccagagaacccagcatggtaccttgtaggcagcagttgctcaataatcttgttaaatgccaggtgaaatgtacaactgtaagtgtgcatgtagtattcccaccttggctgggtcacaccaagcttctgagatgtggctacactcctccaaaccactcatacaaatgtacaacatctttagaaaagctgggacaattcttacacagacaccaaacaggaaacacttttctcccctcccacttaggaaacacttaaaaggatttttcaatcaagaacatgtaggaacacaaataagaggacaggccacaaccggctagaaatacactactgctctgtgtacaattcctgggcctacaagtcactttattttatactcactactcttatctaaatacacaagatcccttccacattacacacttcttcctggctggcataaaacacacctcctctgtaaacaaaggcgcattgctttcccacgcctgtcttcacacctgccatcattcttacatttacacccaagcacagggagcccaccacccccaacatccttattccaaggcaactcgcacgctacacaatgaccaacataaacccatgactacttacacatgtggacagaccctcacactcacataaacataaattgggagtagggggagatagtgatgatggaagaaaactagtgggtgggagagagagagaagcaccaaaggttaggaatgcattacttgtttatgatggaaaatttctctagggcattaggcagaggaggggaaatgaaggggatgccaggatcttgttttgccactacctcccacatctggaatctgggcctccagctgggtctagttatcctcgctgtcctcccggcacagagagacctttctttgtggcaagaccagaatgggacaaagagaagacctgagaacccggactgctcaccattcccaaccaatcccatccccattcctgctaccctcagagccctagggctctgctcctgctccttcctgccacacaggaagctagggaaatgttgggggtgaatcattaagccaataagggggtgggggagtgcaggctggggaatgagttaaggccagaaagtgccaggggctgagacgagcaactggactggctcccactgccctgatactggagaaacaggcccttagcctcctccatttccagctctcctcctcatttccttcccatcttcccccagatcaccatgttccttcatttccctcgtttgacctttgccttgatccatcaccactgctagcctccttctcagccccttgtttttcttcatgacacatatcacgttggggaatcattttatgtatttgctttttgctgttgtttgtcccgcctactggaatataatctccacgagtgtacagggccacatctgacctttttctcattagatctctgtagtatctccagtacttggctgtcacctagtaggaacttaataaatattcttaaatctgtctcctccgaggagctaaacctcatctgcagagaggtctgtttatctagccatgttcctttagaggcccccatgtttgctcttcaaagaggaggttgggggcactcaggtgtggctcaggtgatccgccgctgaatcaggaacaattgtgcagtgacgacagcgacagcaaagccctggcccgcgccctttacaatccctgacataggagtgagtcaggcctgctgcctcacctgggtactgctgcactgctgaccacaggcccagaacgggggacggcaagaatgggcactggcggaggcagaatgggcaggggaaagggaggcagagatttggaaatgggagcatctgagaaaggaaagcagggtgaagggactgcaccagggtcctgggggtagggaatgacaaagtgaaagctttttagctgcacctggtattcagtagatcctcaataactacttggtgacttgagatgggtttgagatagaaaggaaacacggaatagcaaaaagaacatattgtaatctagtggtgttagacgaaattgggtttaagtgccagctctgctacttattaactaggcaatattgggccagttacttaatgttgctgaaaatctgtttcctcaattgataaatgggcaaattgacctctaggtaactgcaaaggttaagaatataaatttactccttctgggcacatagtaggtgcttcttgcatggagcaggggcattattataattatgagaagagggactgctttggaacagggatgggcagcagtgagccaacccaggagtagggaactggaatgagaaaataacctctaactgctaacatcaccaggagatacaagttctttctctttttactctgccctccctccctctccatatcaggcaggttttgtggctctttattttccagagaagcaaagacttctgcattcctagttcctgttcaactaatgtgagtgattttatttttttatgtatgtatttatttattttttgagacaagatctcactctctcacccaggctggagtgcagtggcataaacatggctcactgcaacctcaacctcctgggctcaagtgatcctcccacctcagcctcttgagtagctgggactccaggaacgtgccaccatgcccagctaatttttatttattttggtagagacagggtcttgccatgttgcccaggcaggtctcaaaattctgggctcaagcgatcctcccgcctcaacctcccaaagtgttgggattacaggcgtgagccacaaagtctggcctttatttatttaaaaaatttagtttggctgggcgtggtggctcacgcccataatcccagcactttgggaggttgaggtgggtggatcacgaggtcaggagttcgagaccagcctggccaacatggcaaaaccccgtctctaccaaaaatacaaaaattagctgggcgtggtggcgtgtgcctgtaatcccagctactcgggaggctgaagcaggagaattgcctgaaccagggaggcagaggttgcagtgagctgagattgcaccactgcactccagcctgggcgacgagagtgaaactccgtcttaaaaaaaaagaaagtcttactctgtcgtccaggctggagtgcagtggcacaatctcggctcactgcaacctctgcctcccgggttcaggcgattctcctgcttcagcctcccgagtagcgcatgccaccatgcccggctaatttttgtatttttggtagagataaggtttcaccatgttggccaggctggtctggaaaactcctgacctcacgtgatccgccccctcggcctcccaaagtgctgggattacgggcgtgagccaccacacccagcaaaaaaaaaaatttgtttttactcaccactatactgacaaggaacaggtgattttaaacatcccctcccacctacattttagctggaacaattctccagaggcatgggggtagagtggggtggtgagttctaggcagcaagttaacaaatgacccctaaagatattcatctaggctctaggaggcccaaaatcaggccctggcagttcccctgacgcaaaaccatggcaagagttccgggagcaccaaggcaaggtcacaaaagtggcacgatgaccctaccctgggatgcagctcagcctgacccagcccaactcaacccagctaccctggaggctgctatgagctgagccgggagctgggaaagggcccagcattcctgtccttctgccaaagccggcttcttaggaccccagtgttgtggctcctcctttggtcttggtttctttcccaccagattataactccaccagagtaggactttatctatcttgtgtactgctctattttcagtgcctagaactgtgcctgtcaatcaatacaggctgctgaaaaggctagaaatacaggatcgttgatgtcattactgttacagtgctgttcccgtgggaagcagcctgcatctctctgtagacagctccaatgtcagccattggagaatttgatggagattgaagtcaaaacataatcataggggaaaaatgcacaacaaataaaatatttccccttttgtccagacttttcagacaccccgtatttactggatgagttgatctacaaagtgaaaggcataaattaaaggctctctaatgtttctcctcctctgaaaccccatgattcagcagcgtctcccatgtgtgctcaaaagttggacgtgcctccagcctaccctccaaagcagttgccataggctcttttcttccaaggttgggagggacagttcattccccaagaggcctctccaggggcggaggcgggtgctggggctggcctgtctgcagctccctggccctacccagtggggatcgcgtgtcagtactggggtttggtgggctgccaaggggtgagccctgaggcggttttctgggaaggatagatgccatgtgtgactcagaaccaagttagggaaaaaacaagctcactcaatctctagcaccctctgcctggcctggctttgcccatgagctcataaaagaggaagctgggccggccagacagtagctctgctttccctcatgttttctctccacgtctcacggattccctagagtgtctgggcctcaggccaccgtcatcctagctcctgggccctggctcttttatgacactttcccttcccagacacttggtcatttctttccccaggttgggaatcccacctaccatagaaggggaattgcacacaaggggaggttgcaaatctctgtgttccttggccctgctgaggcctccactgtcagccatgaccatttgggtttgtgcgtgtgactgctgtgtctctgacacagaccaagtggtgctgaccctgggagcctgaattaatagatttcttgagagctgagattctctggttcaggaaagaaaaagggggtaccaaatgactgggcagccgagccaccctcagggctgcaatattccagttgggaccaacttacctagtacttttggcattcagaacagttcactaccaaaaaggcacattttattttagtgaaaatgggacaatcatgggccataaagaaccttcctaactattgttcctccggttcacctcctataccccccagggctttcttgttcaaagacagacttgaccatgtccatgcctgcttcagtaagttcagtggctccaaactctctgagttcccaacccaaatccaggcaccttgcaggctttctctttcaacacccccattgcttcttgatgttgtgcatctctaattttgtcctttttctcacacatgccaaactcttacccattggaccctataaccgttctatttcttttcctttttcctccctattctcctgggaaaaaaccactcctgaacctgccatccagaattagttcatctacattgtatacaaatctctcaaagcatcacacacacgatattatagtcatttgtctatctttttgattgccaggagaggcacgtgccattgagatgcagccgtcttaatactggtaacctcttgacaaggcctaaaattattattaaattgtcaccattaaaaaaaaaatcagtggccaggcacggtgtctcattcctgtaatcccagcactttgggaggccgaggtgggcaaatcacctgaggtcaggagttcgagaccagcctggccaacatggtgaaaccccgtctctactaaaaatacaaaaattagcctggcgtggtggcaggcgcctgtaatcccagctacttggaaggctaaggcaggagaatcgcttgaacccgggaggcagaggttgcagtgagccgagatcacgctatcgcactccagcctgggggacaagagcaagacttctcaaaaaaaaaaaaaatcagtaagaaatgtataaaccagatattctcaacctatccctgtgggttgaactcatcctatctctgaccctgagcctttcacataaaatttggtagtatttggtgatactgcattttgttttaaaaagtcaggtagattgaagtataatttaaatacagtaaaattcatccttcttaggagtagtttttgatgagttttgataaatgcatatagtttgtgtaaaggcctccaccatgatgatatagagttttccatcacccccaaaagttccctgcatccctttgtagtcagtcctgtccccatcccctatagcaaccactgatcagacttctaaccttacagttttgcctgttctagaatgtcatatagatgaaactacaggctgggcaaggtggctcatgcctgtaatcccagcactttgggaggccgaggcgggaggatcatctgaggtcaggagttcaagaccagcctgaccaacatggtgaaaccccgtctctactaaaaattagccaggtgtggtggcaggtggctataatcccagctacttgggaggttgaggcaggagaatcacttgaccccaggaggcagaggttgcagtgagctgagatcacgccatttcacttcagcctgggcaacaagagcaaaactccgtctcaaaaaaaaaaagaaagaaagaaagaacgaaactacagtagacactcttttgtgtccagattcttttgctcagtataatatttttgtgattcatccatgtcatggcatgattcagtagttctttccttttgacttctgcatagcattccattgtataaatatatgacagttggcttattaattcaccattgatggacattgtggtttttttcttatttttggaaatgatgaataaagctactatgaacattcatagacaactcttttttaagacatgtattcttatttctcttgagcagatgtctaggagtagtataactaggtgcatgtttagcttagtaagaaatcgctgctgtgcccagtggctcacacctgtgatcccagcacttgcaccacgacgcccagctaatttttgtatttttagtagagacaggtttcaccatgttgatcaggctggtctcaaactcctgacctcaagtgatcagcccaccttggtctcccaaagtgctgggattacaggtgtgtgccaccatgcccagcctaaaggcagaaggatttcttgagcccaggagtttgagatcagcctgggcagcatggagagacctcgtctctacaaaattaaaaaattagccaggtgttgtggtgcgcgcctgtggtcccagctactctgggaggctcaggtcgaaggatcacttgaatccaggggtcgaggctgtggtaagtcacattcacaccactgcactccagcctgggagacagagcgagaccccattctaaaaaaagaaaaaataagggctgggctcggtggctcatgcctgtaatcccagcactttgggaagctgaggcgggcagttcatgaggtcagaagatcgagaccagcctggctaacatggtgaaaccccgtttctactaaaaattcaaaaattagctgagcgtggtggtgcgtgcctgtaatcccagctactcaggaggctgagccaggagaatcgcttgaaccagggagtcggagattgcacagtgagccaagattgcaccactgcactccagcctggcgagactccgtctcaaaaaaaaaaaaaagaaaaaaaagaatttgctatgctattttccaaagtggttcatactgacagaactgttttaaggaagctgcatcaaaatgttcctcttgtaaattcttgcttaaaatatgccaaaactaagtgttttttttgttatagaacaggttgccactcagattacctcaagggacagagatgggctggaatagagccacctcagtggccagtaacctgccccttgaagaaccagcatgtcttccagaagccacagtggcttccagtgcccagcggcagccccaggagcacaccctgcctccctgcccagactccttgtggctcagcatctctgtctgcagtgactggctctgcccaggtcttgtggggtagtgtgaagtgacactagcccacacacctgagcatgtatgatgcctcagaggcactgtgtgtttttttttgtttgtttgtttgtttgagatggagtcttgctctgtctgtagcccaggctggagtgcagtggcgcgatcttggctcactgcaagctccaactcccgggttcatgccattctctccctcagtctcccgagtagctgggactacaggcgctcaccaccactcctggctaatttttcgtatttttagtagagatggggtttccccgtgttagccaagatggtctcgatctcctgatctcgtgatctgcccacctcggcctcccaaagtgctaggattacaggcgtgagccaccacgcccggcataggcactgttttaagagctatactcaaatcaattcattaagccttcataaccccaactgttattttatctatacacccattttacagatgagaaaaatgaggttcaatgaggcaattcactttcttaaggttgtgtaaccaagaagtaatgggagttagatgtgaacctaggtctatttcattccaaagcctagtggcatacctatttgtcagagcatagatgctagagcccatctacctgggttcaactccatgtttgtttgtttgttttttgtttttgattttgagatggagtctcactatgttgcccaggctggagtgcaatggcatggtcttggctcactgcaacctttgcctcccaggttcaagcaattctcctgcctcagcctcctgattagctgggattacaggcatgtgccaccatacctggctaatttttgtttttttagtacagatggggtttcactatgttggccagactggtcttgaactcctgacctcgtgatctgcctgcctcggcctcccaaagtgctgggattacaggcatgagccaccatgcctggcttgtttgtttttagagtcaagatcttccactacagctcaggctgtagtgcagtggcgccatcatagctcactatagccccaaactcctgggctcaagcaatcctgccacttcagcttcctgagtttctaggactacaggcgtgtgccaccatgcccaactaattaaaaaaaatttttttttttttttggtagagatagggtctcactttgttgcccaggctggtctcaaactcttggcttcaaatgatcttcctgcctcagcctcccaaaatggtgggattacaggtatgaaacaccatgcctggacaactgtatgttttaattcacttaattttcatggtacacctctgagaggagggcatgacaacactcattatacaggtgcagtgacagcacagaactctgtgaagcaggggaatgacagagttgagtttggcatccaggaagtttgtctccagagacaaagctattgacctcaacaccttcctgcctctcaacaatcctcattattaatgttattattcaacccactgacctagctctttttgtctttggggttttacactgctctgatgttcatgtccttgcttatgtcttaaattgagactctgaatgggttgtgtacacactccccaggatacagtaacctttttgggtattctcacctctggctgcatcactggcctcttgccagcccttgagaactgcccctagctcaagcaaggatcctaatttagtagatgaggtcagggccggaagattatctgcagggtgacctatgcccaaggacttactcccaaatacttttctcaagagaaggtggtgtaaccagaagacactttaaggtcttgaggccatccccaaagatcatttgtttcctcaaacagattttgggctttttcaggtgagagactaatcactgaacccactgtcagtattcagcagtgtgcctgattgatatatactaggtactcaatggttttgactgaatgatgaataaataaatgaataaataaagaagcccagattctcttaatttaggtctatgctgtctaatacagtagcatgtggctatttattttattttattttttgagatggagtctcactctgtcgcccaggctggaatgtagtggcatgatcttggctcactgcaacctctgcctcccaggttcaagcagttctcctgcctcagcctcctaggttgctgggattacaggcttgtgccactatgcccagctaatttttgtatttttattatttatttatttatttattttgagtcaaagtctcactctgtcacccaggctggagtgtagtggcgtgatctcagctcactgcaggctctgcctcccgggttcacaccattctcctgcctcagcctcctgagtagctgggactacaggctcccgccaccacactcagctaattttttgtatttttagtagagacggggtttctccttgttagccaggatggtctcgatctcctgacctcgtgatccgcccgccttggcctcccaaagtgctgggattacaggcgtgagccaccgcgcccagcatttttgtatttttaatggagacggggtttcaccatgttggccgggctggtctcgaactcctgacatcaggtcatctgcccaccttggcctcccaaagtgctaggattacaggcgtgagccactgcgcccagctgcatgtggctatttgaatgtaaattctaatgagtcaaaatttaaaattcagtttctcagtttcattagccacatttcaagagcacgataatcccatgtggccagtgattaccatatttgaaaacacggaaatagaacatttccatcattacagaaagatttgttggacagcactaggctagatgacagatagggtgggggaagagaaaatgctgcattgggaaaatgcttggtataggctgatggctttaatctgcttttgacacttttaaaagagtcaagatcacttgtctctcattagattgtatcgcacactgcccattcagaggtccagaaaccacttcttcttcagaaatcttgtactgagaaatggaagcccatttctgatcacatacatgacccatgcttcttcagaaaggaaggcatgaagttgaagggggaactaagactgctgagttcttctgtcttcggccacaggaaactaactgattcatggcactttgtacccatgagctcatctagtcctcccagggcacaggaaagtggtgaaaataagtggccatggttcacagatttttcagctggtagaggctagttcctacacttaaaacatcagtagattgtcaaatgtgttccaactaagagcagtggaaggcagaaaggtgtataaaatatgggtcttaagaggtttataaccaagttaagggaaattaagagatcagcacataaatataagtatacaaaactgtaactgtatctgtagctatatgtgtgtgtgcatctatttattatctatctacctacttatctaataacataattaactaacatttatttgatatcttagagcttaacaagtacttttcctcatatgaagactcagcagatccccatgatgaatgtcaaacaaatggaatgttggtacagagagcaagcattctaggcattcgcagccgggtgagatcactgtggatggagtgatgggggaaagcttttgttgaggcagaaccagcaggaatgtggggtagtcacacaaacacagatacaattcctggtttccctactagacacttcccaggctctcaattgcttgtagtttttgtttgctttttttttttaagacatggtctcactctgtggcccaggctggagtgcagtgccatggtgtaatcatggctcggtgcagtggtactatcatggctcagtgcagtggtgcgatcatgtctcagtgcagtggtgcgattatggctcagtgcagtggtgcgatcatggctcagtgcagtggtgcgatcatggctcagtgcagtggtgcaattatgtctcagtgcagttgtgcgatcatgtttcagtgcagtggtgcgatcatggctcagtgcagtggtgtgatcatggctcagtgcagtggtgtgatcatggctcagtgtagtcgtgtgatcatggctcagtgcagtggtgcagtcatggctcagtgcagcctcaactgccagagctcaagcagttctccctcctcagcctcctgatttgttgggaccatgggtgtgtgccaccacatctggctaattttttgactatttgtagacacagggcctcgctatgttgttcaggccggtctcaaactcctgggctcaagtaatcctcctcggcttcccaaagtgctgggattacaggcgggagccactgcgctgggcccactgctagtagttcattttactttctaaaagataaaatgttgatgaagagttcttagtgatccatgttttctctccagtcctccaccaaaataacgcattttaaaaaaacaaactcccacatattttatagtgattctacaaatgtagaataatttggatactcttaatacaaaatggtttgagttacctttatttaataatcctgtgatgagcatacaatgacatacgtcaaataacttacaactcaggcttatataacatcggctctgccccaaattcctgccgtgtagaacacataaaaatccaaccctgcagtctgaccagtcttgcctaggttctccttacataatcataaccacttccctgccaggagcaattttaaaatgttcttctaaagccctgtgcacttcgccttggcttcctttaacttttcttttctctttttttttttgagagggagtttcgctcttgttgcccaggctggagtgcaatggcttgatttcggctcaccgcaacctccgcctcccaggttcaagcgattctcctgcctcagcctcccaagtagctgggattacagtgtgtgccaccatgcccggctaattctgtatttttattagagatggggtttctccatgttggttaggctggtcttgaactcccgacctcgggtgatccgcccaccttggcctcccaaagtgctgggattacaggtgtgagcaaccgcgcctggccggtttcctttaacttttctaaagagcttctacttttcttccttggcatttgaatttctttggcttcaagccacaaaaatgattgtccttaacttgaacagaatagatgagtcttgggaggatattgaatagctcacagaatcaaaggaaggccagagaatcaggctcaggagacaaagaaccagggtagctccagcggatgaggtagcaggaatcgacggtgttgtcctggctacctgctgaaatgagtaagtgacaaagggttttttccatcctttccattttgttcatcattcaaagccctagcagagagaatctgatcagcctagtctaggtaaaggctaggggaaaaagcacaccttaaccatagctcattaggaatgcacacaggtaattctccaaggaatccagtgactgttctcaggagaagagaatgcatgcaggatggtcaaacctcagaaaatatccaccacattcgcattttctcttacctccattttctactttttctaattatccacaacaggggtgactaacatatcttccaaggttgtgaaaaatatatagaaaaataaatctacctgtattggaatttttcccagaaaggattaatggttgggaaagtttggccctacttacccctcagtgttaaatataaggattaaagaaaatatatgcaaaatgcctattaccttacttggcatgtagcaaggttcattaaatgtcagtcccatttcaccccttcccattcacccactgttgtgctgaagccagctcacaccagttcatgagaagaatcattatagtttcaggaactttatgagccaactggcataacattggtagcttgaagttggcctttgtagagacagaaagatgtgattgctttctgcacccatcctgagtcatgaccaatactcccataacaaaagacaggcgaacaaaacaaaagcataacaaatttattttattttatgtatctatttttagaaacggagtttcactcttgcccaggctgtagtgaagtggcatgatcatggctcaccatagccttaacctcctgggctcaagcaatcctcctgactcagcctacagagtagctggaactacaggtgcagaccaccacacacaggtaattttttgtagagatggggtttcaccatgttactcaggctggcctcgaactcctgggctcaaaccatctgcttgtctcatcttcccaaagtgctgggattacaggtgtgagcccctgtgcccgaccaacaaatttatttcatcaaagttttacatgacatgggagccttcagaaatgaagaccccagaaatgctcagagaaaacaatttttttgattagtttcgatgaagaatggacagccaaggctgggtgcagtggctcacacctgtaatcccagtactttgggaggctgaggtgggaggatcacatgaggccaggagtttgagaccagcctggccaatataatgaaaccccgtctgtactaaaaatacaaaaattagccgggcgtggtggtgtgtgcctgtaatcccagctactcaggaggctgaggcaggagaatcacttgaacctgggagacagaagttgcagtgagttgagatcgtgccactgcactccagcctaggccacagaatgaaactctgtctcagaaaaaaaaaaaaaaaagaacagacagtcatgtagaaatgtgactgaacacaggctgggcacggtggcttatgcctgtaatcctagcacttagggaggccaaggcgggcggatcacctgaggtcgggagttcaagaccagcctgaccaacatggagaaaccccatctctactaaaaatacaaaattagctgggcatggtggtgcgtgcctgtaatcccagctacttgggaggctgaggcaggagaatcgcttgaacccaggaggaggaggttgcagtgagccaagatagtgccattgcactccagcctgggcaacaagagcgaaactccatctcaaaaaaaaaaaaaagaaaagaaaagaaatgtgattgaacacaaagtgaatggtcgcatgggaataggctgagggagaaagccagcagagcctgtctgttgggattctgcttggtctctctgtgcagcattccttccttctggatataggcagggactctccaaaataagggttttatgacctactattagaaaaggtagctcagtttttttttttttttttaatgagctgtgcttatacagaaaggcaaaggaaggctagagtaatagttctaagttttatgattggctttgggggaaagacattctggtttctttgacctgccttggaggagagaggggagcaggagaaggtcagaggcagactttacttctcaggtccttcccatgttcttctcaacttgccaaaacaccaaactctggggtatcattttctgagccccaacaccttgatggaagtatttacaccacagaaatcggaaatgttgcaagtcagaactttcacctacccccagccctccactgcctctgagagttaaacatttacaggccactgccacatctgctcctttctttccttcacaagttgtgagaagaaccaagttagcattaggttgacctgtgagtgacaaaaaccgaatagaacaatggcttcctagatggaagtccatttctctctgacagaaacaaagtccagagccaggcaggcagctcggggctgggacagctccgccttgctgcctcactgtctttgatgcatggctctttgtgatttaggatgactgctcaggctccatgttcaggccaaggggaaagagaaggacaaagaaatacacaccccatcctagtaggtccacagacagaagtaacccgtaacatttctgctcatttcaaataggttggaaggaagtctctctgccacatctggctgccagggaggcttagagccctgttgcttcctgcaggcagccatgtgccctgctgggggctgagaaggggaggacaggggccggggggcagctgagaagccaggtgggattcgagaacatgtaggggagagggagaactggtgttggtgtgatgggaatgagcatagtttgtggaactctgggggagctgactggaatagaaaattaaaaatactgacaaatgaggttaaataaacaaggtggaagccagagctcagtgagggaccaggaaagcagacaaaagaatctttatctgctgccactagacaccggaggcactgaactttccagcaggggagctacatgatcagaggcatttcagaaatgttaatctcacacttaagtgctagacagattggaggcaggaggaaaaacaggaagcagcagggaggttggaaaggagaattatttcataagccaggtgtgaggtgattatcggggaacctgccccattagtcacgtaggttcttttctattttcctaagcatcggccagtttgagaaataaagggacagagtacaaaagagagaaattttaaagctgggcatccgggggagacatcacatgttggtaggttccgtgatgccccgcaagccgcaaaaccagcaagtttttattagggattttcaaaaggggagggagtgtgtgaataggtgtgggtcacagacatcaagtacttcacaaggtaatagaatatcgaaaggcaaatggaggcagggcgggatcacaggaccacaggaccggggcgagattaaaattgctaatgaagtttctggcacaattgtcattgataacattttatcaggagacagggttttgagagaaactggtctgaccaaaatttattaggcaggaatttcctcttcctaataagcctgggagcgctatgggacactggggtctatttcacccctacagcctcgaccatagaagatggccacgcccaggggggccagttcagagacccacccccaggcgtgtattctctttcccagggatgttccttgctgagaaaaagaattcagcaatatttctcccatttgcttttgaaagaagagaaatatggctctgttccgcccagctcaccggcggtcagagtttaaggttatctctcttgttccctaaacattgctgttatcctgctcttttttcaaggtgcccagatttcatattgttcaaacacatatgctctacaatttgtgcagttaatgcaattatcacagggtcctgaggcgacatacatcctccttggcttacgagatgacaggattaagagattaaagtaaagacagtcataggaaatcacaagggtattgactggggaagtgataagtgtccatgaaatcttcacaatttatgtttagagattgcagtaaagacaggcataagaaattataaaagtattaatttggggaactaataaatgtccatgaaatcttcacaatccacattcttctgccatggcttcagctggtccctccgtttggggtccctgacttcctgaacagtgattacatggggacaatgggaatgaggaggaagaatgagaggcatttgctagaaaatgtattcaaactgatggctggtctgaaagggagttgtaggctggggtgatgagagacaggtctcatagcaacagggtaaacaaagtaaacttggcttggttggtgttttatttattattattatttttttgagatggagttttgctcttgttgcccagactggagtgcaatggtgcaatctcagctcactgcaacctctgcctcccagattcaagtgattctcctgcctcagcctcccgagtagctggggtaacaggtatgtgccaccatggccagctaatttctttatttttactagagacggggtttcaccatgttggccaggctgatctccaactcctgacctcaagtgatccgcccaccttggcctcccaaagtgctggaattacaggcatgagccacggcacccggcctattattattattattttatttcgagacagggtcttcctctgtcactcaggctgaagtgcagtggtgcaatctcagctttctgcaacctctgcctcctgggctcaagcgatcgatcctcctgtctcagcctcccaagtagctgggactacaggcgcatgccacaaagctaggctaattttttttttgtatcttttgaagaggcaagattttgctgtgtccagcctgtctccaggctggtcttgaactcatgagctcaaagcaatctgcccaccttggcctcccaaagtgctgggattgcaggtgtgagccactgcactcggcagcaggtgttttagattgggctaccttgaagcagaacctggggtggggacttttgttcaagagatacactgcgggaggctctcaggagaaagactgaagaaaacaggatagggaagggaaaaaggctaagcaaggatgtgagcttcagcctgagctcatggggaagctcagggcagcaaattgcaccagtcaattgcacttggaggcatgggggctggcgttttgtagatctgctttaaggtcaggcagccactgggagtctgtccagagtgtgtgcaagggaggagggcttggctcctgtttggcccagggcaattctccagaaaaggggacaattgtgtgtggttatcagctgatattcccaaaagctggaaagtgagtggactcactggtgaaaaggacctgagcccaaacagtgtccatgatagtgaatccattttggttgtgttggatttgaggtggcaaagaaataaggaactggcatgtgactgcgggaaattggagctacaagacaggagttcaggtgaaaagataggactaggtatgtagctattggagtgggggacttcggcgcacagatgatagggttttttgtttgtttgtttgtgagggtttttttgtttgtttgtttgtttgtttgtttggagagagggtcttgctctgtaaccctggctggagtatagtggcatgatcatagctctctgcagccttgacctcccaggctcaagagatcgtctcacctcagcttcttgagtagctgatactacaggtgtatgtcaccactcccagccaattttttaaacatttttttagagactgggggtctcactgtgttgcccaggctggtctcaaattcctgggctcaaatgatcctgctgcctcagcctcccaaagttttgggattataggtgtgagccatggcgcaggcctagatgatagtttaaacaagagggaatttgtatatttgtcactttgggggttgctggtggcctttgaaggaagagtttcacagcaggacagagtacaaaaccatatggtgacgtgaggtctagtaatgctttccacagttaatgtccttccattctgactaactcttaacacctctagggtactttctccttcgacttatgtgctgctcattctggcttgtcctctgtgttctggttattttttgttgtccaacaaattgcctcaaaattttgtggcatgagacaaccctttattacgttcacggattctgtgggccaggaatttggacacaccgcagtggggatggcttgtctctgctccatgttatctggggctgcagctggaagactcgaaagctgggggactgaaatcgtctgcagacactttgcagtggatgctggcagttagctcagggacctcagggtttctacctgtggtctagttagagtttctcttgcatagtggctgggttgctgtgagggaaccaggcatgaactgctttttttttttttgaggcggagtttcactcttgttgcccaggctggagtgcagtggtgcagtcatggttcactgcagccttgactacccaggcttaagtgatcctcctgcctcagtctccctggtagctggggctactgccaacatgcctggctgatttttgtattattattatcattattttgtagagacagggtctcactatgttgcccaggctggtctccaactcctgggctcaagcaatctgtccatctcagcctcctaaagtattgggattacaggtgtgagccactgtgcccagctgcattctttttataacctcatctttttttgatctgcatcacctccctcctaccctattggtcagagtagtcacagccccgctcccattcaaagagagggaacatggcccctacctggagtgtcagtcatgggacaaggagagcaagtggaaaggggcacccaactttggaaaataccatcggccacactctatcggagcctccatttgctttttatgagtggccttcatttatttagctgtcattgggtcaacaataacagcaacttgaggaacctcttgagggcagggatcaggcctgttacgtttgtttactttatctttatatcctgagcattggcccaggaataagtatctgtggaaggacgggatccttctaagtctctcatctatttttcatacacggcatcatttaattctaaactagctgtcattaccatttcacaattgaagaaactgaggcttagaggcgcaaatggtctctctcagatgactcaggtcttctgggttgatgtggcttttattaagaacttgttgtctccaacagcaaatagcattcctaggggctggggctgtttcttcaaggcccctgcctctgcaccctggtagcagcacaggcctagctgtagggctgtggacagcgtgccctcggctgcttactgactggttggcatttgatacatatgatgatttaacatgaagatttagtgtgattttgcatctcttcatgggagcagggtcaggaccaggtcctgttgcggaattcagctttggggctgggtagaagactgggatgaagttgctcctcatctctgtgccctggctatgagcaggcagcacctgggtcaggagtgtgaggtgagtgggtgatgctaaggagggttcaggtggagcagtcagactgtgctgagtaactcccctggaggggaagggggacgtggtggaggcagttcctggaggcccagctcagagcggagaaaggagccaattaccacctcctcccaagtcacatcccagccctgggaatacttcacaggctccggggaaatcccggccaagtggcagagtgggtggtggggtgcttatcactcatgatcaggagtgggtgggggcggatcttagagcttgcatcaggcctcaattttccaactcctgcctgtgatccacccccgcgcccactgcacaccaccaaccaacctttgactttatctctttagttgatttctcagagattgcagatcaggaagggcctttggaaaccacagcttccacttccgctgtgggggcagaaagcacgggacaatctaaccctttcgtgcctggaaagtaacaaggaggactctgcccttaccaggttcccaaggtcctgtaccagccccacagggactgctgaggggagctttttctctctggttcctcatcctctcctctactcaggtgtaggctgtccctgcctagttggtctgacagtagctccctgcgacttctcatatcacctccgactccccagcctcacctccacgggccctgatgcactggcttcggctgtgtcttttgtgagtcatccttgctgctttgttccagccccactgatgggcctcctgccctcccccatgcaggacttagtcaccgctcgtgtcatcaatccctctggaatgcacccctcctccagacacccatgctccccacatcctttattattttgttaaaactagcaatgccccccccaacccccatgattaaaatagtacatgtttgttgtgggaaatctgtaatatgcaaaatatacacaaaagagaataaaaagcaccaataattccataacccaaattagctaacattacattccggtggatttccatctggcattctcctcgccagaactccgtccagcttcaggccttcatgtgtgcttattgcttcttttacctgcagtcatgctctctgtctctcccctccttcaatctgtgagcaaatctactcatccttattattttaagggtcattctttcagagaaaccttccctctacccccaagctagtctctttattacacactcacaatacccagtacttttccttgtagcactcaccacaactagaaataaatcatcatttttgtcctcttgtgtttaatgtctgcctagctacctgacgtaaggtctgtgactggttttcttgtttactctgatggccctagcacccatcacagtgccctgtactcagaaaacatacatcatacccagatgccttcccggaataaccatgtgcctgtcttcccagcacttacaataatcaatttaacaaatataattaatcaattactatgtgcctggcttggtttcaggtacaggataccaagcaaaatgacccagttcttaccctcgaggaggtctcagtcttttgagggagacagatcagtaatggaagctttctaatgtacagctaagtaaacggtgatcaatagtgttaggtaaagtgtggaggagaggtccgtgaacaatcctggggagatgacaccattgttttatcttgttaatgcatttacttcacagaatcacaggataatggaattggacggcaccatgagatcagcaggcccatctcttcctgtacagatgaggaaactaaagtggtgaagggtagtgaagccacttagccaaagccattgggtgacagatctgggaatagaacttggatctttagattcccagcccagggctctttccactgtacctgggggcctttggactccccctcccctctcctcttattctgttaatccccaagtcctttgattttccccatgaaggtctctccaatctctccacttttcctcatccccacatcaccaggctctaagcctccaacatcatctccagcctgagcacctaccctcacctcctacctcatctctctgcttctagtcttgccctgctcagatgccttctccactctgccgccaaaatgagcctcacagatgtacgcatgtctgtccctggcttagaactccagtggcttcccaccaggcttttagaaatatactcaaaattcttatatggtgtattagtcagctcaggctgccataacaaaatatcctagacggggtggcttaaacaacagaagtttatttctcacagttctggaagctgagaagtccaagaccaaagtgctggcaaggtcagctttattcagactttcagagtcctcttttctttctttcttttattttattttattttatttttttattttttttgagacagcatcctgctctgttgcccaggctggagtgcaatggcgtgatctcgggttcaagtgattctcctgcctcagcctcccgagtagctgtgactgcaggtgcccgccaccacacccagctaatttgatacttttaatagagacggggtttcaccatgttggccaggatggtctcgatctcttgaccttgtgatctgcctgcctcggcctcccaaagtgctgggattacaggcgtaagccaccacgcctggcctctttctttctctttttttttttttttttgagacagagagagtcttgctctgtcacccaggctagagtgcaatggcatgatctcggctcactgcaaactctgcctcccaggttcaagtgattctcctgtctcagcttcctgagtagctgggattacaggcgcccaccaccatgcctggctaatttttgatttttagtagagacggggtttcaccatgttggccaggctgttctcaaactcttgatctcaggtgatccaccctcctcagcctcccaaagtgctgggattacaggtgtgagccaccgcacctggcccagagtcctctttacttcgttgtaggtggccgccattttgctctgtactcacatggcctcttcgtgcatgtggggagagagagctctcttgtgcatcctgttccttttataagaacaccagtcccatcagattagggcctcacccttaggacctcatttaacctgaatcacctaaaaaccctatctccaaatatagtcgcattgagagttaggggttcaacatacgaatttggggggacacaattcattccatagtgtagggtccactgggccttttttggttgagcccaccttaccagcctcttctaaacccaactcacctctctgtctgtacgcttttatatcttggaatttttttggttcctccgacttgtctggatctcttgtagctcaggttccccctccccctgctctgatgtttttatattttcatcattttcaagtctcagtttgaacattagcttctaggagaggccttccctgatctgcatcctgtgttaggtcctctggctatacatgcctatggtaccctgaactccaccttgtgtaagagtcaccacctcagtcctgtgtgtttcatatctgtccttctgagctccacaaggcaggaagatctctgtctggttggttgcagtatccccagggctagcacagtgcctggtgcctactaagcagtcaagattaacttttactggtagatgctcaatacatttccattgacctgagctgtcctcagagagtatatgtattttgttgtctaatttgggttgaaatctctcagaagggtcctatctgttccttacttgaaatctcctatcccgtgcccatcctgggctccttcattcaggaaacattcccataaatgattattaactgatctccctacaactttcccaacatgtatcacatttgaaggaacaatcatatttaaaagaatatgttacatagcaggacagtttattatgaatgtcatgtaacaacaatctactgagaattaaaaagaaactaaagtgttcctctcctctcccacctctgggcaaccaggacttcatttctttgaaattgtggatttcctgacccctgaggtgtttggctttttgtgtatgttttagaaggaacagaaagaatcaggctgggtggggctgtaaaggaaacccaccctaagcaggcctcgttttggaagagctggaaagatacctgtggtgccagatggtatgagagtacagggtgtgagggcaggagcctacttcttggttgactcttagacttccatggactcatggaaaagagaaggggtgcaggctgggcacaatagctcatacctgtaatcccagcactctgggaggccgaggtgggcagatcacttgaggtcaggagtttgagactagcctagccaacatggtgaaaccccgtctctactaaaaatacaaaaattagctgggcgtggtggtgggtgcctgtaatctcagctactcgggaggctgaggcaagagaatcgcttgaacctgggaggcggaggttgcagtgagctgaagtcattccactgcactccagcctgggcaacaagagcaagactctgtctcaaaaaaaaaaaaaatcagaatggtggttagtttggagtgaggtgggcaggaaagagggtgctacatattgactgcaagggaaacaagggagactcctgggttgaagctatcttgtctagatggtggttaaatgggtaaatataaatgtaaaagctcatcggtttgtttcctgctgatagccaattagttaattaatttaatttaaaaaaactaattggggccaggtacaccggctcattcctgtaatcccagcactttaggagactgaggcaggaggattgcttgagcccagatgttcaagaccagtctgggcaacatggtgaaaccctgtctctgcaaaaaatacaaaaattatctgggcatagtggtgcacgcctgtaatcctagctgctcaggctgaggcagaaggatcacttgagcccaggaggttgaagctgcagtgaaccattatcatgccactactccagcctgggcaacacagtgaaaccttgcttaaaaaaagaaaagaaaaggaaaaggagaaaaacatcaaactgcatacatttttaaaatgaaaaaaggaaacaaattactgacacatgcaatgacttggatgaatctcaaaggcattacgctgagtgaaaaaagttctcaaaagttacagactgtatgattccatttatgtgacacttttgaaaagataaaacgatagcaacagagactagatcaaaatagcaaaatagcagggagtttgtcgggggcaggaaagaggatgggactacaaaggggtagcccgagggagtgttttaggcagtggagctattctgtttcagtggtggtgattacatgatcgattgtggtgattacatgaatctttacacatgtgaaactcataggactgtccactgaaaaaaatcaattttactttatgttaatttttaaaataaaattatttttaattaagaagagaccttctagcccctcaatagcgcagaggagttcctgaaaggaggcgctaaggaactggctaccctggaaaaggcataccaccttccccgccttgccctgtaccaggcctggggatcttcctgggccctctgtggttctcactctccttccttgtcctcctgctgggccagagtgacccacacatcccctcctttagcatctaagtctcggggtctaggaagccagtgtgctttgctcactcctacgtccccggtccctgagacacaggtacgaggtggttgctcattgacagagtgaaggaatgttctagcaccaggcctgatccgtcttggcacactccacaggcttttctatgtttagcctcctttccagctgcccagaggacacgccatagctgggagacatcactgtcgaggtgtgggtcacaagcttacccctcccatgaggcagggttaccagctttcctatcgtttgaagaatttagcaatctgagtttattattgctgtcattctaattttgaaatacatttttattatacaagaaaatctgttcaattaaaaaaaaaacagttaaaaaaaaagggagatccggtcccacttcccagactcataactgttactagatccttctctatctatctagaaacatttatgtgaaggtaggcatgtatgtccacatatatgcaacagatatgattgccccacagctcctgggctacaagtaatgtcttgtttctttgtggactcactcaaatagactctgggtccagccctgcccaccactgactggaactccagtgtcagacagttttcaggctccctccctcaggtcatacaagatgcccagactgatgcagtactgatgaaacggaagagtctgttcctctggccacatggtcagcacttgccagctgcttgcccaggtcagtggggaccattatgagtcaggctgctggtggggtgtggtggctcacgcctgtaatcccagcactttgggaggccaaggtgggtggatcacctgaggacaggaactcctgacctaagtgatctgctctccttggcctcccaaagtgttgagattacaggcgtgagccactgcgcctggcctattctgacttctgttaccataaattggttttgtctggaaggtttctaacaattgtggtgcaagttttataacccacctggttttgtcttgggaattagaagtctctcaatgttttggagagagattctgatgcccctcaccagaagtcatgctctggggccagtgagcaaagatgagcttcttatcctttttcttcctgggttccagcaagccaagcctcacagcagtgtccaaaaagttggtagaaaaggcctaatttttttttttttttttcaggcagagtctggctctgtcgcccaggctggagtgcagtggcgcgatctcggttcactgcaagctccgcctcccgtgttcccgccattctcctgcctcagcctccctagtagctgggactacaggcgtctgccaccgcgcccggctaattttttttgtattttttagtagagacggggtttcactgtgttagccaggatggtctcgatctcctgatctcgtgatcctcccgccttggcctcccaaagtgctgggattacaggcgtgagacaccgtgctcggcctttttttttttttttttttgagacagagtcttggtctgttgccgaggctggagtgcagtggcaccatctcagctcactgcaacctctgcctcctgggttcaagtgattctccggcctcagtctcccaagtagctgggattacaggcacacaccacctcgccagctaattttttgtagttttagtagagatagggtttagccatgttggccaggctggtctcgaactcctggcctcaagtgatccgcccacctcagcctcctaaagtgctggtattacaggcatgagccactgtgcctggccaggcctagcatcttaaaaacccagtggaggggaaggtcacagtcctaggaatcaaaaggcatgggttcacttcctctctctgatatttgctgcatgttcttgaacaaactatgtaaacttcttgagcctcagctatttcatcagtaaagtgggaacagtaacatccactgtgattatcagacctatttttaaatacttgaggccctctttccttcaaagggtgtaagaaaattgaactttgccactccatttaactcctacccactaatccaggcgtggctacgtgacttactgaggccaattaaaatggtgccttctaggtggaagttttaaaagctagtgtatgcttttccacatttttttttctccttcaactatagtaattggtgatattccacatagtggctgctctgtcaacctgggtcctggagttaggacaatgacagctcagagcagagcctcggccaacccaccatggatatgtggcaggagagtcaatgaagctttgctgcataaaagccattgagatttgggggttgtttgttactgaagcataacctagcctgcttggttgatataccacattacacatttattactaagattatgtgaagtaaaatgtttggaacttcttggtacataataaagctgattttcttcctttcagactctccttttttctttctaagagtcatgaacccagggatacttttttttttgagacagaatcttgctctgttacccaggctggcgtgcagtggcgtgatcatagctcactgcaggcttcccctcctgatcttaagtaatcctctcccacctcagccttccgagtagctgggattgcagacataccctgccatacccagctgatttttttattttttgcagagacagggtcccactatgttgcccaggctggtcttgaactactgggctcaagtgatccccctgccttggcctgccagagtgctggattacaggcatgagccaccgcacctggcccccaggaatgttcttaccagcttctaaccctggctaaagggcaatagaacagagagccactcaaccacaaaagaaaaaggaagaagaaaggatataaagcaacaaaggtacagaaatgtaatacagaggaaaggaaaagaaacaaagtgataaagaaggcgagacaaagtataaaaacagggaagaaagaggtacagagggccaggcagggtggctcacgcctataatcccagcaatttgggaggcccagtcagatggatcacctgaggtcaggagtgcaagaccagcctggccaacatgctgaaaccccgtctctactaaaaatacaaaaattagttggccttagtggtgcaggcctgtaatcccagctacttgggtggctgaggcatgaggatcgcttggaactgggaagcagaggttgcagtgaggtgagagtgcgccactgcactccagcctgggccacagagtgagattctgtctcaaaaaataaaaaataaataaataaataaaaataaaaaaaaacaaaacaaaacaaaacaaaaaaacaggtataagggatgtctgaggcatagacagaggtgattctcagaaaaacaaaagaaaacaaaaggaaaaaccactgaggcaaagggaaactgtatttcttggaattgttggccccaaccccaggcaaacaacattttcccttaagacaaatgaacaaacaaactttggcaaatagagcttctgggtgtgcatttatcagtctttccactcggtttactgggcgcctactctgtgcctgacattgtgcttgggctggctttacaggggcaaccaagacctagtgctggcctctgccttcaaggagcccctagactggtgtgaaacagacacaagaacagttgggattcaatctggcttgtgcaatgatggaagtgccaggaggaattaagggaagagaaggggaagcaggccctgcaaaggggctttctggaaaatttgagcctgagtgtcttgaaggataactaggagttagcaatggcaaggtttctgaggagaaagagggaccacgatgggcagaggggcaataggagccaggtagctgcaggtagtctggggttgctggacccttgatgagaggctgtgggcagcaggagatgaggctggagagggattcagggtcctatcacagagactcaaatgttaagatgttggtctttaagtggatgggctcggggatatttgggctgttatgtggggaagtgacatggtcagatttttagctaaattgctctgcctgccatgtggacagtgtgttggggcagcatttctttgcatgaggtctctggggattgggctgaatacccacccagcccagggcctgcaagtggacaggatggcctctggaagaatcatcctagccgctgcttcatcagtgtctcaggggagtgatggctatctgcggtggtggcgttggggtaaaagaatttaccagccgggcgtagtggctcacgcccataatcccagcactttgggaggccgaggcgggtggatcacctaaggtcaggagtttgagaccagcctggccaacatggtaaaactctgtctctactaaaaatacaaaagttagccgggcgcggtggtgggtgcttgtaatctaatctcagctactcgagaggctgaggcaggagaattgcttgaacctgggaggcggagcttgcagtgagccgagattgcgccacggcactccagcctgggtgacagagtgagactccatctcaaaaaaagaaaaaaaaaatttaccaaggcagttgtaggtagagaaaggcagatttattacagtaattaggaaaacgccagggttgcagggaggtaacttgcatttttttgtcagctgggatgtctggaaagttgaagtgtttgatggtaagcaggaagtttgtgagttctgctatctgagtaggagctggggcttgtaaagcagccaacagttgagcctgccttttggctccgtgtttgtttttttcttagtcttgtcctccttattttgttcttggttataaagactgaggaggctaatttggtaattttctgcataggggtcatgctgtgttatacaagaaaattagatgtttctttttgagagtttggcggtagaatttgtcacaattctttacagcctagaggcaagtttgcaggaacggacggggtttgctccatggtgggactggaaaacatgccgctctggggcaatgtcaatcagggacatgaactgcacttttctgcggggggcatctcactgagatgaacagagggttccacttacatccacagagggacttggatgcactttccaaagggggcatcccaccaattagaaaagacctcctggccgctcaggggcctcatgctggatggccagtccaggcactcacttatgctgggtgatcagcccaggcacgaggaaaaagaagggtaaaggaagatctctacctggtcttggcccaggaggtggggtgggtaagagaagactcaccgttctgaggctgtctgacatcacctgatttagcaaggcccaggacaggatggctggctgactccataggtgaatttagagtgagaaagagagcgtctgagttacctaaaacgtgtgtgagtttgccccgaacaagcttctgctgtcaattgtgtcacatatagggatgagggacttgcaattagagaagatgggcaacagcctttctcccttccaggcagggcagctagccctgttcactctgggccttcaggcaacactggagagtggccctggccagttacctttgattgccagagagatactagaagctggttgctgaaagactgaaaaaagaaaaaaagtcaggtcactcacccaaaccaggcaatgatgatcagatgcttccacatggacagacacctttcagtctcactggagtgtagctctggccagagacctgcaattgtctttgtgcttagatgctgtccttcgagggtcccgagttgggaaagggaaaggagagagagtccctgtatggagagggagagttccctgtatgggccaccaaaatgtttcaggggagcaacggctatctgggctggcggctcaggggtaagagaatttaccaagacagttgtaggtagagaaaggcaaatttattagagaaagtagaaaaacaggagagcaatgggcaggagagcaacgggcaggccagcagaagaggagctgactgcaaggaaacaaaggcttgttggggattttgtaggatggctcttaggctgtagagtgttatgtgcagtactgattatgccagggtagcagggaggtaacttgcatttttttttttttttttttgtcagccagggtgtttgataaattgaggtgtttgatggtaagcagaagtttttgagttatgtacattatctgagcaggagggccatatgtcttgggccatttgcctcatttctttgctttcccctggtcccaccagcctgatttgttttttaattattactcaacagtgagtgctgtcacatgctgggcattgtgctatgtgctctatgtggagtaactcacttactgtccccctatcccccaagaccatcctgtgacatgggcattcttttttttttgagatggagtcttgctctgtcaccaggctggagtgcagaggtgtgatcttggctcactgcaacctccgccttacgggttcaagcgattcttctgcctcagcctcctgagtagctgggactacaggtgcgtgccaccacgcccaattaatttttgtgtttttagtagagacgggttttcaccacgttggccaggatggtctcaatctcttgacctggtgatccacctacctcagcctcccaaagtcctgggattacaggcgtgagccaccacacccgaccagacatgggcattcttatcctcattttgactgagtaactgggcacagagaggctgttatgcatcccaattgcagagctaggcagcggcaagcccactttcacacagcgccagctgcctggctctgggatcagcctgtagtcactctccattctgcccctcaggatctgcttctcccaggaagcctctcacagaggcagaattttgcattggcatcctgcttcaagcttatgaaatcttctatacagatgacctcattccagccttgcaataatagcttctgtgaggtattattattcatagctttaaaaaagccagttgaaggaaatccagtgatttgtcaaaggtcagaagttaggtggccgctctcctgctcagacttacgttttctgacttggagtacagtgctccgctctcacgttatctgtcagctgacgctgcagccagcctcatactcaacacatcacatggttcgaaggctaggccactttccactactattgagctgcctcctctctatgaaaatgcttttctggattgagggagacagtcatagagaaatgtgttgttggcatcgatttcctatggttgggcaatggcttccgccatctggaccaggtgacgtcagctatctggatttctgccagcattccccggcccaggaaacagacttccggctgtctgggctctgagccatcttcggcctcctgggtgagtgggtcttgcaattcgcaaagtgaggaactgaaaagtcagctctcagggaagatttcactgtataaagtcaggtaaaaatggggaagaggcatactgggtcagagagacagggagcccttctatctgagtctggggcctttctcagatgagaggggaggatctagtgatcagacagggaaattgaagatctttgtgactaagactcaagtcaattgggggtagatgaggagtaaggtaagcaaagctaaagaaatctggggaaagatacacataaagatacaaacacagaaggtcaaatactggccaaggatagaatgttgatcccaaaactcatgcacttttctgtggacactgagacttgaacaaatcaataacttgagaatgtaagcagccctctgccatgttatactttgttgagttatataacagttgggggaaaacctaaacaatggtacatgtgttaaggtagacagttaaattgtccctccaccactccctgtctcattcccaaccctgctctccaggccaggctcataaaagttgttactcattttagccattccttcagccaatattcatcttattcattcttacaatcaccctgtgaggtaagagctatcattatgcctttattttgaaaattgtagtaaaatagacatagaatttagcattttaactgtttgtaaacatacagttcagtggcattaggtacatccacattattgtgcaaccatcaccatcagccacattcagaactttttcatcttcccccactgaaactccacccagcaaacaataccttcacattccccactttccttagccctggcaaccaccattctactttctgtagaatgtaaccactttagatgccttttattttattttttatttatttgtttttttgagacggagtctttctctgtcaccaagccagagtgctgtggcacgatcctggctcactgcaacctctgcctcctgggttctagtgattctcctgccccagcttcccgagtagctgggattacaggaacacgccaccacgcccagctaatttttgtatttttagtagagacggggtttcaccatgttggccaggatgtaggtgccttttataagtggaataataggctgggcgcgatggctcacacgtgtaatcccagcactttgggagaccaagtctgatggatcacttgaggtcaggagttcgagaccagcctgtccaacatggcaaaaccccatctctactaaaaatacaaaaattagctgggcatgctgccgtgtgcctgtaatcccagctacttgggagactgaggcacaagaattgcctgaacgcgggaggcagaggttgcagtgagctgagctcacgctactgcactccagcaagattctgtcttaaaaaaagtggaatcggccaggcatggtggctcacgagtgtaatcccagcactttgggaggccgaagtgggcggatcacctgaggtcaggaattcaagaccagcctggccaacattgcgaaaccccgtctctacttaaaatacaaaaattagctgggcgtggtggtgggcgcctgtaatcccagctacttgagaagctgaggcagaagaatcgcttgaacccaggaggcgagtttgtggtgagccgagatcgctccagcctgggtgacagagcaaaactctgtctaaaaaaaaaaaaaaaggtggaatcataaaatatttttcctcttgtgattggcttttttttttttttgagatggacttttgttcttgttgcccaggctggagtgcaatggcacaatcttggctcaccgcaacctttgcctcccaggttcaagctattctcctgcctcagcctcccgagtagctgggattataggcatgcaccaacacactgggctaattttttgtatttttggtagagacagggtttctccatgttggtcaggctggtctcaaactcctgacctcaggtgatccacccgcctcagcctcccaaagtgctaggattacaggcatgaggcaccacgcccgatcatgattggcttttatttcacttagcaggatgtcttcaaggtttatccacattgtagtgcatatcagaattttctttttaaaaaaatattccattatatgtatatatgtattatacaattttttttttttttttgggtggagacagagtctccttctgttgcccaggctggaatgcagtggtgcgatctcagcccactgcaacctcagtctccctggctcaagtcaacctctcaccaccttagtcccctgagtagctgggactacaggtatgcaccaccatgcctggctaatttttgtgtttttggtagagatgaggtctcatcaagttgcccaggctggtctcgaactcctaggttcaagcaatcctcccacctcagcctcccaaagtgcttggattacaggtgtgagctaccaggcctggccacattttgcttattcattcatctattgatggacacttggatggcttccaccttttggctattgtgaatgatgctgctgtgaatgtgggtatacaatttaataacatttatattgagatacaattcacatactatataattcaccttgtaagaggtggaggttgcagtgtggtgagccgagatcatgctcctgcactccagcctggggggtacaaagtgagacgccatctcaaaaaaaaaaaaaatccaccctttaaaaatgtacaatgaaatgtgttttttttttttttttttttgagacagagtctcactctattgcccaggttggagtgcagtggctcagtcttggctcactgctacctctgccgccctggttcaagcgacactcctgctcagaccagagtagctaggattataggctcctgccaccgtgcccggctaatttttgtatttttagtagagatggggtttcaccatcttggccaggctggtcttgaactcctgaccacgtgatccacccacctcggcctcccaaagtgctgggattacaggcgtgagccgccgcacccggcagaaatggtttttagtatattcacagagttgtgcaaccatcaccacaattttagaacattttcatcacactcaaagacgtcccatgctcattagcagtcatttccggttttacccccaatctctccccttcccagccttaagcaaccactaatctactttttgtctctatagatttgcctacactggacatttcatataaacaatcatacaatatgtggcattttatgtctggcttctttcacttagcatagtgttttcagtgttgtagcatgaatcagtactttctttttattgttgaatactatttcattgtatggatataccatattttatttatacattcatcagttgatggacatttatactgtttccaaattttagctattatgaataatgctagtgtgaacattcatgtataagattttgtgtggacatccattttctctttggtatacacttaggagtggaatttcgaggtcattaactttatgttccacttttgagaactgctttccaatgttgctgagccatttgacattctcaccagcagtgtatgaaggttccagtttctccagtctgtctttttgattctagccatcttagtgggtatgaagtggtatttcatggtggtttagatttgcattttcttggtggttaatgatgttgaatatctttttttttttttttttgagatggagtctcgctctgtcgcccaggctggaatgcagtggcacgatctcagctcactgcaacttctgcctcctgggttcaagcgattctcctgcctcagtttcctgagtagctgggactacaggtgtgcaccaccactcctggctatttttttatatttttactagagatagggtttcagcatgttggccaggctggtctcaaactcctgacctcaagtgatccgcccacctcggcctcccaaagtgctgagtcaccgcgcctggcctgaacgtcttctcatgtgcttattggtcatttgtatacctttggagaaatgtttattcagatcctttgcgtattttttaattgagttgtctttttattattgagttgtaagagtttgttataaattctaaatataagtctcttaactgatacataatttacaaatattttatcccattctatgggtcttttttacctgtttctttctttctttcttttcttttttttttttttttttaatagcgacagggtctcgctttgttgcctaggctgatctcgaactcttgggctcaagcaatcctcctggcttggcctcccaaagtgcttgggctacaggcatgggccaccatgcccagcctattttcttaatgtcctttgaagcacaaaagttttaaattttgaagtccaatttatctatttttttttcctgcttgtgcactgtgtcatagctaagaaaccactgcctagtctgtggtcacaaagatttacatctgtcttttcttctaagaatttaatagttttatctcttccatgtaggtctttgatctattttgaataaatttttgtctatggtatgaggtaagggtccaacttcattcttttgcatgtgcatatccagtggtctcagcattagtatgccttgttacggaggaataaattttcagcttcgtaagaaaaggaccatgggcctggcaaggttgcttatgcctgtaatcccagcactttgggaggccaaggtgggagcatcacttgagccctggagttcgagaccagcctgggcattagagtgagaccccgtctctacttaaaaaagaaaaggaaagaaaagaaaaaggactgtgcccggttttgctcaccattatcttcccaggattctcttagccccatgcaagacacatgctacatgctcaataaatatagcctgagtgagtgaacatatgagtgactgagactcagtgtggttaaataacttgcataggtcagtcagttggaaggtggccagatatggctcaaacccagatcttctcatctaattcttttttttttttttgagatggagtcttgtcgtcaggctggagtgcagtggcatgatctcggctcactgcaacctccacctcccaggttgaagcgattctcctgcctcagcctcctgagtagctgggactacaggcgcgcaccaccacgcccagctaacttttgtgtttttagtagagacagggtttcaccatgttggccaggatggtctcgatatcttgacctcatgatccgcctgcctcggcctcccaaagcgttgggattacaggcatgagccactgcacctggccttctcatctaattctaattaagagtttttgtataatacttcaaagtttctgaaaatttcctgagttaccaaaagctctttgtcacaagaaaccatatttcttaggctgggggtggtgctcacgcctgtaatcctaacactttgggaggctgaggtgggtggaatacctgaggtcaggagttcgagaccagcctggccacatggtgaaaccctgtctctactaaaagtacaaaaattagccgggcgtggtggcaagcacctgtaatcccagctactggggaggctgaggcagggaatcgcttgaacccgggggcagaggttgcagtgagccgagatcatgccacttcactccagcctgggcaaaagagtgagactccgtctcaaaaaaataaaataaaataaaataaaataaaataaaaataaaaataaaaataaaaaataaaaagaaacggtatttctccaaagtttcatttgctgtctctgctgtatgatcccaatcatttcattgtttgtgagcagcaaaactcaaatctagggagcctcatgtcccttctgcttctgactcctccctcactcgagccacagagtcaaagattccacttccttctagggtagttttatagttggaaagttcttctaaatctcggaccacaacctcctgctgcaaaattgtgccataaatccccatgagtgttcagtgtaaccattgactataggacctggtttgatgtgggaggcatttggggcttgcggaaagctttatgtgctctgccccgtacaaagggcagccttggggcagccgatgcccttgctctggccctgacatgctgctccctttttgaagtgtggtttctgattctgggtgcagcttgccatatcagaggagaatgaagctaggtggcatgaaccccagaaaattttggtgaactcacctcttggaatgaggacaaaggagagtcttgaagcagaaaagagctgtgctccttgaaggggtccaaagttaaagctcacactggggtggattgggtagacttacctgtcccctctttgacagtgatgcatttgagcttctcctattgggtcctttggaaaagaattctttgaactactagaaaattaggacagggtgggggcaaaagaaaacgtatattgagagcttgctccatgtatttgttaggcatttaatctaggtatctaattttatcttcaaagtaatcctgtgggttggttttatcaatcctattttgcagagttggatgctgaaacttgcagtcacacaaggacttgaacctagagcttttctaaagcccgtactctttccagtaccctgagccaggggagccagcgggcagaaatgacgtgtgaggtaccctctctctcttcacttccatgtgatctgttactcattttgtcaagacatcctgggtcccaggtaagctccagtgattcccctgaaccagtggtgtgctggagccagctcagacctgctagtgagagtgttaaatattcaggaaatttgcaagctggttgttaaactgtcagtggttggaaattggtcatgggaggaagtatctacaccacggaataactacacacggataactgctacaaatcagggatccccatctcccccacaagctggtttgctaacacatcactgtctttcttttttttttttttttttttgagacagagtctcactctgtcgctcaggctggaatgctgtggcgtgatcttggctcagtgcagcctctgcctcccaggtttaagcaattctcctgcccaagtagctgggattacaggcacgtgccaccatgcctggcaattttcgtatttttagtagagacagggtttcgcaatgttggccaggctagtcttgaactcctggcctcaagtgatccaccagactcggcctcccaaagtgctgggattacaggtgtgagtcaccgcgcccggcccagagcactaaccttggggtccagagtgagagctgaagagaacagggcctgcccccagcagtcacagagtttcagctgcagactgagggaagaccgatagtatctatgggaaagtgtgtgcacaaaagagacagaaaagaggctggagaatattgattattcacacatgaacaaagtaagtaccaatgttattaatcccagggattttgctgggaggagttctggcttgttattagggtccttttctttcagatcaagaaaagggagatctaattcatgaagaaactagaaaagtgccctggattggtgggagtgtggtgggggtggtgctgcacaacacagaagaggggaactttgactttgagcctgaggtcttgggatgaaaagcagtttgtggaccggattcctgaccctggggttacagtaggaatccctttgcctgacaggtggtgaccttcctctggcaaggtccccagactcctaaggcagaagcaatcctcccatctcagtctgccaagtagctgggactacaggtgctcaccaacacacctggctaatttttgtgtttttttggtagagatggggttattccaggctgggatctgtgaagagcagaacaactctaagccccagggcaaaaatctgcagagctgagtctcatgccactttggggcactccatctgaggcctggaatcagaggccttccgcagcttgtgtagatgctgccaaaaggctgagctcggtggcccatgcctgtaatcccagcactgtgggaggctgaggcaggcagattacttgaacctaggagtttgagaccagcctgggccacatggtgtacccccatctctacaaaaaatataaaaattagccaggtgtgttggtgagcacctgtagtaccaactacttgggaggctgaggtgggaggattgccccaggggtttgaggctgcagtgagccatgatcatgccactgtactccagcttgggcaacagaatgagaccccatctcaaaaacaaccaaaaagatgctgcaaagaaacagcagcctcctgtaacaaaataagtggtacatcttttgtgatgggagcatctccctggggagcgaagctggacgttgcagccctaccctgtccccagaggtttttctgtccctttatgtctatgaacaagtacagctgaggccatcagcactgcacacacctggaacagtcttgttaaaacaggacctccctaaaggccaagagctaaggaaagagaaagtgaaggactgagcagcaggtaaccagaatcagagtcattgaaggcaactgcaggagttgccccttcctggctccctcccatggcaactccctgagtctgagtagagaaggttagagacgcatggaggttcccacccctcctgtgaaaggctcccttctgagttccaggtccctatctgatgacccacctcacctatgcctgcctaatacctgaatggccatctctttcagagaccactcttattcccaggtgtgtgacctcctcctacagactacagtgggaaagacaccatctccaggtaaccccaacacagtgaggggtggagcggggatgtggtcattcgttccaggtattgttgattctcttgaggttcaatccagggctagagattgtgattaaagagatacccagattgggtatgcgtgtaaagggcaagagctatgagaccaatgtgacatttaggattaattagtcccttccacagggcaggctgccactcactggtacagctcctgggctgagcctggcagagctcattagcaaggcagacactggaatgtgtgtgcaatggagggaggcttaaactcagaggctgctggttcctattaagcagagagaggttagaacttagtggcacagaaactgatatcagctaaatatgggttagtcaccaaccctgcaccatcttccctaacctttgagaaagtcttttcctactgcttgttcacatccattcattcaacaaacaattatgaattttctcttaggtgccaggtgctacacaagatactggctatagcagcgaacaggacagcccgtctcatcctcatggaggtcacaggacaatgagaagaaagacttttttatttttatttttttgagacggagttttgctcttgttgccgaggctggagtgcagtggtgtgatctcgactcactgcaacctccgcctcccaagttcaagcaattatcctgcctcaggcctcttgagtagctgggattacaggcacctgccaccactcctggctaattttttgtatttttagtagagacaggggtttcatcatgttggccaggctggtctcgaactcctgacctcaggtgatccacccacctcggcctcccaaagtgcagggattacaggcatgagccatcgaacccggcccaagaagaaagacattgaacaagtaattacagggtattgggtgttatgaaagaaaagcatggtactgtataatgaggtcatctaatttagtctggggtgacaaggaatgcctactaaagaaggtatcgtttaagacatacctggggaatagcggtagtgaaaatagaagctccagaaatgcagggaccatggctgacatgtttaccatgccagtgtctggcatggaagaggcccaattcctttggttgaaaggatgaagtaatctagctgaataaagggtgtgtgcgtgcacgcaggtgtgtttgtagttaaccttcctttagctcagcttaggaaacagcttttgtaaaactgcgtaactagtagtaggtgagagaggaatacgaatgatatacacaccattaaagacaacttactaacagcatgagtccgacatagattccttcctacttgggtttgaaccctgagcccaccacttactagctgtgagaaagtgaatgagttgcctccctttcctgtgcctctgtttcttgtaaattctatttccaagcatcatgaggataaaagacaatgtatatacgttgtttggcatattacagtcaatgcttggtaactactattgttattttttaaaaaattattattattattttttgagacggactctcgctctgtcgcccaggctggagtgcagtggcgctatcttggctcactgcaagctctgcctcttgggttcacaccattctcctgcctcggcctcctgagcagctgggactacaggcgcccgcaaccacgcccggctaattttttgtatttttagtagagacggggtttcactgtgttagccaggatggtctcgatctcctaacctcgtgatccgcctgcctcggcctcccaaagtgctgggattacaggcgcgagccaccgtgcccggccccactattgttatttatgtacaccaaatttatatccaaagggactttgatagttacaagaaaagacatataagtccagatatcattgaacaagagtaaaataataaatcaagtaggaatggaggggaggatatgcatgcagcactagataatatctatacagagagaggatgaggtcttggaagatgagtctgaagactttcctgttggagaggggctctatgctcggcatgctgactgcttttacaaccccacccccacatctcatcttaaccacaagacagtcttgttctggggagttcagagcctttattttttatttatttatttattttttgagatggagtctcactctgtcaccctggctgaagtgcaatggcatgatctcagctcactacaacctttgcctcccaggttcaagcgattctcctgcctcagcctcctgagtaactgggattacaggcacgtgccaccaagcccagctaatttttgtatttttagtagagatggggtttcaccatgttggccaggctggtctcgaactcctgacctcgtgagctgtccacctcggcctcccaaagtgctgggattacaggcgtgagccactgcgcccggccccagagtctttatttattatttagagagggtctcactctgtcacccaggctgtagtgtagtggtgcgatcttggctcactgcagccttaacctcccaggctcaagcaatcctctcacttcagcctcctgagtaattggggccacaggctcacaccaccatgcctggctaattttttaaaaaaatttttatagagacaaggtcttgccatgttgcccaggctggtcttgaactcttgggctcaagtgatcctcctgcctcagcctcccaaagtgctgggattacagacatcagccaccgtgcccagcccagaatctttcaacccccaaaatccattggtgtggggttagatgagggatcctaaaaggagagggaggctgctgtgcagtgatcccaccggcctgcttgcaggaaggagagccgaccctttcttgacctctaccaaagacactagagagctttgtaaatcttccaattagatgatacataaatacttccccaggtcttctaggcctgattcaataatatttacttcgagaggctgctgcttcctgtttgtattctcttaccacaagttatctgctgttcctactttcacttaagctttgtatcgtactctgtgagaaatgtttgagctggctggacacatttcctgaaatcatttctctagtcttttacgaaatgtctgcatttatgctggaatcatagagctgaactatcattgagataaaaattccagtctttaccccaatttacaattcctaaaaactgtcactttcttagatctcttcacattttcattacttctttttttttttgttttttgttttttgttttttgagactgagttttgctcttgttgcccaggctggagtgtaatggtgcgatctcggctcactgcaacctccgcctcccagattcaagtgattcttcctgcctcagtctcctgagtagctgggattacaggcgcccgccaccatgcccggctaatttttgtatttttagtagagacagggtttcaccatatttggcaggctggtctcaaactcctgaccttggcctcccaaagtactgggattacaggcgtaagccaccacacctggccagacattttcattgcttctattacctgtgtaagcaagtggctttattgggaggcgattttcacaaagaaacaaggttttttaaaaaaggtgtttcccgtaggtttctgcctgtgagaccacctgctgagaaatgcagagccgctttgggaagctgggtagtcagctctcatccatactcactcaaccatgcccagctgggcagtgccacttgtgtctgagcctcagcaaaactgcatgtccctaaatgtcaggggtcttcacagacaagtgaagcaaccagaaatactgaattttcagatggacatgtttatcgtactgaatctccatagccaggaggcacagacaactaataaagccctgtgccccattattgcttcattgattcactgaaataatgctgggtatgattgtggctacagagttaagccccattgttaattatatggtttggtgagggaaagagttttttttgtttttgttttggctagactaatgtaaacacagttcaaatgttgctccttcactggggacagaaaaatccatatgtggctcacgcctgtaatcctagcactttggaaggccaaggcaggcagattgcttgagtccaggagtttgagactggcctgggcaagatgacaaaaccctgtctctactaaaaataaaaaacaaaaaattaatttaatttaaaaaactgaggtgagaggatcacctgagcttggggatgtcaaggctgccatgagccatgtttgtgccactgcactccaccatggatgacagagtaagaccccatcttaaaaaaaaaatccacgtaatatagttcacatctttgcttcccatgtaaattcctcttttttgtgtgtcactatcagtatgtaattattgaaacttcaaggtatgactcttgttaggaaatgatagagaaaaaacaattgctctataatcaccccttacattgtgacttcttgcaaataaatacaccccactttcagcctcactcatttattataaaattgtaagaggtggaacaagcctttgtttagagatgtgattcatgtgttgcttgctggagtttctgaaaacaaacaaacaaacaaaaaaacccaagatagcagatggccagatgagccactgggaatggagcaatggctggtcatggcttctgtcaaacacaaagctctgactggagaagcttggaatcttctggatgtcttttgcaaagatgacaaattcttttagataggctgctgcttgaaggtaagatggaagaagctttgttcattgtattatggaggtctttgacccccacctcctcccaccccatgaactcagaccttccacattagacctgggctgtccctcagcatctttgctgcacattgcatgaaacttttcagttatttcatataacttccaggtgtttgaaatacgaaatgcgtaagagacatgttcctgagatgtcggagtgaggtttcctttgagagaaggaagtgagggttgttgcctacagattgttgagggtaataatgggatgaggcataaaaaggacctagcctagcagcaggcatgtagtaagagctcagtaagtattacatttgtttaattagtgtctgcctaccaggttcaacccttggcttcatatgtccagcaacacttcctaacttgcccattcttgcccttccttgggtcctgctgtttattctgttctctgaaataaggagttcctcccagtattgtagctgataaggttagagctcaaagcagttagggacctcaagaggtatcctagtctggttcctggtctagataaaatattatcccttattgcagaagtagcaactgaatctaggaaaggttgagtgatttgagagactatagtaggcataggtggggatattggctaattcttagttcttctgacttaggagcatctaggtcgtggacacagagtgtcccttttttcaaagtggagtcccacagtgcatcatttacagttattctagctgctggtggtatttggaggagtatcctaaacacttctctttccaaatcacaggcccagttgggatcaggaacatcaactcatatcacatgagcagaacttgttcatttggggacatccccaataatgccaaaatctatgctccagatgagtaagagtatgaattggaaccactttcagggaacctcttgtctgcacctcattctgtttttatttatttatttatttatttatttatttattatttttgagatagagtctcactctgttgcccaggctggagtgcaatggtgctatctcagctcactgcaacttctgccttcctggttctagtgattttcctgcctcagcctcccaagtagctgggactacaggcacgtgccaccacgcctggctagtttttgtatttttagtagagacggagttttaccatgttgaccaggctggtcttgaactcctgacctcaagtgatctacccaccttggcctcccaaagtgctgggattataggcgtgaaataccacgccccgcctgcacatcattctgggtggctgaatcctccactctcctggttctctcctctgtgctggtaggaggggaggctgggagagaatgggagaggtggtcatgatcagtaaagagacaattggagggagatggtccaaccctgtggttctggactctgaagtggtctttactgaaaacagcagattcctaggctcagaacagtggcaaaatagcttggaatttaggggtctctgatttttttcagattctcccaagctggagtgcagtggtgtgatctcagctcactgcaacctctgcctcccgggctcaagtgatcctcccacctcagcctcctgagtagctgggactacaggtgcatgccaccacacctagctaatttttgtagttttggtagagatcttcctgtcttgcccaagctggtcttgacctcctgggatcaagcaatctgcctgcctcagcctcccaaaatgctgggattgcaggtgtgagccaccgtaccctgcctcatatattttgtttcgtaataagtttactttaaatcaagatcgaaggccaggcacggtggctcacacctataatcccaaaagtgtgatttcagaatacaaaatttgggattataatttgtaatcccaaaagtgggatttgggcatgggccaccacacccggctgattttttttttttttttttttttgatagagacaggttttataccacattgcccaggctggtttcgaactccttgattgaagcgatctacctgccttggtctgacaaagtgctgagattacagatgtgccttgcctgacctgattattgttttttatatctcctttaatgtacaggttagctctctcattttttccccctcttgaaataggtttgttggagaaaatggattttttttgtactgtacagctttccagtctgggttttgctgattctaccctggaggtgctatgtaagacactcctctgatcgctgacttcttgtgaattgctaatttcatctagaggtctgatcagattgaagttcagtgtttgtttttgcagggccccttctcagggaatgttgtgaacattcacccagaggtacatgctgtctgcttgtgtccgtctcttttggtgatgttctaagtcattcgtgatcatcgactaatccattatttcattaggagttgcaaaatagtaatattggaattctattatttctttcttcatttatgtatttattcttttttctcccccacacccactctcctgccctgctcgctcctttcttcagttattaggtagactgcttgtgtaagagaaattgcttcatcaaccatggggttcagttatggtttctataggaaaggcagaataaaggatttctctttattaccagttttcaagttgttgagttggttacgtagagtccttcacaagtgaccaattatttaagataccattatgaaatcatggattgaaacatatttgatgtacttcagttcactatagtccattatagtgattagtcttatgaatgctcaaattgtcccgtctttggcaagtgggagtcttttcacctctttctgacacagtccaaagagactttgatagctttttgagtttctgatttgaccagatatcgaagcacatcttgtacatttccgttcccagtctgagagccaagcatttctttaagaagatctgatttcagttgaagggaaatgatagactgccagagatgcttgttgctgctggattggttcttgtttctagggccttttagtgggaagaaaatataaacatattttaaaaataaactcattgtctgtttatactaatactttctttatttttttaaaaatttttttaccagctctaggatcaaggaaaaagatactttccattcaaatagaggctctcagtgtttttatataacttcacatacttgcatctgtttttttctcccaaccaaatattctagtttccaaatccaccaacgtttgctttatccctcaatacttatacacagtcttaaaataacaacatcaatattatcgccattaatatgataatgcttttccatgaaagggccatacatgcaaagtggcccccaaaggtcaaaggagctgagaaaccaaagaacaaggtaggcaagtccagtttgttgctaaagcgtgtttcactggggaacttacagacggaagcctgctcttgggcagctgcaagacaggtggatctcacactgttatctcagacccaaggcttatttatataccatagggaaagagtatatgtgcttagtgcaagacaaaggcaactgtccagaacaggctagaatgctatgtgcgtcacagcctataatttgtgtgataacatcaaagttgatatattcttacactagggacagtaaataaagtaggaatcaggaggcgttcctgggactggggctaatcagatgacgacatggtggattagcatccaagatggggccacttttgtctccacaataaaactattctttcagttcctttttttttgtccttagggtatatctcactaggaatatacaatcaaattgcagtggtctaaagttgtttgagacagtttttctctctgtaattgtatcactaactcactgtgcggatagtcttttatttttgcttttgatttttagaaatttaaatatatacatgtatatattcttagatatagagtagcatccagatttccccacttctcttttttttaaatgaacattgggataaaattgacatacagtttgacctttctttacttaacaataggtgctgtcaatcagcccatggcagtatgtagagatatttattctttttttaatgctccatagtacttcatatttaatttagtcagtcccttgttgttagacatttgggttatttccagtatttatttatttatttatttttaaaatttgaaatagagatggagtttcaccatgttgctcaggctggccttgaactcctgggcttaagcaaacagcccgccttggcctctcaaaaagtgctaggattacagccaccatgctcggcctatttctagtcttttgttatgacaaacagagctgcaataaatagcctacacaaatactttttcatatttttgccagtgatgttttggaatagtttcctagaaactgtattgctggaaatgcatatgtaattttgctagatacagccagtcaaattcccttccatagagattgcctcattttgcattcctagtcacaatgtactagaatgcctatttccctatagctttgccaactacatgtattgacaaatttttggattttttgccgatctgataggtataatatgctaccttaggatagttgttttgtttcgtttgttttgttttttgtttttgtttttgttttgttttttgtttttttgcgattctcctgcctcagcctcctgagtagctgggactacaagtgagcgccaccatgcttgactaatttttgcatttttagtagagacggggtttcaccatattggccaggctggtcttgaactcccgacctcatgatccacctcccttggcctcccaaagtgctgggattacaggcatgagccaccatgcccagccaaaatttatcactctttctcttcaattgcagctgaagatttagccatagttatgcaagtcttttccactcccaagctgtagaagaatttatttccctttaatattgtgtggtttttgttttttaaagtctcatatggaatttatctttttgtatgtatgctatgataagtggaccaacttttatcttttttcatatagagtctcaaatttgatattactagctcctctctcccactccctcccttcagcttgatttttcctggacattttattattttcttggccaaagctggacatggatcaaaataaacgtctgttcaactccctgtgtttggttccattttgctgcctgtttttctttcctggattctttgtgatttcagcacagtgtttttccagccattcaaggagttatgacctttagggcttgaggaagagtgcattaaaggcctgtccagagaatgattcaagctggagtggatcctgtagacgtccaggagggcccagctctacttgggccagggggttggagagctgcttctcaggagcaggatagccactcacgcgtgtgaagcactcaggagcccagttttttgtgtttttgttttttccttgagacggagtcttactgtgtcgcctgggctggagtgcagtggtgtgatctcggctcactgcaacctctgtctcttgggttcaagtgattctcctgcctcagcctcctgagtagctgggattacaggcgcccgccaccacacccagctaatttttatttttagtagagacggggtttcaccatgttggccaggctggtctcgaactcttgacctcaggtgatctgtccagcagcctcccaacgtgttgggattacaggcgtgaaccacggcgcctgtcctggagcccagtttttgttgataacccatgtttcctgtttccacccctcccctgctcttgatttccattaggaatttctacctttctaactggaaaagactggggtcagggggtggagaagtgggcagaggaagggaggagtggaatacagaaattgaaacctgtcttactctgctcatgtaactcttagcgcagatccatatcattaatgccaactaccatttagtggttatttcctaccaccacgcatcagatactgcgctaagtactttatacagaataaatcatttcatcttgacctgttagttggctagggtggttacttccagaaggaaaaagaggcccagagataagttcacacaattggtaagtagtgggatttgggtctgtgtgacatcagattccaggctcaaaacgtctaagtttgtggcctccgcaaaaaaggctcataacagtctgtatttctgtttgcttttccatctaaagactaactttactccacttcactgcccagatctgctgagctcagatgtgagcagtgtgcttggctgtgactgcaggcatcatgctaggctgtagggacccgtggctggagaggggctccgtcttgccctccgtctgttctgttgccagcacagtgcttggcacacgtgggctctcatcacgtatctgttggataattagatgaaaaaggaggaggaagaggaacgtgtgctggagataaagcggcaggagtggaggaggcgcaggggaagagaacagatttgggaaaaaccagtgggacatgaggatgctgggcaggtgggtagaaggttgccatgtgttcagaagcacagaaaaagggtgacttccaggtcaaaagtgatttcaggatgggtgtgatggctcatgcctgtaatcccagcactttgggaagctgccggacggatcacctgaggccaggagttacagacttgcctggccaatatggtaaaaccctgtctctactgaaaatacaaaaattagcaggtgtggtggcaggcacctgtaatcccagctactcgggagggctgaggcagaagaatcgcttgaacccagcaggtgaaggttgcagtgagccaagattgcgccactgcactccagcctaggcggcagagtaagactgtctcaaaaaaaaaaaaaaaaaaaaaaaaaaaatatatatatatatatatataaacacacacacacatatatatacacacacatatatatacacatgtatacacacacatatatatatacacacacacatatataaagtgatttcagttttttcacaacttgatcactgagcaagtgacttagactgtggtcattttctgttaactcttatctgatccaactagaaagcaaagcaaaacaaaaacctgactgccttctacagacaagccaatgtgaaggtattcagctcacacaggttgcaaaagacagagaaacacccaagttacctcaggggatggacattccctaaggatacacaggtgagtaaggaaaataggaaatggcttctgtaggtctcaagaactagagcaccattcaggatgcgatggccacacacagtgtggcctggcagagaggaggaaactgctctccatcatcaagaatacagctctaggccgggtgtggttgctcacgcctgtaattccagtactttgggaggctgaggagggtggatcacctgaggtcaggagttcgggactagcctggtcaaaatggtgaaacctcgtctctactaaaaataaaaataaaaaattatccgggcgtagtggcgcatgcctatagacccagctactgaggaggctgaggcaggagaattgcttgaacccaggaggcggaggttgcagtgagctgaggttgtgccattgcacttcagcctgggtgacaagagcaaaactctgcctcaaaaataaagataaaaataaaagccgggcgctgtggctaacacctgtaatcctagcactttgggaggccggggtggacagatcacgaggtcaagagatcgagactatcctggccaacatggtgaaaccctgtctctactaaaaatacaaaaattagctgggcatggcagcgcgtgcctgtagtcccagctactcaggaggctgatgcaggagaatcgcttgaacccgggaggcggaggttgcagtaagccgagatcatgccactgcactctagcctggcaacagagcaagactccatctcaaaacaaaataataataataataaattaaaaaagaaaatacagaaatttggctgggtgcagtggctcatgcctgtaatccctgcactttgggaggccgaggtgggcggatcacttgaggtcaggagttcgagaccagcctggtcaacatggtgaaaccctgtctgtattaaaaatataaaaaaaattagccaggcctggtggcaggtgcctgtaatcccagctactcaggaggctgaggcaggagaattgcttgaacctggaaggtggaggttgcagtgagctgagatcacgccactgcactccagcctgggcaacagagcaagattctatctcaaaataaataaataaataaataaataaaagaatacagctcttctagttcccagcccctctggggttcttgtgtgaaagaaaacattttaatgtgtcctttgattacatgaaattcaggcagagtctgatcaaagagatgccccattgctgagcacagtgaagagaaaggatgtcttccttgagcagagaggtggtgagaaatttccagaatagggcaccttgcatggagattattttaggaatgtcatctctggtatggaattctacttgtcccctgtagaattctgggctggcctacccatggttcaagcttccactgaagctgtgttgacccctagtccagtgtcagctggtaaaggaagggaagggctgaaggagctggacccccacagggaggtgttgaaagaaaggagaagcaagaggtgatattgaccagggaaatggcgccacttcctgagccagggccctggacttcctgtagttgtagaaaagtgcaggcctgagttatttaactatcaaagaaaaagtgatgctctgtgtgtgggaaaaacaacactcaatgtgctttttcctactctctcactcacaacaatcattaacacagaaggcttctgtgaccaaatgtgaggagttttgtctctacacatcaagcaagcaattaaatctgcagcagacaccagttgggtgtcttctaatccaattctgacactgtctacctagaggtagcatcagatcccacaggttgagggctcagtccccaagactgccccccgacccacactggtcacaggtttggccttgggaacttctgacccaccagcttcaagttgggattcccacaaccccctctttgggttcagttaaatgaacacttgcatttactggtttattacaaaggctagagatgaagagatgcacagggagaaggggcacagagcttccgagtcctccctgtgtgcaacaccttccaggaacctccatgtgttcagctctccagaagctctctgaaccccgtcctcttgggcatttatggagacttcactggacaggcatgactgaagcatggacaaccatgtcaaaatgtgattgaacaaaaaggatatgatctaatactaacagacagactggggaaacccagtgagtcctgtccagattcttcttggcctctctgtgcagcctttcttcctccaggatatggggcatcctttctgaaatgggagtcttatgacctatagtcagacaaggtaggtcaaagacagaaagatgggcaaagattcctgccttggagagataaaggagcagatgaaatgagggcaggagaaggtcagagagattccgtttattgagacctgcttctgaggcttaaagcacccaacattacaacaacagatggtaacaagggcaatgggaattataagccaggaaccatggactaaaacctatatataaattataatagcacagaatcccaaaggctggaaaacttgtgggcttccctttcaccatatagagccactgttctctccacagtgcctgcatattcctgtctctttctgttgaatgactttttttttgacacagtctcactctgttgcccaggctggagtgcagtggtgtgatcttggttcactgcaacctccacctcttgggttcaagagattctcctgcctcaatctcccaagtagctgggattataagctcctgccaccacgcccgtctaattttttgtatttttgtagagacagggtttcaccatgttggccagcctggttttgaactcctgacctcaagcgattcactcaccttggcctcccaaagtgttgggattacaggcgtgagccactgtgccgagcctgtagaatgactttaaatctccaccctctacctatagcagcccacttcctcctctctcttcaaatctcctttttctcactttcttctccatcttccttgcccttttagaagcagaaaagggcataccttttctgtgataccttttctctccatcatgaaagtctcggccacggtcctctaacaaaagacaggttaatgagagaaaaacatttattgaatccaagttttatgtgtcacggtggcctttagaatgaagacccacaggggccggatgtggcggctcatgcctgtaatcccagcagtttgggaggccgaggtgggcagatcacttgaggtcaggagttcaagaccagcctgtccaatatggtaagatcctgtctctactaaaaaaaaaaaaaatttagctgggtgtggtggcatgcacctgtagtcccagctactcatgaggctgaggcaggagaattgcttgaacacaggaggcagaggttgcagtgagctgagatcacactgccacactgcagcctgggcgacagagcaagactccgtctcaaaaaaaaaaaaaaaaaaaaaggaaaaagaaaagaattaagacccacagggaaaattctcattttttatgcttagagttgatgaagaatggatggtcatgtggaagcattatgggacagaaagggtatgatctcctggaggaatccagcaatgcctgtctgtccggattcttctcggcctctatgttgtagcatttctgccagccaggtatgggactggacccctctggaatgaggatcttattgtgtccagaaatggtgggttcttggtttcactgacttcaagaacgaagccacagaccctcgcggtgagtgttatagcccttaaggtggcgcttctggagtctgtcctttctgatgttcagatgtgttcggagtttcttccttctggtaggttcatggtcttgctggctcaggagtgaagctgcagatcttcgcagtaagtgttacaacttataaaagcagcatggacccaaaaaagtgaacagcagcaagacttattgcaaagagcaaaagaacaaaccttccacagtctggaaagggacccaagcgggttgccaatgctggttcgggcagcctgcttttattctcttatctggccccacccacatcctgctgattggtagagccgagtggcctgttttgtcagggtgctgattggtgcgtttacaatccttgcgctagatacaaaggttctccacgtccccatcagattagttagatacagagtttggacacacaggttctccaaggctccaccagagcaactagatacagagtgtggactggtgcactcacaagccttgagctaaacacagggtgctgattggtgtatttacaatccctgagctagacataaagactctccacatcctcaccagactcaggagcccagctggcttcacctagtggaccccacactggggctgcaggtggagctgcctgccagtcctgtgccgtgtgcttgcactcctcagcccttgggtggtcgatgggactgggcgtcgtggagcagggggtggtgctcgtcggggaggctcgggccgcacaggagccctttgagtgggtgggaggctcaggcatggcgggctgcaggtcccgagccctgccccgcgggaaggcagctaaggctcggtgagaaatcgagcgcaccgccggtgggctggcactgctgggcgacccagtacaccctctgcagccactggcccgggtgctaagtccctcattgcccggggccggcagggctggccggctgctctgagtgcggggccctccaagcccacgcccacccggaactcccgctggcgcccaagcgccgctcgcagccccggttcccgctcgcacctctccctccacacctccctgcaagctgagggagtgggctccagccttggccagcccagaaaggggttcccacagtgcagtggtgggctgaagggctcgtcaaatgccgccaaagtgggagcccaggtagaggaggtggcaagagcaagcgagggctctgaggactgccagcacgctgtcacctctcattatggcccaccattagacaagcgtaggtcagactatttatttatggtcatgtcttaggaagcagtagaagaaataattctagtttttatggctggctttggggaacaggggttctggtttctatgaccttagggaggactaattctggcttctgtggctcacttcaggagagaatgaggggcgagagacaggaggggcagaaggtcagagggatcttggtttcgaggctgcttctgagtcttcccaatgtcctttagttcaaagtattcagcatgccaaagtgccacactttggggtattgttttctgagccccagtgttttcttcctctcttcttcattctttctcaatctcttcttctttttttaattgagatggagtctcactctatcacccaggctggagtgcagtggcgtaatctccgctcactgcaacctccgccgccgtccgggttcaagtgattctcgtgcctcagcctcccaagtagctgggactacaggcacatgccaccatgcctggctttttttttctatttttagtagagatggggttttgccatgttggccaggctggtctcgaattcctgaccccaggtgatccgcctgccttggcctcacgcctgctgggattataggcgtgagccactgcatccggcccccaatctcttctcaatcgcattcatcaatatttttttttcttcttttttcatcccatcaccttgggtctctccttgtccgtctcccagtctttcttactgtcagctagccccttgcttttccccttcctttctttgcaacagcttcctatctcatttgttcagcataatagaagtgcaaaccgatggcctactgcctgagtatctgctctgcagaaacatataatttgctaagagaacgtttatccaaaatattgtcttcaggaactgggagcagtggctcatgcgtgtaactccagcactttgggaggccgagttgggaggattgcttgagcccaggagtttgggaccagcctgggcaacacagtaggaccccgtctttataaaaaatacaaaaattagccaggcatgatgctacacacctgtagtctgtagtcagcttctggggaggctgagctgggaggactgcttgagcccaggaggtcaaggctgtagaaaactttgattgtgctactgcactccagcttgggtgacagagcaagaccctggctccaaaaaaaaagaagaaaaaaagtcttcaatctcaacaattaagaattggagatttcacataaaaatccagattttatcctgggcaacatgggcaacacagtgagaccctgtctttacaaaaaataataaaaatcagctgggtgtggtggttcacacctacaatttaatttgagaggctgaggagggaggattgtttcagcccaggagttccaggctgcagtgttttatgatagtgccattgcactccagactggggtgagacccggtctctaaacagaaatcccagttttacagcttaaaaaaaaatcaggctatctggcatcatgcgacctacaccgattgctagtaacagttgatggagctgggcggtggctgccccactctgttcaccagtgcccactccatgcctcctggcctccttaacactgagggaaagtgccaattggcatttattatttagcttgagtagttattttttcctctagcagacaaattttagtttctacctatatctttactgaaaaaagggaaaacagagaacaagagccaggtctttcttatcccaagcctgctacctcatttgcattttctgctttgcccctgcaggtggctgaattttcaaccttcgctatagacaaaggctcaggtctcccttcccaatttctcaccgtgcctcacttctcttttactctctccatatatcctcgtttctctttttgttcatataaggttaatatttaggccgggcacagtggctcacgcctgtaatcccagcactttgggaggccaaagcgggtggatcacttgaggtcaggagttcgagaccagcctggccaacatggtgaaacaccatctctactaaaaatacaaaaatattagccaggcatggtggtgcatgcctgtaatcctagctacttgggaggctgaggcagcagaatcacttgaacccgggagacaggagttgcagtgagccgagatggcatcactgcactccagcctgggtgacggagtgagactccatctcaaaaaaaaaaaaaagttaatatttaatgcattgatgtaaagctaacttcaggaccacttttgaaactttttttcagactgttttgaaatcttcaatcttcagaaaaagtctgtgaaaaatcattttattttcgcactagtgtgtgtgtttgtgtgtgtgtgcacgcacatagatgagagtagttactctgtgaaggatctgttacttatcttgctatttttcttgtttgactaacagcctatttatatggataagatctgagaatcggttactaggccgtatgaaagaggagtcttctttaggatcattatcagtacaggcctggcattcacctaaccagtaatagaaacctgaaaaacagtggcataaaaaattgagagtttaatttttctgcatttagaataaatctagaggtgagagcagggatcctaatagcatagcaatattggcaagaacctagtgtaattaaccatgttttctagtttctatattctgatacttccacatcgtggggtcttgctgaccctggagtgactgcctctcccaggttgagctaattcctagaagcaaagaactcgcctgtcatatgtagatcaaccaagctagaccccatcctcccaaccaccaccttcatcaggctctgccactcctagctgcaattcccctagtcagcccaggaccagtactagagagctagggacagcccctatgccccagaggctgctgaaattattcaaactagccgagcctgaacttgcttacctgcctgcacactcctgcctgtgaaaccacaataaaggctcttgcccacattttcctttcactcccactgcctcctgactgactcaggtgcttccccatggggcacccctgcacgccatgccatgcctcatgcatgtttctagggaactgtgagtaaatgtcttcctccatgaaagtgattcctgtgtctgcacgtcttgccacacctgattaaaacaaaccctggctacctttacaacccccaggtccatccagccttctgagccaccaccctgacttgatcgagcatcaggaatctcatttctgggcggggtgcagtggctcacgcctataatccctacactttgggaagccaaggctggcagatcacttgaggtcaggagtttgagactagcccggccaacatagtgaaatcctgtctctactaaaaaaaaaaaaaaaaaaaaaaatagctgggtgtagtggcatattcctgtaactccagctacttgggaggctgaggcacgaaaatcacttgaacctggaggtggaggctgcagtgagccgagaatgtgcccctgcactccagcctgggtgacagagtgagactctgtctcaaaacaaacaaacaaacaaacaaaaataaaaagaatctcatttctgggtggtgtggtggctcacacctataatcccagccccttgtgaggttaggataggaagatcacttgaggccaggagcttgagaccagcctggggaatgtagcaagactccgtctctacaaaaataaaaaataaaaaaaaaattagccagatgtagtggtatacacctgtagtcccagctactcaggaggctgtggcaggaggatcacttgagcccaggtgtttgaggttacagtgagctatgatcgcaccactgcactctagtgtgggcaacagaaggagatggagtgagagtgtccctaaagataataagaatctcatttcttaatttattttccttaacacttaccatattctgaaatactatatatttgtttgcttataatttgtttcctctcactagactgtaagctccttgaagccagagatttttatctgttttctttatggtaagttcctagaactgaaaacagggcctggcatgtatttactgaaaaagtgattaagtgctctccagttgatggctggagttcagaccatcatggttttgtttcaggctggaggaagtgggagagtaaaaggcaaagggggcccatgccagttgagtcagtcctagaaaagaacttttctgaaagtcccctttacatgacttaggctaacatctcattggccagccctatgccacaccaccactcctacctgcatggcagtttgaggcaaaaaaaaatttaaagcatagaactttgctaaacaaaataaaattggggttctgctagaagaaggaagggacaatgaacactgggtctctgcaagggggctgttggctgcactccaaatgcccgcagcattatacacgaatcatacatggagctctttttttttttttttttgaggtggagtcttactctgttgcccaagttggagtgcagtggtgtgatctcggctcactgcaagctccacctcctggattcacaccattctcctgcctcagcctcccgagtagctgggactacaggcgcccaccacccccggctaatttttgtatttttagtagagacggggtttcaccatgttagctaggatggtctcgatctcatgaccttgtgatccgcccgcctcggcctcccaaagtgctgggaccgcaggcgtgagccaccgcgcccagccctacatggagctctttaccctggcctgtgctttcctctctatttactttttttttttttttctttcctgagagggagtcttgctctgtcgcccaggctggagtgcagtggtgtgatcttggctcactgcaacccctgtctcctgggttcaagcgattctcctgcctcagcctcccatgtagctgggattgcaggtgcctgccaccacacccagctaatttttgtatttttagtagagaacagggtttcatcatgttggccaggctggtctcaaactctctacctcaagtgatctgctcgtcttggcctcccaaagtgctagaattacaggcgtgaagccaccacgcccggtttcctctctatttactcttgtgagtaacatcagcttctttgaacttcaccaaacttaattccttaattccatactaactgtttatttgttgagtttccaagatgcaattgcatataattccaggaactgtgagtagtaagaacccccttatcagctgtcctatttttagatatcatgattcctactgaaacattcagtggcttaagctctgcccagcatgttcttgaccctgtgtgcctgtggggtgtgtgtgtgtggtgtgtgtgtgtgtgtgtatgtgcacacagtcatgtgcactctcacatcacataaggggaagataaagggagactctccgtggctcttcctccttttttccaaggctgatgttggccctttctgaaaatgctttaatgtgtagaaagcagcccacagataggcactccctgtgataaagcagtcacagccagagcagggtccctcccacctcagcctcctaagtagctgagactacaggtgtaccaccacgcttaggtaagtttaaaaaaaaaagttttgtagagatgggggtcttactatgttgcccaggccgatctcaaactcctggcctcaagtgatcctcccaccttggcctctcaaagtgctgggattacagatacgagccaccacacctagctgagaatttctttatggccatcttctggacaaaaagtcaaggagagtttagagtaataattccagtttttatggcttttgcttcggggaaaaagggttctagtttctaggacctaccgtggggaagaggattctggtttctatgactcacttcaggggagaacgagggacgagagagacaggagggcaggagcaggtcagagggaccttggatctgaggctgcttctgaggccttccaatgtcctttagttaagtactcatcgccatactttggggtattgtgttctgaaccccaacagaaacaactcactctctcggcatcagccttgtgcctatacccacaggagcaggagcacaagccattgcaggtgcgggctcctcagatggagcaactccaatgtcacctgctcctcacctgtacccagtggacttttttggcagcctcccccatcttctcgtgtggctccatatctttatatcttctgtggcagacgtagcctgctgcctccccaaactctatcgtcctcttctccttcaaccatggaaacttgattttgtctgtggcatccatgtgcctctttgaaacactcacctcctcagactgccttgaatccaggggtggccacatgactgggtaatgagtcaccggtagaagtcggcttgatggggcttttagggaaacaacggctttcctgtttttgtttttcttcttcttctttttaaattttctcctgctacccctccccttgtttgtttttaagatggatttgttcggaacacatcttttgctctttccttctcctttctgcctggaatgtaaatgtgatgtctgaaggcagagcaaccatcttgcacatgtgacatagaaaggtagatgtgaagacatctagcaggagattgcatctctggtgattggagcagctgtatcagctctggactgcctgctcaagtcttcttcataactgggaaaaataaacacctatgaagttaggccattgtattgagtttttgttactcaagaaccaaacacaatatttattgagatggcatttcactcttattgcccaggcttgtgtgtggtggcctgacctcagctcactacaacctctaccccccatccagccctgctccaggttcaagcgattctcctgcctcagcctcctgagtagctgagattacaggcgcccaccacatctggctaatttttttgtatttttagtggagacggggtttcacaatgttggctaggctggtcttgaactcctgacctcaggtgatccaccctcctcagcctctcaaagtgctggaattacaaaggtgagccacggcacccggcctttttttttttttgagacagtctcgctctgttgccaggctgggatgcagtgtggtgtgatcttagcttgtgtccggaattggtgggttcttggtctcactgacttcaagaatgaagccacggaccctcacggtgagtgttatagctcttaaggtggcatgtctggagtttgttctttctgatgttcagatgtgttcggagtttcttccttctggtgggtttgtggtcttactggcttcaggaatgaagctgcagacctttgcagtgagtgttacagctcacaaaagcaatgtagactcaaagactgagcagtagcaagatttattgcaaagagcaaaagaacaaagcttacacactgtggaaggggaccggagcaagttgccactgttggctggggcagcctgcttttattctcttatctggccacacccacatcctgctgattggtagagccgagtggcctgttttgacagggtgctgattggtgcgtttacaatccctgagctacatacaaaggttctccacgtccccatcagattagttagatacagagtatggacacacgggttctccaaggccccaccagagcagctagatacagagtgtcgattggtgcactcacaaaccctgagctagacacagggtgctgattggcgtgtttacaaaccttgagttagatacagagtgccgattggtgtatttacaatccctgagctaaatgtaaaggttctccaaggccccaccagagcagctagatacagagtgtcgattggtgcactcacaaaccctgagctagacacagggtgctgattggcgtgtttacaaaccttgagttagatacagagtgccgattggtgtatttacaatccctgagctagacataaaggttctccaagggcccactagagcagctaggtagagtgtcaattggggcactcacaaaccctgagctagacacagggtgctgattggtgtgtttacaaaccttgagctagatacagagtgccgattggtgtatttacaatccctgagctagacataaagactctccacgtccccaccagactcaggagcccagctggcttcacccagtggatccagcaccggggctgcaggtggagctgcctgccagtcctgggccatgcgctcacactccttagcccttgggcggtcgatgggactgggggccctggagcagggggcggcgctcgtcggggaggcttgggccgcacaggagcccacggagggggtgggaggctcaggcatggcgggctgcaggtcccgagccctgccccgtgcgaaggcagctaaggcctggcgagaaatcgagcgcaccgccggtgggccggcactgctgggggacctagtacaccctccgcagccgctggcccgggtgctaagcccctcactgcctggggctggcagggccggccggctgctccgagtgcggggcccgccaagcccacgcccacccggaactccagctggcccgcaagcactgcacgcagccccggttccgctcgcgcctctccctccacacctccctgcaagctgagggagccggctctggccttggccagcccagaaaggggctcccatagtgcagcggtgggctgaagggctcctcaaatgccgccaaagtgggagcccaggcagaggaggcgcccagagcgagtgagagctgtgaggactgctagcaggctgtcacctctcaagctcactgcaacctctgcctcccaggttcaagtgattctcctgcctcagcctcctgagtaggtaggattacaggcgtgtgccaccacacccggctaatttttgtacttttagtggagacagggtttcaccatgttcgccaggctggtctcaaactcctgacttcaggtgattcacccaccttggcctcccaaaatgctgggattacaggcatcagccactgctcctggcctctgtgtagttttgtttggagctgcagtaaatagtgtctaatcttttccttccttacaggctatttctccatattgcttcccagatacaaaattcataaatgtatacaagccatacccatgttacccactccctcaggccctgccaaggccttgagaaactagactcagactgtgtctccatgtagggggattgcacatagcatctttgaacttcagtttctctttctgtaaaatggggaattttgactacttagcatgcgtcatgtgttaaaaccctaacctcgttagcaattataaccactatcagtatcccatactctggtttttttagggctttcccaaggcaaatgggaagatttgctgccaagctcacttcgggaggtcaccaggcccagaacattcttgtcctcacaaattttcacttccttcatttaagaacaaggactagagtgttctcacttaattacaactgggataggtgggagggagttacccatgtgggcaacattagggaaactttttctttgagacagggtcttgctctgttgcccaggctggagtacagtggtgtgatcatggctcactgcagcctcgacttcctgggctcaagcaatcctcctgtcttagcctcctaagttctgacagcccttagggactacaggcgcacaccaccacaccccattcatttttgcatttcttgtggagatgcgttttttccatgtttctcaggctggtcttgaattcctgggctcaagagatccttagggaaacattctaccaaaccagaagtgatggatcaactcccagcaagcctttagtgggcattgttcttttcagggagctggatagaagaggggtctcggagccacaacacccgtgctgcccatgatggtagaaaagggaagtctaaaaagagtttgggtctgaactggggcctaggaaaagttaatggggcagtgattttggccttttctacccacctccttgtaataatattattttaacaatctggctgggtatgtggctcatacctataatcccagcactttgggaggccaaggtgaatggatcacctgaggtcaggagttcaagaccagactggccaacatggtgaaaccctgtctctactaaaaatacaaaaatcattcggccgaggtggtggttgcctgtaatccaagctactcgggaggctgaggcaggagaatcgcttgaacctgggaggcggaggttgcagtgagctgagattgcgccactaccctccagcctgggtgacagagggagactccttctccaaagaaaaaacctaaccgccccccccaaaaaaaaccaatcaaacaaaaaaccaatcttacccccatgacgttgcctctctctagcctcccagggtatttctgtagtctcaatatttggccttagctataagaaaatttccttaccattactctttattgtgcaattctctgaagatattcttctgatggcattctttcctctccattccttgtgtgtcatcattatttcttgcttattcctgtcttgtgcttacttcctgaaatctgatctatcctttaggcctatctcagaagcctttatgaagccagcctgcacggagacactttccttctctggaacccatggcacttagctgctatggcttttgtgctcatcagcaaactggaatgcgcttccattagacttatcctttcaccttagattccttaaggcaggaactgtcctgtacttagccttgctcttgtcatgttgtatttacttgataattattccttgaatttaactggaaattccggtttggaaggagaggacatatatacacgaagcatggtatatttaaataaactggagttaattttccttcagaaatacctcctatttaagcctttgccacacaggtataggcctggaaataaaaggtgtggctaaaagctacctgctcagagaactctttttttgttgttgttgttttgagatggagtctcgctctgtcgctaggccggagtgcagtggcgcaatcttggctcactgcaacctccgtctcccgggttcaagcgattctcctgcctcagcctcccgagtagctgggactacagacatgcgccaccacgcccggctaaatttttgtgttttaatagagacggggtttcaccctgttggccaggctggtctcaatctcctgacctcgtgatccgcccgcctcggcctcccaaagtactgggattacaggcgtgagccaccgtgcccagcccagataactcttttcttcagattttctttacagattcttcaagctgtaaaataaatgaataccatctctcatcacctatacctaggaagtgctgagtaactctttcctgtggacccactgagtcagaggttcacatctggttgggcaagtagtgggtgtgatcagtgatgaatattctttggtttcagcaccagcatcagctatttatatgtcagtgatgcaaatctccatatgcagagtccttgatactgttcggagtgcttccatacccatgcccaaactggacccagcgggggtggctgccgagaaaagaaacttgacagagcaggttcaaagggtccctggtttcttgcactggaagaattagggtgggaacacagtgggagaagagaggtggaatgtcacagttctgacagcccttagcatggagatagccagcagccaattagatatgggaatcggaagcctagcagagaggatagctggagagtacatttcaaagtcactgccatataaacaggaattaaaaccctgatagtgggtgggatcgcctgggagagtacggaggaagaggaggatggattcagaatggagtcccagtgcttgggtagtgcatggaggacaggacccctgaacaggccggcaaagtgtgggtagagaggtcaaggagagagaggagaagttactgtagaaatcgataacttcaacaaatgagagagaggtcagctgtaaggtaagaaccaagaagggcccactggatttggcgtggagcaaagggatggagtgagtggagtaaaagcgaagatggaaggtggatttcagtggtgccagaggggaatggtagtaaggagagcgtagtggacatggagatgtgctgctcagatctcccccaaggaaggacttgttgcccagctatgggagagcagtcagcagacagcctccagccatcagctccttcagggtcccctggctgcaaagagctgcctggtccctcttcctggtcacaccctttctcctggcagctccatgtggtgactaagcagggctggatataaatgtctggctctttcagttcaacttgctttgctttgatagacaatactgccccaagctctctgcagagttatgagaggtgtggttgggcctgcagctcagtttaacttctccctctgcccactcctgcttccttgcccttattcacaggtgttaatacctaattaacatcttgcatcccaactttatctcagtatctgtttccagagaacatggtctccaacagaatcatgggaacaagtcttctgaagagtttgagagcaggagtcgagggacgggaaggaggtgttaaaaaattagtagggaatggtgacacgcctatagtcctagctattgggaggctaaggtgaaaggatcacttgagcttaggggtgactatactcagctcttctcggggctcacgaaacactttacaaaacatctttctgtatctcatttgagggtttttgcctacagtcattgccaaggccacttatctgtagttttcttttcttttttatttttgagacagagtctcgctttgtcacccaggctggagtacagtggcctgatcttggctcactgcaagccttgacttcctgggctcaagtgatcctcctgcctcagtcccccaagtagctgggactacaggtgtgcaccaccacacctggctaatttttttttttttcttgagatggagtttttgctcttgttgcccaggctggagtgtgatggcacgatctcggctcactgcagactccaccatccaggttcaagcaattctcctgcctcagcctcccgagtagctgggattacaggcatgcgccaccacacctggctaattttgtatttttagtagagacagggtttctccatgttggtcaggctggtctcgaactgctgacctcaggtgatatgcctgccgcggcctcccaaagtgttgggattacaggcgtgagccaccgtgcccagctaatttttgtattttttgtagagatggggttttgcccaggctcatctcaaactcctgaactcaagtaatccacctgcctcagcctcccaaagtgctaggattacaggcgtgagcccccacacctggcctgatctgtgcttttcaacattcatctttttttccatctttgggaatcagagccacacaatctccaacttctaatacctttctgcctctttgtgatttctcagagatcgttgatagtgacttggagatactctcagttaatttttattttggtacttaggaatgtaatccattcagaccaggaggtttgaacacatttggagcagctactcttgctgttattattatttttttcaggtgttatggtgattcccacttagcagtggccgttctgctgtttcctagtcaaattccatgctgcttactgataagctgggggcactggcttctgctcttgctctttcttctggaaacattattctgttcctttggacatgggcaagggtcctgtccctaacttgtccttctttttcttttgatcttaaccagtttcacttgtaccaagaccaaactttcttacctttccatgcagggaaacaggcaccatcaagatcaatgccctggtactccttatgtagtgagtgatagatgctcacggaaaatggggagaaaactaaggggtgaaagggaataactctaaaaaggacacgttcacactttctgacagcatagttgcatgttttcaatttattttggccaccagatggcataactgggctcattaagataaacaaagagaatggctactactctgaaaaaacaaaaaaaaaaactctagataattaatggtgaaaatgcccctgagaaagctcatttctaattcttactcctagctggctttttatacacaggcaggggagacccatctttggaattttaaggttcaaaaaggaatttgtctgtacctgatggccagaaaaccacactgaaatcgtcaactggcatttagaattgtctgttctaagagttagaaatgagcgtgtctctacctgcttctagcacacaccttcctttgaggtaaactccttactgttgagcccttgaatctcggagtggatgaagagggtgatgagggattgtagctaatattagcattgttgagctaaaataccatcatattttgtcaggagaagtgctgactgtcctgtggaatctgaggatgagtggcattggtccctaaggattagcttgtccctttcggttacttttgaatatgatttggaacttgtggggtttgggttatgacaagaagggaactgagaaagtaaaaacattcattgcttgttttgtgcttctacatatttttgactctgggagattttaaaggtctatttctaatatttgttctaggtgcatagatttgtttattcaacaagcattccaggcaccatataggggctgggaagaaagagtaaataaggcagagttccaactttcaaagagctttctaatcttggtttttagtcccacaggggcaagatgggaatgccatgagaggctctttgattgtggcccaagggaacactcagtgcctagatgtgtgaagtgggatgcagctcctggtgaaggcagaagtcctttaaaagtttattgactgcaaagaataaaccaaaatgggccgggtgcagtggttcacgcctgtaatcacagcactttgagaggccaaggcaggcggttcatgaggtcaggagttcaagaccagcctggtcaacatggtgaaaccccgtctctactaaaaatacaaaaattagctgggcatggtggcgggtgcctgtaatcccagctacttgggaggctgaggcaggagaatcgcttgaactcgggaggcagaggttgcagcgagccgagatggcaccactgcactccagcctgagtgacagagtaagactccatctcaaaaaaaaaaaagaataaaccaaaatgacaaagcttcttgataacatcccagcccatttcttcttcttcttctttcacttctccttctccttcttcttcttcttcctcttccccttcttcttcttctcctccttctccttctttttttttggagatggagtcttgctctcttgcccaggctggagtgcagtggtgtgagccaccccgcccagccatcccagcccatttcttatacaagaaacattgagggtttactaaagaaagaaagagacagtagaataatgggaaccacgttgcaaaaatgtaaatcgctcactggtgactgccaggattttgatgatctaataaaatgactggcatatgaggtggggaaaatgtaccctcctgtgatcagccagaggtttcagcagcagtggaagatgcataccagaaggcggtgcaaagggggattagagaggatctaaactggtatcagggattgggtgtggtggctcacatctgttatcccagcactttgggaggccaacatgcgagaattgcttgagccaggagtttgagaccagcctaggcaacatagtgagacctcatctctgcaaaagttttaaacaattagccagacatggtggtgcatgcctgtagtcccagctactcaggaggttgaggtgggaggatcactcaagcccaggagacggaagctgcagtgacccataatcacgccactgcataccagcctgggcagcagagcaagatcctgtctcaaaaaagaaaaaaaaacacaaaaactggtgtcgggaaaagtagttgggaagctatggaaattgctccagtgagaggtgatgaacatctgaattagtggcaggagtctctctgaacctattcagtttcaggggattgcttgatttaaaaaaaaaaaaaagacaaattagccgggcgtggtggtggatgcctgtaatcccaactacttgggaggctgaggcaggagaatcacttgaacccgggaagcggaggttgcagtgagccaagatggcaccattgcactccaggctgggtgacagtgcgagactccatctcgaaaaaaaaaaaaaaaaaaggcagtggttaagggactgagtggggacagatgggagatggattttagggtaggaagggtggatgtaagtgtgaaggagaggaagaatgactctggagagaacaccagctccagtggcctgaccctaagtcctgtgtgctttctcgcatattgtgctgcctcgtcatataacgaagattccactttagtccaactcttccattttacagtgaaaggagaagattaaaacccagaaaatggaaaccctcatttatgttaaagctgagaaatcaagtgtcccttccctgatccaatcctcttccgcaggttcatgacagggtgcacattagaactacctgcagagccttccaagcggcacgtgcctggcccatccctagatccagtgaaccagaatccctgggctgggaccactggctcattccagacagtgcacaagcatctcttcctggtgcaaccttccatagcacgttccgcttggatcactttctctttctctgttttataattgtccattacatacagccactgataactgaaaaggctcgcagtgtttggatgaggaaccatatgcaaacaaataccacagttcttccttatagacccacttaactgatttgcaaacatctcactgaaaccgcaggggagaggttttagaaggctatgctccagtaaggaaaaattaatggaagtaattgttcagtaagcagttaccaatctaagttttataaaattgatactctctttatgagtgtattttagtaaaaatagggaatagcttttttttttttgagacggagtctcgctttgtcacccaggctggagtgcaatggcgccatctcggctcactgcaacctctgcctcccaggttcaagcgattctcctgcctcagcctccgattacaggcgcccgccaccatgccttgctaatttttgtattttatagtagagacggggttttgccatgttggccaggctggtctcgaactcctgacctcaagtgatctgcctgccttggcctcccagagtgctgggattagaggcgtgagccaccgtgcctggctgggaatagttttaaaacataaaaaacgcaaaagttttaaaaaacatgggttttctaaagatttcagtattccctatccctaacttttcataaagtcctgagtttcttaatcacaatgttttcatccaaggaggcttttaggaacaggaccccagggttagggcaggaatacactattgttattttaacagtctatcaactagaaaggcaaaaaaaaaattagatttttttcaatattaatgaagttgaattgttcgttgataattgttaattagttatggtgtttctgttataaattgtctgtgtctgaatttctcacacagtacaatataaaatacaaatagctgtggggtattttctaggtgctggttactgttctaagagctttaaatggagtaattcagttaatcctgcctcacggtacaataattagtctcgtatgacggaggaaatagaagcctggagaggtcaagtaacttgcccaaagtcatacccagaaaggctggattcagagactgttgccaacattttccttatttatttgcattccatttttttctattaaatataaaaattagccaggcgcagtggctcacacctgtaatcccagcacattgggaggccgaggagggtggatcacttgaggtcaggagttcaagaccagcctggccaacatagtgaaaccctgtctctactaaaaatacaaaaaatcagctggacatgatggcctgtgcctgtagttccaggtactcaggaactcgagaggctgaggcaggagaatcgcttgaatgtgggaggtggagtttgcagtgagccaagattgtgccattgcactccagcctgggtgacagagcgagactttgtctcaaaagaaaaaaaaaaaaatttaaaaactttttgtagttaaatctatgcatatattcctttcttttgttggcctattgtttcagttaatttgtttttttacttttttcccatgttttacttattactttcatatttcttgtatgatatttatcttaaaatctagttttatttttctttaagagactgggagtcttgctatgtttctcaggcgggtctcgaatttctgggcataagcgatcttcctgcctcagcctctcaagtagctgggaattacgccaccaacacacctggcttctttcagctaatttagaacatcctacccttttcagagattaaaaaatatttagatttgctcaggatatgttagatgaagtgaggatttacatctactatatgtattttcccaaatattaataattatttctcctgaaccatttattgcataatatttttctgttccattgttatatgacagcacgtttctgcctggttgtaatctcatagtggcttgatttttaagtgaacattatatgtttaactgcctccttgaggatactgaagactctttccaatgattatattcttttcacttcacctgtcatgcatcaagtgttgatgttgctggctgcctttctcagtgttagtttttatgtgttttggaatttcagcttccaggttcatttccaggctttctctgtctcccttctcttgttcctcactcctccctgcctagtggctgtgcagttgcccttcccaggggccagtgttcaggactaggtcttatatggcagtcggggctcctgccctgggataaccctgggaatgactcacatccagccccatggctgtgggtggctcagttaagcccaggtgtggtgccgtttggtaaccacgggcctccctaggccacagtcccaggcgaagttagtagcaagctatttcagtcttcttgaagagggtggaagtgtgggcaagaggggaatctgagtccctaatattttcacagtgaccatgacactggtcccccacctcagtgggcaatttaattctatctcaccactcagtactcaacaggacttgacttcccagctgcctttaactgtaccctgagtcagaacccaacaggccacagctgtagccctgttcatcttttgcatttatattcagtttctgggaatatctttggggatattctccctttgtggagcattgctttttaattttctctaatattatatctatcattgctctgtattgaaagcccctgggctagcctgtttcacttgtgtctattttttagaagcatttactgtagctttatactacatatttggggatcactaacaattttttccggtcacactctaatcactttctcaaggctggatcaggtgcgagactctgtagcagtaacctgaagttgagaattgaggaagtagtgctgctatgagaggagacctgcggtggcatccctaggatggggtgctggtggggggtgggtggcaagggggaaagggggtttctgcctaagggagtttctgctccatgccagcacttcatcagaggtcttgagccagggtggaatccagctccagggagcatatgagagcaaacaatggaagcttgacatgatcactggatgaacatctgaagtttcatatgtgatgggatctccccagaaaacaatagtgcacatcacagccaggaggcacccagagcattgtgttgctgtgttttttgaacccagtgagttaactgtccagtgttccacatcattctgacctgggtcaacagatggaggcagggcacactcttggctgtagctcgatccgcctctcctgctgcagcaggacatttctcagtagcacaggcaaggtgctccgggcaggggactgcatagtaagtggtgcctcctttgcaatataagccaaacaaggcttcctgctggagcgcctcttggctaattcaggggcatgagaggcagcatctaaccttgcccaggggccctggctcccctttactatggggggtggcctgtgatcaggcccagtgggactgaggagcaaatgtggacagtcttccccggcacacatcggctgacctgcatgcccagactgtctcctggggcgcctgtacaagttggtcctagaatccaattcttcctggaactgggtgtcatttcaggacagagaataccgggagtcataaattggccctgaagcaaacgaaagtcttccaatcctgcatgacatagcagattgttttgcttggggctttggcttggtctggggcgtgcagttccatgggggaacctctggcaatcccaccagggggagccctttccccatcttggggctgtggatctcagctttccagaatatttgtgtgcatgtgagtgagcacatctgacttaatttttatattcagtatagaatcatgactcagctttccctgttaatgtagtcaacttaagctactgccatggttcaggttccatcatgcttcaaatatagtttatgactgtagttacgtagtgtggcagcaacacagggcaacttggggctggggagaagtgagcgtgtctttccctccccaaatgcagtcatttagcatcttcctctttcagagtcctgtatcccagcgatggggatcaagattcagacttaaggacaccctacctggaccttggcaaggagatttttacagtgggaatctggtccagcctctctctggccccaggcctctactgtccaccttttacaaatgccacatggtaaggagtcaactgagctaccttccaaggagctggattggtctcctggctctgcctgaccttcctcagcccctccgcaacccccacctgctcgcttctccttcacctcctctcctgttcacctgtaccttctttccttagatgtggccacactctgttcccccaggcagcgtcttcactgagtagtctttgaaccattaaccacctgcagccctatccatgttctctagggcacctgcaagaggaggaaggggaatttgctgatagccacagctgtgcatcctactggaggtgccttccggagggcagcatagttaatctagacacccagcattctcagtccacttccatggccttctcttcccattgcctgggtctcaaaaggcccaggacaatctcatgaggtggaccgagcagtatttggggagggaggatagaaaagagactgggatatctttaattaatagatactattaaaacctcctccccagcagcagtagtagggatcgttagtggcagcaaatccataggggtctgcagcaacctcaattcttgcctctttggtcacttactgggatcttattgggaaactgctgatcaccagtttcagatgtttctattgggagactgcctgtctctggtgccagctgtgaccaattattttagagagcccgttaacaactgcctgaccctcacctgatgtttgcctgacattcctgtgggtgtgtgtctggggcgccctctcctgccctgctcatccctgactagctacttactctaacaggatgagaagacatacaaaatagaggctactttaaaaaaaaaattctcagagtgtagtgtgtaaacgttcacctccactataaagacctccttgccaggggtaggaagcctttagtctgaaccttgagctccgtcgctgggatacaggactctgaagaggaagacgctaatgatgacattgagttgactccacagcatctcacaattctttctttttctaagtcatctgcatttagtatccactgaccaagcaggcaggaaatgtaattgaagttttattagggactcccctatctcttctcctatggggtccagtgaccatcccaggggtctgacccagcctagaacattcagagtctgggcctctgaccttcagacacagctgatatgaatgggagtctttgtggttagtaaggccaaggttcttagctagtttcctttggaatccctgacctccctccatccccactgttgtgtgtgtggggttctatgtgggagcagggcttctcctcactactccaaggacccccaaaccacatcccttccacagcatctgggaatctccccccaccccccactcccttgagcagcttttgcctccttcagtccagtgtgcttacctctctcccctggcagagaacccaggtgctggcggggtctcctctggatgccttgccaacttctttttttttctttccaacttcttctcttggtgaggctacgcaaaatcttctggggccaggatgtgcaaacgcttcctggaatggggtagaacagtgacaaaacaggaagaacaaaaaaacacatgttaatatctcaagaaagtatccagccaccataatgaaggggcttccaggctctgagggaagaccactgagctgaggggcctttgcactctattccagggaagataatggatgcccagaagaagtgggacatttggagccccagacaaaccaatgacacagactgagacactgtggagctggatgcctttctgtgtgtttgttagagtatgagaagcccgctgggaacaagtaagggcatccctaaccatcagtgtccattgcccaagagagatggcagaagtgggttggtccaaatcctttccgttgtaaatgtggagggctaacattttgaaatattctctggccaggtgcggtggctcacacatgtaatctcaggtacttgggaggctgaggcaggaggatcacttgagcccaggggttccaggctgcagtgagctgcaattttgccactgtactccaacctgggtgacagagagagacctcatctctagaaaaaaaaaaaaaaacaacttctgatttatttcatctgtatctctccctcctcccctcccactccccagcccttctagcagttggggtaggagggtgggcagtcagcagaaagcagagccaagcagcatcttctgcctcataaatttcaaacatgagacctcatgggaactgaaaggatttatgacataggccaggtatttaggagaaatggacactaagaacaaccatcccctcaccttccaacagaaaggggttcccttgtgctggtggggcagaggggccataataacaatgtgcacatttgtgggtattagagaaaggggtccctgggctgagtcctggggaggtggcagaaatggcagacaggtttgtggggtcagacagaaagctctgtcttgcttcgtctttgagccaaaggggacctggtgcccctgagttgggggcactgtgtggtgcccagtcacactctccgtggtgtcctcagtgagtggcactcattgagggacaggaggagcagagctgctcccaatagagaagcactggagcccacactgcctaaagtgggaatgacccaaatagccttcagcaggagaaaggggaggaaaattgtggcatatgcatgcagtggaatatttctcagcactgaaaatgaatgttcctataactgcatgtgataacaggcaaatctgcagacataaagtcgagtgaaagaagccagctgtgaaagagcacattgtatgattccatttatataaagctcaggtccaggcaaaatggtagtagtgaggagagaggttgtcctttggggagggtagtaactaaaaggcacaggagggggcccctggcatcctgggaatgtcctttccttaatctaggcactggttgcatgcatatgctgtttgcgaaagttctttgagctgtacatttaaaattaatgcacttctctgtatgtatgttttatttatataaaaacatttttttaaaagatagaagtagctggatgcagtggctcacgcctgtaatcccagcactttgggaggccaaggcggatggatcacctgaggtcgggagttcgagaccagcctgaccaacatggtgaaaccccatctctactaaaaatacaaaaattagccgggtgtggtggcacatgcctgtaatcccaccttcctggaggctgggaggtggaggtgagctgagatcgcactactgcattccagcattccagcctgggctacaaatgagactctgtctttcaaaaaaaaaaaaaaaaaaaaaaggactttctgctctttcctgcttgacatcttccttgactccatcttctttttgatcacctttttatggcttcctgaactgatctcatggattttttatctgcatcaaaaatggaaatggattagatgttgcgatttttagggtataaaattcaatgattaattttatgtgtcaatttgattgtgttgcactacagggtgcccagattaaataacatttcttggtgtgtctctgagggtgtttctaggtgagattagcattgtggactcagtagattgtcttcgccagtgtggtgggcatcatctaatctgctgagagcctgaacagaacgaaaagaggaaagagaaattcactactgtttcttcccgcctgcgcgctggaactggaatatcagtcttcttctctccttggactgagatttgtactattagctcccctggttcctctggtccacaagattgtggacatagactggaattatattactggctttcctgggtctcagttcgctgatggcagactgtgggactttagagcctccataataatgtgagccaattcctcattctatctatcaatctatatatcgattgattgatcgatcgatagatcgatctatctaatctatctatctacttatctatctatcatatcatctactgatttctctctctctcttcttttttttttttttgagacaagatctcactctgttgcctaggctggagtgcagtggcacaatcctagctcattgcagccttgacttcccaggctcaagcaatcctccagcctcatcctcctgagtagctaggactacaggtgcccaccaccatgcccaactaatttttaaactttttttacagatgaggtctcactatgttgcccaggctggtctctaactcctgggctcaagcgatcctctcacctcggcctcccaaagtgctaggattacaggcatgagccaccgtgcctggccctgatttctcctattgggtctgcttccctggagtaccctaatacagatgggtttgtgttattgagagccctatttgctgcctccttcacaagatgctagctgaactcttgagcatgggcatcagcattggtaaatctggcagtaaggcctgtgggctgctcacatcagccaggcagacatttgattaagtttgagatcttgatgtcttcaccagagccactaagttttatatatgccattgttgaagccaaccccaactcacctggcaatcagctggaggaaggggactacttctattcattgcagatttaaaagttggctacatatcctttgctacttctcccattgggaggtggggaccccttaaatctgggtggctgtgtggctgctcgagcgacacaaattgttggaagtgatgctaaaccagcttccagcacaggattcaatagcaccttccacctcctgtctcctggagcattctctgggagcctgaatcaccatgtaaaaagttcaaaatcaggctgggcacggtggctcacacctgtaatcccagcactttgggaggctgaggcgggcggatcatgaggtcaggagttcaagaccagcctggccaacatggtgaaatgccgtctctactaaaaatacaaaaattagctggatgtggtggtgcgcacctgtaatcccagctactcagggggctgaggcaggagaattgcttgaaccccggaggtggaggttgcagtgagctgagattgcaccactgcactccagctctgggtgacagaacaagactctgtctcaggaaaaaaaaaaaaaaaaaaaaaagtttcaaattcaggctgggcacagtggtgctccgtaatcctagaactttgggaggctgaggcagggggattacttgaggtcagaagttcagaccagcctggtcaacatagtgagagtccatatctacaaaaaagaaaagattagccgggaatggtggctcacgcctgtagtcccagctactcaagaggctgaggcaggaggattgcttgagacctttaaggttgtagtcagctatgaccatgccattgcacaccagcctaggcaacagagcgagaccctgtacccctcttccccccaaaagaagaagttcaaattccctgccactgcctgctggagtggccgagtatggtactctggccaaccactagcagagcccagctgtccccacaaaggtgacaaaaatgtgaaggaagctgtcttgaacactccagaccagccagctgccgaagatggcattgagtgactccagttaacatcaagcagagtagaattgctgaactgacagacacaattttttatgtaaggaagtggctgttgttgtaagccactaggtttgggatggcggttgctcagtgatagataactgaaacagctgtatctgcacctggaccagagctttcatgcccagggtgagtagcttcttggttctgtaaggctctgtctccttcaactcactttgccgggttgcggctacagcattacccagctcttcattccattacagttcatcaaagctcccatgccaggcttgtggcagggtaatttactgtggaattgttttgttttgttcttgttgctctgtgtatactcccctcaccaagagagttactgggctttttgttcccaattctgaggctctttcttgagtatggagaaggtgggtagtgatggcatttggattatgcgcaaacacctaggctaagagaggcagaagtggactgtgggtgtgtcttgagcagaggttgagattctctagggtctggaaatttggtgctttctccccacgagtgaggagacccccacttctgcccagagcattcccaggctgaaggattgctggagaatgcccagagaagccatgatttctcccagctaggggcacagaggccagggtccccagggagattctactatgggtgatgtggacattgctgatgtgaggggaagtgctgggcctgacccagaggacatcactccaggacttgactgtagcctctgaaagtagaggcagctagagaaacaatagtggcttctatgggctaaatgtctctgtccccccataattaatatgttgaaaacccaacccccagtgtgatgatatttggaggtggggccttttggaggtacttaggtttagctgaggtcataagggtggagcccccatgtgtgattagtgcccttataagacgagttagagaccagagctctctctcggccatcggtagtgagaaggctgcagtctgagaatcaggaagagagccctcagcagacatcaaatctgctggtacctggatcttggacttcctagtctccagaactgtgagaaatacatattcattcagctgggtgtagtggctcacacctgtaatcctagtacaggtttgggagaccaaggtgggcagattacttgagcccaggagtttgagaccagcctgggcaacatggggaaaaccccatctctacaaaaatacaaaaacttaggctggcatggtggctcatgcctgtaatcccagcactttgggaggccaagaagggcagatcacctgaggtcaggagttcaaaaccagcctggccaacatggtgaaaccccatctctactaaaaatacaaagaattagctgggcatggtggcgggcacctgtagtcccagctattcaggaggctgaggcaggacaattgcttgaacctgggaggcggaggttgcagtgagccgagattgtgccactgcactccagcctgggtgacagagcgagactgtgtctaaaaaaaaaaaaaaaaagaaaaattagccagatgtggtggtatgcacctatagtcccagctgcgcgggaggctgaggtaggaggatcacctgagcctggaaggttgaggatgtagtgaggtgacattgcaacactgccctccagcctgagtgatacagtgagaccctgtctcaaaaacaaacaaaaacatatttgtcatttaagtcacctagtctctggtattctgtcacagcagctagagcgaactaagttggctatcctgagtactaaggacctggccttgctcccagcttttctggtactgcctaagcccctggtattttgtaatgtgttggagggaggagacagccccactaatgactagggttgaatttcctcccagtcttctgggtaggacacagagcagattacatttgattgagtaaaagtaaggaatgtgacatttcatgcacattttatagccccaaatgacaaaaataacatgcttctcaagccacctggaacattttatagctttctgttttttttgcattgtaggctcctgtgtccatcaatttatcagcatttttcttggcaaggattccctgaaatgtctccaagtttggaaattttgtctttatgaaaagtggggcatgggaccagaggagggacttggtcagaaaaacaaaatacgattatttttgatccatgtccttatttcttggttactaaatagctgccctctgtatttctttgattttaataaatcgtccagatatggatttttaaaattctatgtatgttttttgagacagggttttgctctgtcacccacgctgaagtgcagtggctcactgaagccttcaactcttgggctcaagcaatcctcccacctcagcctcatgagtagctgggactacagccatgtggcaccatgcctggctaatttttaaaatttttttagtagagacaaagtcttgctatgttgccaggctggtcttgaactcctgaactcgtcatcctcccaccttggcctcctaaagtgctgggattacaagtgtgatccaccacacccaggcctagtttttaaaatgatatttcatttatgtagttcaaataaaaatgacatcaataagtacatgagaaatatcactcctaccccacacttaccctctctttttcccctcacattgctcgtcagtaaccatttttaccagaatagtgccttatttattctcccaacgtttctttatgcaaacataaataacatacttttatttcctcttttattacacaaaaaaagcatgttatatacatcttgctccttccttttaaaatcgtaactaaatatactgggtatccttccctatcaccacgtaaagctgttcctcctgcctttttcattttgacagctctatagtattccattggtggatcgaccagagctgtgtgttcgccagtctcctattgctgggttgttgggctgtttctgatccgttgttattataaataatgccacaatgaataaccttatacctaagcaagtttacctttgtgtaggtgaatctataagatagattcccagaagggggatctctgggtcaaagggtttgtgcatgtatagttctggtagatattgcaggtctgctccacagaactgtgccatctgcactgctgccagcaatgcatgggacagtctgtttcctctcagcctccttcacacactgtgatatcatattctggactcttgccaaccaaggaaagatttatgtataagttcaacatggatgcacttaggctaattctccttcctgcatttccttcagaacatcctcagtctcctcactcatttcagataccttaattagcttccatttttcatgacacaggttagccatgtttatatttccttcgtgatcatcacagttatgaaagatttcttcttgggttgataggttaagtaaccatggtccagtattggttattgcaatcaaaccaacagctacaggtggcttggattgttttagatggaattggtctcaaatttaaaaggtcactttgtcattctttgtatcattgttattcatgtctgtatcttttacaaatatatttatttaatatttaataagacaaataaaatgttaaaaattattttgtcctgggaaagcccaagccttcctgcacagaagttgaaatattcaaaggacaagaaaaggcctctggtacggtcctgtcttggacagtttccccggccacccagcaggctgcctattgtgctgtttgagatgcaaatgatctcttcttatgctggggaaccttctaggcatggcaggggcagtggagaggctacttcctctctctctttttttttttttttttttttgagacggaattctcactctgttactaggctggagagcggtggcatgatcttgacacactgcaacctctgcctccagggttcaagtgattctcctgcctccgcctcccgagtagctcggactacaggcgcatggcatcacgcccagctaatttttgtattttcagtagagacggggtttcaccatgttggccaggatggtctcaatctcttgatctcgtgatctgcctgcctgagcatcccaaagtgctgggattacaggcgtgagccaccgcactcggccacttcctctctttttttgcccacttctctagctagtcccaagacttgttcaactctttcttatggatggttttgcagaatacatacatggaaaccgtccacaaattctagcccaccaattaatgctgtcagactgggaacttcatgaaaagcctgcttgaaacaaaaaattgaaaataagtggcttaaacaaggtagatatttatttctctgctttatccacgaggtctgagatgaaacgtccagggcaggtgtggaggctccctggcatgatggacccaggctcctgtcttctgttcctgtcatcttagtgtgcttccttctacccttagggtggcctcatggtctgagatggcttcaggactctccacttcaggccttttggagtccatgatttcttttcttttttttttttttgagatggagtttctgtcttgttgcccaagctggagcacagtgatatgatcttggctcactgcaacctctgcctcccaggttcaagcgattctcctgcctcagccgcccgagtagctgggattacaggcacctgccactgtgcctggctaatttctgtatttttagtagagacagggttttaccatgttggccaggctggtctcgaactcctaacctcaggtgatccacccgccttggcctcccaaagtgctgggattacaggagcgagccaccgcgcccatccatgatgttctcatggccaacatcctgaggtctcccaaaggcaagggcttctttgcttgcccactggtttgggtacagatatatttgtggactctggagtccaggtgtcagggtatagcttcctgaggtgccccaggcagctggtctcctctgaggccttgatgatagcccttgacatgcctggggctgtggagctggggatggtctccaccccacagggatccacctacctcagccggtatccagtccagggcctctgtcttcttggctgccctcaaggcactgggctcctttagacactccccaccacacccttaatcctctcagggaactccagtctccagcaaacaaaggcctgaaaagtgtctacaaggaaattctgagttcaggtttctgaggtgaaggagcacaaagtcctttctcctggcttggaagtgcagggtggtgcgaagagtgggagggaggcagggttaggtgaggaaaaaacagaaaacacaaattaatttgacaatgatatgttaacttaaaaatcacaactttaggctgggcagacagtggctcttgcctgtgatccctgcactttggtaggtggaggtgggaggactgcttgagggtaagagttcgagaccagcctgggcaacatagtgaggccctttctttaccaataaataaataaataaataaaaattagctaggtgtgctggcacacgcctgtagtcctacctactcaggaggctgaagtggatcccagtagtttgaggctgcagggagctatttactccagccagggcaacagagtgagaccctgtctcttaaaaaaaaaaaaaaagaaaagaaaaatcataaatttggaaaggagagctttatttcttttaaagagttactgctgactgggcattgtggctcacatctgcagtcccagcactttgggaggctgaggtgggtggatcgtttgaacccaggagttcgagaccagcctggcaatactgatgcagaactttgctcctcagttcagctaaaaccgggttcttgtcacatgaccaggaaaagttaagcaggcagacactttgaagggtgaggggaatggaattttttgggtgaaaaaggaaaagaagaaaagaaaaacctctcagcaaagagcaaggggggttcctgccaacaggtccccactccacagattgattccaggccacacacagtagctgaagaggccaggctcctccccgaccactgcacactcggcacgaacttcccgtggctccaccccattttcccagtatgcaggcaggtgattctccagggaccctcccctttatctgtctcctgcatctatcattatctattttattttatacatttaaaacactattctgccgggtgtggtgacctgcacctgtagtcccagctactcaggaagctgaggcagcaggatctcttgaactcaggaggtggaggctgcagtgagctatgatcatgacaatgcactccatcctgggcaacacagcaaaaccttgtctcaaaacaaacaaacaaaaaacaaaaccccaccattattctcagaagtacagcagctttcacaaattgccaaaggggtctgttttaggttagtttccttcagaagcagatctggagacaaagatttgaagcaaggaggttattagagaggaaatccctggcataattgataaagtagacaggaaagggcagaagccagcatggggtgcatcgatgagcaatgaacttaatgaactccttggctcaatcccactgggaccttcaagagactactgtatagagcatgcctcggagtcatcctacccttgaggaagctggggtatttcttcaccaaatcccatttcacttgagggctgcccccagggcactgacatttctagcctgccctacccatgggtagtgctcctgtgactagggtaagtcctcaacagtgtcagaggcttaaagacggagccatctgaatggcaaccttagaggacaagtgggtagggcacaaagtttggctacaaggcctgcagcactaaaaggttaggaacgcctcagagctgccccttttaggatggacccactcagctccccggttcccactccctgacatctgctttctgtccgctgctcagtgtctccagtggattcacaaaacaactgcctttctccctttccacctcagttcattatcaagaacaaccctggggtttcccaccttaatcaggctgctccggcctctgcccacagcccttctgacacctggtttatgtgtgaccctgccacccttaacccccagcagcaggggatgtcagctttctttcagggaagaacacagactccttttgagagactatagtgagataattttgtaaactgaaaataaaatcctaagccccccagttgacttaatggaccccctcttggccaaggggaccccagagaaaccttaaaaactgagttcccaggcaggagaggatgggaggtcagacacacctcgtcatacctcatcccttttgtggtttagacaaccactgaccagcattaataaaccagagatcataagactgacagaacaaagtatttgagccaatgaaagaccaaactataaacaagacttaaggccatggcaggtcagggttaagtcacacacccctgcacttaaagaaaaagtgttctgccacaaggttttaatttttctctagcagccaaacaaacattggccttgagataagcaagattaaaacaacttgcagatcgtccatcagccaaaactacagcttgggttgaacacgagactgatttcagtaaccttctcctgataagaagactactgaccatggactggttctggctggtttacagatgctgcatacttgagtttgcttgtgtcctgaaaagaccttttgatgtataagacctaattgtaatacatttatttttttttaattaattttttttttttttgagacggagtctcactatcgcttaggctggagtgcagtggtgcgatctcggctcactgcaagctctgcctcccaggttcatgccattctcttgcctcagcctcccgagtagctgggactacaggcacccgctaccatgcccggctaattttttttgtatttttagtagagacggggtttcaccctgttagccaggatggcctcgatctcctgacctcatgatccatctgcctcagcctcccaaagtgctgggattacaggtgtaagccaccgcgcctggccagctgtaatacatttaaatgctaagtctccaccctaaggtgcacatgggtcatatgcaatatactagtttattcagtatatgtgcttcaggaccactttcatgaatattcatagctccttctgtaacctgttgaatatgtatacttggccaacccagtcagattaaattcctttcttattcctcctcgtccctcaaagttcattctctaggctctgccagaggctatgcttcccactagtccgaatggtacattgtaggctgcaactctttatttttattttatttttaaatttatttttgagacacggtctcactctgtcacccaggctggagtgcagtggtgcaatcacagctcactgcagcctcgacctcccaggctcaggtgattctccaacctcagcctttcaagtagctgggaccacatccgtgcaccaccaggcccagttaactttcacaattttcttggagacagggtttcaccatattgatagatgcaggaggtagataagggaaagggtccccagagaatctctgacctgcctatgcacttgggagaagggggtggagccacgggaagttcgtgccatgtgcagttggggaggagcctggcctcttcagttcttgtgtgtagcctggaatcagtctgggggtgggggtgctgttggcaggaactcttcttgctttgctgagagatttttttttcttcttttcctttttcacccaataaattctgttcccctcacccttcaatgcgtctgcgttcctagcttttcctgcttgtgtgacaagaacctggttttagggtttaaggaacaaagttctgcatcaataagattcaaaagaaatcattctattgaaatatgattctaggcacaggctagttgggggtctctgagccccagatcccacagctgtgctgagatgcctgcccacaagctcaaggagcatgtctaggagtccacggaggcaagcagaggcaggaagaggagaccagaattcagctgccggtggtgagcctcaggaaactctttatcaaagcctagaaaagccaaaggtgggcccgagagggaagaaagagacaaagagatgggaagaagatggaagtaggacacttagagtgggaaggaaaaagagcaagagaaagtgagagggagcagcagagccctgggaagggagcttgaaggggtggggcacgtttggaagcctctgtgattatttggggaaggctgattttctagtgccttgggctgggcccatgcaggttacttcctacccagctaccttcctggctcttctgcccagggagctccttctgccagtccccagcctactgcacttcttccttatatgcttggagtgtgtggaatgctgctcaccactctggggcagttggagactgagataactccctccctggaatgtagggaatttggtgtgctggaaagagagaaagagagagggagacagaatgtaccttgcagcagcacagctgggttctggatgggctccatctctgaaagagaggggcaaaagggttggggaaggggtagctgccggtcttagtgaagggtccccgaggcactagcgtgtcctcacatttgtgctgcctgcttcccagaagactcagcacatggggaaagtggtgccaagggcacacccaccagccacactgtggagcttggacacctggggcaggatattcagtagtcggcctggggacctccaaagatgctttcccattccttagcctgtcagccttggtagggacatcactttcctccttatccttcaatgaggacattcaagacaacatccctgagctggaggaaacccagcctcacctcctccttccacccctcatctcctaagctccccatcagtggtgtctggggtgtggaacgtggggaggcaaggaagacagctcacctggcccaggcttcaatgctcagcccctcttattccttctagcaagagcttcttgcaaatacctcaatttttttttttatcttctgcagctgatgctcaaactgtcaacttgttacttgagaccatgaatgttggttataagaatttgttgactttttaaaaaaataaaaatgatgtttgcccacttaaagttttaaattctgtttttcagaggagtttttttttttttttttttgagacagtcaccctctgttgatatggctctgatgagtggaggaacaccagggctcttgtctcacatcgaattagataagatgacacgaacacacgtggagtggttttaaggagcggagagtttaataggcaagaaagaagggagaagaaagaaagaagaaactcccttgtacagagacagagggaggggggctccaaagccgagagatggaaccccgcacttaggtaataccagccagctatattcgatgggtggaggaggcagtatctgatctgcataggactcaggggattggtttgaccaggcatgtcattcatgtagccggcgaaaaagctggccctcccaccctagccttttaatatgcaaatgtagggctgtgtcatgttccacacacgtggggatatgtgggggcggccatgctgccaggcacatgtaggggcaagggcaagaggacaaaggtgggaatagccttgttgggtggacccagtttctaacagctagcgtttgcatatcaaaggttgctggcccaagtctaagagccagggctttcatgctagacaagagctgtgaaaaattttccatggacctttttcctctctatctgcctaaaataatttcttaataactcctacctcactgtagcctaggttggagtgcagtgtggcaacatctcggctcactgcaacctccgcctctcgggttcaagcaattctcttgccatagccacccacatagctgggactacaggcacccaccaccaagcccggctagttttttgtattttagtagagaggggtctcaccatgttggccaggctggtcttgagctcctgagctcaagcaatccacctgccttggcctcccaaagtgctggaattacaagcatgaaccactgtacctggcctttcataggagattaatggctgattttacccaccaacctggtgatcatgaaccagccatctataaccttgttgatctagctcaacccattatataaaactgtgcttggattgtatggaatgctacacacttacaattaaagatatttagagctgggcatggtgggtcacacatgtaatcatagcactttggaaggccaaggagggaggattgtttgaacctgggatttccagagcagcctaggcaacatagtgagaacccatttctttttttgtcttttcttttcttttcttttttttttgagatggagttttgctcttgttgcccaggctggagtgcaattgcgcggtctcagctcactgcaacctctgcctcctgggttcaagtgattctcctgcctcagcctcttgagtagctgggattacaggcacgtgccaccatgcccggctaagtttttgtatttttagtggagatggggttttaccatgttggccaggctggtctcgaactcctgacctcaggtgattcacccccctcagcctcctaaagtgctgggattacaggcatgagccaccatgccaggtgggggtaggtggggaagcccatttctattaaaaaaaaaaaaaaaaaaggccaggtgtggtggctcatgcctgtaatcccagcactttgggaggtcaaggcaggaggatcacctgagatcaggagttcgagacaagcctgcccaacatggtgaaaccccgtctccactaaaaatacaaaaaattagccgggcatggtagcacgtgcctgtaatcccagatactcgggaggctgaggcaggagaatcacttgaacccaggaggcggaggttgcagtgagttgagatcctgccactgcactctagcctgggtgacagagggagactccatctccaaaggaaaaaaaaaaagagaaagtaaaatttgtacttcaattcagagattataaacaatgtatacttgactttgtggcagtgatcactattgtacaatagttacttaaactcaggaggcagaggctgcagtgagccaagatagctccactgcactccagcctgggtgacagagcgagactctgtctcaaaaaaaaaaaaaaaaaaaaagttactcactcatttgttctgcagaatctatttattgctgtgttcacagaaaaggaagcatcaagacggcaaagctctttgatgaaaagccaggcgtactcacacacacaactgagaaagttctggaagtaggagaaaacgtctttaaggcatataggctaaacttatataaatattgttagtgtttgccaaaacagggataatctagtaaaatcagagatacaaagccagaacagagaattggtaagtaaaaaattgttaagaatgtatattggctgggcgcgatggctcatgcctgtaatactagcactttggggaggctgaggggggcagattgcttgagctcaggagtttgagaccagcctgggcaaccctttcactactgaaaatacaaaaaaaaaaaaaaaaaaaaccaaaaacaaaactgggcgtgctggtgcgcacgtgtggtcccaattaccctggaggctaatgtggaaggatcgcttgagcccagagtgtgggggtgggggttgggaggcaaggttgcagtgagcctggattgcaccactgcacttcagcctgggtaacagagcgagaccttgtctcaaaaaaaaaaaaagtatcaaaaggcctaggaatttgttctccaggtaaatctgccctccctcatctctaacctttatgaaatcacccaaatggagacatcacagcaaggccccgacaaggaaatgaggaatgtaggtggataagggactggaatagtgcagcacaacactaactacaggtttcagccccaatgagattgccctcacttccgccgccagccacaagtgtggaggtccccaggctactcgctcctctgaccaactggctactaatctggggggtacccacaaccccctcgggtttgataatttgctagaacaactcaccaaactcaggagaatgttatacttacgattacaggcttgttacaaaggatacaaatcaggaggaccagactaatgaagacacacgtagggcggggtctgggcgggtcttccatgcagagcttctgtgtcttctctctgtgaatcaggttgtgtcaccctcctggcacatggatgtgttcaccaaccaggaagctccaccaaattttggcgtccagagttttcattacataggcacaattggttgactcatttgccaccgaattgaacgcaatctctagtcctcccaccctccgtcgaggttgggctggctctaaggcccaatccttttattatgtgatctttctgatgaccaacctcccatcgtgagttctctcttagcataagcccaggtgtgatccaaggggctcatgaataacaaagatactcatattactcaggagattccaaggatttagtttccctcctaggaaccagggacaaagggcagtcaaattctttattgttatcacagagacacagtaatataatatgatacagcagaagagaggtgaggaatgttgccatgccttgagaagcctatcacaagagctttaaggaattcacacttaaatattaataggtacattatgaaagaaatcagccaagtacagtcttttcttattatggaatctagttattgcaggaattgaaaaattgatgtaataaagcctagaatgcaataaaggaatcggcattcaagtagatgagagaggttggggaatatgtcaagatgcaaaagtgagagagctgtcacagtttacttactctgcaatctctgaggatggaacaggatcaaagatgaagccaggaagcacagagtagttttcttcctccctaatctcatcccttgttttcatttggcactttaaaaaatttccacatttatattcatatggaattgattttgagtatagagagataattctaattattattgtttttcaaatgttagccagttgaaccatttatcataatcaaggtgataatatggcttattttctttggcctacagagatgataaatttgaatatattttaaaatataaaactatctttaaaatttgaatatatttgaatatgatacatttgaatatattttaaaacatagagctatctttgtactcctggttagtcatggtgcatttttttttaatacttcatattaaatttttaccttctggattgagacactagagttcttaaaggttctttcagaaattcttcctatattcagtatgctaccagaaaacctcttacaactaaccttacagaagatactgttttctttgtactttgtccaatatcaaaggaaacctccaagttccaaggaggtcaggctactaatacccacaaatgaattctgatgagatcattacacaataaacaataactgttgcttattacatgcttactttgtactaggcaggactaagataagtattatttaagttttaagatcattcttaatttcttgtcaaaagtatactggtttgcaaagtaatgaataaaataaatctttaacaatatccctatagtaaagacaatggtgaacttcttatgcctcttttaaaaaactctgcttatgatgacaatttcaaacatacacagaagccgtgagtatataatgagtcttgctgtatccatcacaaagttttaaaaactgtcaaaagttgaccatactcacttaatctactcctaccactttttcagctggagatcttttaaagcaaattctacacattgtgccatatcatccataaattattttgcattacatcccattcttattgagtccctgcaagctgagagccgactgccaaagcacaattcactgtaagagattctgtgaagggttaaaacaaacagtccaaattcacagtgctgcaaatgtctgtaattgcataatctgcaaaatatattcttcaagaaatcctctgtgcacttggtttcccttaactgagtttttttttcttcttcagaccagattaattgatgagaactgacaagcaggggagagaggtgatgtttaaggttatatattttggcaaaaaattatgagtgtaaattgtgcttgtttctgattaagagaggtccattaatcagaaagtaaacttggcatcctcgtagaaaaatcacatagcttaacaagaattcatgactctgaattgctgcacagacaggtagcatgagttcttggcaggattctttcagctgagctgttttccattagaatggtgtctgatatggtttagctgggtctccacccaaatctcatcttgaattgtagttcccttaatccccacgtgtcatgagagggacctggtgggaggtaactgaatcatgaggggcaggtttttcccatgctattcttcttgtgatagtgaataagtctcatgagatctcatggttttataaaggtagttctgcacacgctcttgcctgctgccatgtaagacatgcctttgctcctccttcatcttccaccatgattttgagggcctcctcagccatgtggaactgtgaatgcattaaacctctttttctttataaattacccagtgtcaggtatttattcatagcagtatgaaaacggactaatacggctgggtgcagtggctcatgcctgtaatcctagcactttgagaggccgaggcaggtgaatcatttgaggccaggagttcaagatcagcctggtggtcaatatggtgaaaccccatctctactaaacaaacaaacaaaaaaaattagccatgcatggcggttggcgcctataatcccagctacttagaaggctgaggaaggagaattgcttgaacctgggaggtggagggtgcagtgaaccgagattgtgccaccgtactccagcctgggtgacagagcaagactgtctcaaaaataaaaataaaaaaagaaaatggattaatacagtaaattggtaccagtaaagtggggtactgctataaagatacctgaaaatgtggaaatgggtaacaggcagaggttagaagtttagagggctcagaagaagacacaaaaatgtgggaaagtttggaacttcctcaagacttggagggctcagaagacaggaaaatgtgggaaactttggaacttcctagagacttgttgaatggctttgaccaaaatgctgacagtgatatggacaatatttgtccaggctaaggtggtctcagatggagataaggaacttgttgggacctggagtaaaggtcactcttcctatgcaaagagactggcggtattttgcccctgccctagagatctgtggaactttgaactgaaagaaatgacttagggtatctggcagaagaaatttctaagtggtaaagctgttcaagtggaagtagagcataaaagtttggaaaatttgcagtctgatgatgcgatagaaaagaaaaacccattttctagggagaaattcaagtttgctgcagaaatttgcataagtaaagaggagtggaatgttaatcactaagacaatggggaaaatgtctccagggaatattagagaacttcatagcagcccctcccatcacaggcctggaggcctaggagggaaaaagggtttgtgggctgggctaagggacccctgctctatgcagcctggggacatggtgccctacatcccagctactttagctccagctgtggctaaaaagggccaacctacagctcaggccattgcttcagaggttccaagccccaagccttgatagcttacaaatgtgctgggcctgtgggtgcacagaagtcaagaattgaggtttgagaacctctgcctaggtttcagagcatgtatgtaaatgcctagatgtctaggcagaagtttgctgcaggggtggagcccttatggagaacctctgctagggcagtgcagaagggaaatgtggggtcagagcccctacacagagttccccaccggggcattgcctggtggagctgtgagaagagggccaccatcctccaaaccccagaatggtagatccaccaacagcttacaccatgcacctggaaaagctggagacactcaacactagcccatgaaagcagctggaaggggggctgtaccctgcaaagccacagaggcagaactacccaatgctgtgggagcccatctctcacatcagcatgacctggatgtgagacatggagtcaaagggggagcattttggaacgttaaggtttaatgactgccctactgtatttcagacttgtatggggcttgtggcacctttattttggccaatgtatcccattggaatgggtgtatttacccaatgcctgtacccccattgtatctaggaagtaactaacttgcttttgatttacaggctcataggaagagggacttgccttgtctcagatgatactttggagttggacttttgagttaatgctgaaatgagttaagactttggtggactgttgaaaggcatgattgtgtgttgaattgtgaagacatgaaatttgggaggggccaggggaggaatgatatggtttggctgtgtctccacccaaatatcatcttgaattgtagttcccataatccccatgtgtcatgggagggacttggtggcaggtaactgaatcatgggtggcgggtttttcccatgctattgtcatgatagtgaataagtcttatgagatctgatggttttataaagggctgttcccctgagcatgctcttgcctgctgccatgtacaacatgcttttgctcctccttcactttccaccatgattatgaggcctccacagccatgtggaactgtgaatccattaaatctctcttccttccttcccttccttccttcctttccttctttcttttcttttcttttcttttcttttcttttctttcgagtctcactctgtcacccaggctggagtgcagtggcatgatctcggctcactgcaacctccatctcctgggttcaagtgattctcctgccttagcctcctgagtagctgggattacaggtatgtgtcatcacagctggctaatttttgtatttttagtggagacgaggtttcaccatgttggccaggctggtcttgaaattctgacctcaggtgatccgcctgcctcagcctcccaaagtgctgggattacaggcatgagccacgcgcccagctcagaattataaattacccagtcttgggtatttcttcatagcagtatgaaaatggactaatacattatctcttggaagtgaatggccagagtgaaagaaaccagaaaaaaaaaaaaaaaaagaagaatacatactatatgatttcatttatataaaactctaggagaagcaaataatctacagtgacagaaagcagatcagtgagtgtttgagaatgggcatggcaggagggaaggaagtataacgggcatgagaaaacttttgagaggtatggatgtgttcactatcttgattgtggtgacagtttcatagtatacaaatacgacaaaactgatcaaagtgcacactttaaatctgtgcaattatgtctcaataatttttttttttaaagaatagccaaggccgggtgcggtggctcatgcctgtaatcccagcactttgggaggccgaggcgggcggatcacgaggtcaggagatcgagaccatcctggctaacatggtgaaaccccgtctctactaaaaatacaaaaaattagccgggcaaggtggcaggcgcctgtagtcccagctactcgggaggctgaggcaggagaatggcgtgaaccccagggggcggagcctgcagtgagctgagattgcgccactgcactccagcctgagtgacagagcaagactccctctcaaaaaaaataaaaataaaaaaataaagaatagccaagtggtagaaagcctgcagatgctgttccagagctgtgcccacagctctgggcccaggtcacaggtataacctgcaataagaagagacaagagtctgagggctgaccatctgtgggcccacaagttaaggaaaccaaagtttgggtgcacaaatcattactggaaagggatcctgatccagtcacttctcaagagagggttcttagacattgtgcaagaaagaatttggggcgagtccacagagtaaagtgaaagcaagtttattaagaaataaaggaataaaagagtggttacctcataggtggagtggctctgagggctgctagttggctatttttatgattctttctttcttttcctttttttttttttttgagacacagttttgctcttggagtgcaatggcgcgatctcagcttattgcaacctctgcctcctgggtttaagcgattctcctgcctcagcctcctgagtagctgggtttacaggcatgcaccactcccagctaattttgtatttttagtagagatggggcttcaccatgttggtcaggctggtctccaactcctgacctgaagtgatctgcctgccttggcctcccaaagtgctgggactacaggcatgagccacagcgcctagccaattatttcttaatcatatgctaaacaaggggtggggtatccatgaattttctgggaaagggatggagatttcctggaactgtgggttcttcttccttttagatcatatagggtaactctgggacattgccatgacatttataaaccatcttggtgctggtggggggtgacttttggcatgctaatgcattataattagcatgtaatgggcagtgaggatgaccaaaagtcacttttgtcaccatcttggtttgggccggcttctttactgcatcctattttatcagcgaggtctttgtggcctgtatcttgtgctgacctcctatatcatcctgtgactaagaattcccaacctcctgggaatgcagcccagcaggtctcagcctcattttacccagcccctatttaagatggagttgctctgattcaaacatctccgacaaaaccactgattgggtatagagtcccaaccagccagttattgaaattttgtttttttgttatcacagcctagcctaatctaactaaagaaagggggatcaggaagcaactttattttcacttcaccgtgtccctttacatccattttgtgggatttcttctccttttgccccaagatgaaatttggagcaagccccatgaactttctagtcatttgtaggtaatctaaggtcattgggttactccaattccccaaggagtttaataagtaattaaatggtccaatctcatgtaatagtagaaactttaaactttatttaaatttgagatttcttcccgtactttatgctatttacagaccagccacgctcaatgggaattgaggtgtgtggtgacctctgatttcccactttgcgctttgtggcagaaattgcagttatcaccaaatattcattctcctcttcttcctgattagtaagactcccaaatttttgctggacttatggccagcctgaaacaagactacattttccagtatcccttgcagccaggtgtggctgtgagactaacttttggccaacggatctgaatcagaacaacataagcaaccttttgttctgccctcaaacagcatgggtggcattagtttcccctttccttctttccctggctggaatgctgacccagcagatgtggggagccatttcaacctttcaagagagagcagccctcgatgcaatggcagagcagcaagacagaaggagctggggtctccaacaccgcggagtcactctatccagcctaagactcctgatgttggaactgttaatgagaaacacactttgtcttttgacatacagtttttctctcagctgctgaacctggattctacctacacaggttcattgtgtatgcatgcttctatccctcctccctcatcttgctaacttggaccctggacctctccagggttccagtggtgagagggaggggccaggaggtttcattgcactagaattactgtgagatggcagaagcactgcctgggtcattaggcatagctgattcttcctttcatcaggcacttccgttgatttttctgagctaacaccttccctttgctacgatttctcatcacctaattccctgaggtggacaaatgcccttccttaggctggtcaactatatttctttctgcagcttctaagagtctgacgattcatccctctattaggatcaccaaaccccttcagatgacccttttagacagagtctaatgccatcccctgccatctctctcttatggtggccccacctgtggtccacaggaaacatgaatccagtgcccccggcaattgcggaaggctggcagccctgaaacccagctacctcccttgttccaccatcagggcaggtagccagactcctggtgttcttttttgttgtgtgtgtgtctttgtgtgtatatgtgtttttccatttccagaaatgaaccagctagctgctcaccctgtcctccaaattgcaggaacatatattcagctccctgacgggtaccaccaaaggccctttcctggggctcgaagaaataccctcactgaattcaatttcctcaagtaattgaagatcttcccctttcccctttcctgttccactcgatggcccccactttatggggacactcccaggccggggactgcagagttgctctgctacttttggactctggtccatctcattttttcccccctctcttccatttaagaggagattcaacctttttagaagctcactgttttgagtaagagccactgtttgccagatcccagccccctctgcctctaccatctgcctcatctcttctatagctgcagaggaattaacatcctcggaagatctagtgaagctgccttcactttctctttctgccttcacatttctctttcagcccacctcaacctgaggccacaggcagctgggctccaccagtgccactgccaccatcccaaaaggccaggggctctcatcccagtagtagtaattaatctgtcatgcacaattcatagtatttcaacattaggttccaaataagtaacctgagcatccctgggtcttgctaacctatgggaatgtgcaaatggggccaccttaagatagtaacaacatttcagtgtctccttctctgcccaagtatttctgggggtctgagggaaatctcactcgtgctcctaaatccaggcacccaggccaacagcaactctccatcgcctgctgagcattcccccagggaaccggagcccttcaggcatcaattctgcattgggcagagcagtgtctatgtccagtggggaaatgcctttcccctcttttgtgttcctgttcacgaaggggccacccaagcaatgctggtgggctccagcattgtgcagagcttgtagaaccacagcttctatgttgaccttcagctttctttttgcttcggatggaggcaggactggactaaatgtggtgacaaacaacattcatttactcttttattcaacacatatttcctaaattccttatccatgctagccacatgatgaacatgataaacaagataaacgtggtctctgtgcccatggagtttatggtttggtacaagatcaaaaagcggtatacacatacacaaacacgaacaaaaaagcagttatgatttaatgtccaagactttgttattggttcaagtttatcatgcatggatgcttcttctgcttggatgagttttgtgcgtgcagcttgtcaactctcaggcaaacaaacagaccctgtcaacccactgcgacctcactgctcccgggctgcctgctggggcccagtgagggaggttaactcttactgtgctaaagtgtctgatttgtttcaacactctaacaaccaaagaaaacactgattgtatctcttaaagagcttttcttccttccccattccacactatgaatttatgaattccaaacttcacactttatgtaaatttgaagcttctggccaagcgtggtggctcatacctgtaatcctagcactgtgggaagccaaagcggatgattgcttgagctcaggagttcgagaccagcttggacaatgtggtaaaaccccgtctctaccaaaaatacaaaaattagccaggcatagtggcacacgcctgtaatcgtagctactgggaggctgaggaaggaggatcactggagcccaagaagtcaaggctgcagtgagccatgatcataccactgcactccagccttggagacgcagcaagaccctgtctcaaaaaaataaaataaaaataaaataaataacatttgaggcttcttcacttactttgtgccatttacaggccagctgctcctggtgagaatggaggtgtgtagtgatctctcacttcccactgtgtgctttgtggcagaaactgctgttgtccccaagtatccattctcctcttcttccttactaatgagactcccaaatttttgctggacttgtggccatcctgaatcaagactacatttcccagtatcacatgctgtgggactagcttttggccaacatgatctgaatcaaatgatgtgagcaaccttttgttctgccctcaaatggcaggggtgatggcaaaaattctggcagcaaaaatggatgatgtggccaggcatgctggctcacacctataatcccagcactttgggaggctgagatgggtggatcatctgaggtcaggagtttgagaccaccctggccaacatggtgaaaccccatatctactaaaaatacaaaaatgagccagatgtggtggcacccacctgtagtaccagctactcaggaggctgaggcaagagaatcacttgaactcaggaggcggaggtggcagtgagaagagattatgccactgcactctagcctgggcaacaaagcgagactctgtctcgaaaaaaaaaaaaaaaaacgatggtgaaggcctatatattagtctgttttcatgctgctgataaagacatgcctgagactgggtcatttataaagaaaaaggggtttaatggactcacagttccatgtggcaggggaggcctcacaagcatggcagaaggcaaaaggcacatcttacatggtggcagacaagaagagaatgagagaccaagtgaaagggatttccccttataaaactatccgatcttgtgggacttactaccacaaaaacagtatgggggaaaccactccctgtgattcaattatctcccatcaggtccctcccacaacacatgggaattatgggaactacaactcaagatgagatttgggtggggacacagcccaaccatatcattctgccccagcccctcccaaatctcatgtcctcacatttcaaaaccaatcatgccttcccaacagtcttaactcatttcagcataaacttaaaagtccacagtccaaagtctcatctgagacaaggcaagtcccttccaactatgaggctgcaaaatcaaaagcaagttagttacttcctagatatagtgggggtataggcattgggtaaatacagctattccaaatgggagaaattggccaaaacaaaggggctacagtccccatgcaagtccaaaatccagtggggcagtcaaatcttaaagctccaaaattatctccattgactccatgtctcacatccaggtaacactgatacaagagatgggttcccatggccttgggcagctctgcccctgtggctttacatggtacagcccctcttctggctgctttcatgggctggtgttgagtgtctgttgtttttccaggcacacagtgcaagctgtgggcggatctaccattctggggtctggaggatggtggccctcttctcacagctccactaggcagtgccccagtggagaccctgcatgggggcttcaacctcccattttcctcccgcagtgccctagcagaggtcctccgtgagagctccaccgctgcagcaaacttctgcctggacatccaggtgaaatctagttggaggttcccaaacctcaattcttgacttcagtgcacccacaggctcaacaccatgtggaagctgccaaggcttggggcttgcaccctctgaagccatgacccaagctgtaccttggccccttttagccatggctgggatgcaggcaccaagtctccaggctgcacacagcaggggggccctaggcctggcccacaaaaccattttttctccctagtctccaggtctgtgatgggaggggctgctgcaaaggtctctgacacgccctggagacatttaccccattgtcttggtgattaacatttgactcttcattacttatgcaaacttcttcagctggctcgaatttctcctcagaaaatgatttttttggctgggcgtggcggctcaggcctgtaatcccagcactttgggaggctgaggcaggtggatcacttgagttcaggagttcgagacgagcctgggcaaaaccccatctctacaaaaaatacaaaaattagctgggcacggtggctcacgcctgtaatcccaacactttgggaggccacggcaggcagatcacttgaggtcagtagttcaagaccagcctggtcagccaacatgatgaaaccctgtctctactaaaaatacaaaattagctggacgtggtggcatgtgcctgtaattccagttacttgggaggctgaggcaaaagaattgcttgaacctgggaggcagaggttgcagtgagccaagatcatgccactgcactacagcctgggtgacagagctagactccatctcaaaaacaaacaaacaaaaaagaaatgggtttttattttctatcacatcgtcaggctgcaagttttctgaacttttatgctgtgtttcagttttaaaactgaatgcttttaacagcacctacatcacctcttgaatgctttgctgcttagaaatttcttctgccagataccctaaatcatctccctcaagttcaatgttccacaaatctctaggtcaggggcaaaatgccaccagtctttgtggtaaaacatagcaagagtcacctttactccagttcccaacaagttcctcatctccatttgagaccacctcagcctgtatttcattgtccatatcattatcaggattttggtcaaagccattcaacaagtctctaggaagttccatactttcccacactttcctgtcttctgagccctccaaactgttccagtcgctacctgttacccagttccaaagttgcttccacatttttgggttactttacagcagcatctcactcccattaccaatgtactgtattagtcccttttcatgctactgataaaaacatacccaagactgggtaatttataaagaaaaagaagagatttaatggactcacagttccacatggctggggaggcctcacaatcacaattgaaggcaaaagccatgtcttacatggtggcagacaagaacagaatgagagactaagtgaaaggggtttccccttataaaaccatcagatctcatgagacttattcactaccatgaaaacagtataggggaaaccacccctgtgattcagttatctcccaccaggtccctcctgcaacacatgggaattataggagctacaattcaagatgagatttggctggggacacagccaaaccatatcagtttataatcccagcactttgggaggccaagacaggattatcacttgaggccagaagttggagacttacttgggcaacatagggagacttcctctctaaaagcaaacaaaaaaccaagttatccaggcatggtggcatgttcctgtagtcctagctgttccagaggctgagttggaaagatcacttgagcccaggagttcaaggctgcagtgaaccgtgattgtgccactgtactccagcctaggcaacagagcgaggccctctttctctctctctctttttttaaacaaggaagaaaaaagaaaagaaaatagggtggtgaggaggctggccaaagtggtgataacctcgtgcactaggtcctagcagctggtagcaggggagccaggaggtgtagcactctgcctggtaaagcagtctgtcagggtctgtttgcctgagagttgacaggctgcaagcacaaaaatataaaagggggccagggacttgctaatcttgccggagagtcggcgcagctcagtgcaaggacttgggaaggcagggaactttgagagaaggtaaaaaggaggtggattcatggagagggaaggggaaagttgagggttggggaggtgtggtgaggagctgagatcttggagagacattcttcgttggcctagggacaccacataaacacctctgtgcatggtgggagggaccagctcctccccaaacactgtttagattttggccttgaaaaccatgactactaacgttccttgggttttctgtgagtgtgaccagtctcctcagctcccagctggcacataaaggagatgtgttcttttcttgccgatgtgaggctacaggatctcatgaggaacatcccatgaacaaacagtacggctgagccctcacctgcgtctcatcctaatcttggtcctcccccagcacactcccagctctatcgcctggagttacagacaaacccgcagaccaatgtgaaaagccaattgcccagagaaacccagcagagtcttcagctacgcctgacagtcatccggggttaaacaccagcctggaattttagcttcctgtccaggaaaaaccaaatacataaatcacttctctctctctctcttttttttaatggagtcttgctctgtcacccaggctagagtgcagtggtgtgagctcagcttactgcaacctctgcctcccaggttcaagcgattctcctgcctcagcttcctgagtagctgggattacaggcgcgcaccaccatgcctggctaatttttgcatttttagtagagacagggtttcaccacgttggtcaggctggtctggaactactggcctcgtgatccacctgccttggcctcccaaagtgctgggattacaggtgtgaaccaccacgcccggcctaataattcatcttactactagaatttcaggcttcctttttaatttgcttgctttcttgttggtctgtgtcttggaacataggaactttcaatccctccaatatgggctccatccaaatctcaagttgaactgtaattcccagtgttggagtgttggaggagaggcctggtgggaggtgattggatcattggggcagatttcccccttgctgttctcgtgatagtgagtgagttcccacgagatctggttgtttgaaagtgtgtagtagagccgggcgtggtggctcacgcctgtaatcccagcatgttgggaggctgaggtaggcggatcacctgaggtcgggagttcgagaccagcctgaccaatatggagaaaccccgtctctactaaatacaaatttagccggcatggtggcacatgcctataatcccagctacttgggaggctgaggcaggagaatcacttgaacctgagagatggaggttgctgtgagccgagatcacgccattgcactccagcctgggcaacaagagcaaaactctgactcaaaaaacaaacaaacaaacaaaacaaaacaaaaaaacaaagtgtgtagtacctcccccttcactttccctctctcccactccaccgtgtgaagaaggtgtttgcttccccttgcccttctgcccagattgtaagtttcctgaggcctccccaagcatgattcttgtacagcctgtggaactgtgagccaattaaacttcctttcttcataaattacccagtctcaggtagttctttatagcagtgctaatacaccctgttacaggactaatacaccttccctctgctaagtgtctattgatctgaaaacacatgctatgaaacattaaaacgctacctgagaccatgtgtttcttttatcaagtgagagattcctttataatttggataatttcactccgtttgcaagtaggatgctctagaactgatgttataaagtcagtttaatgatttaaatcccattgtggagaaaatagatctctgcagaaaagtacatccctgccctttcccagctccccagtcaagggggggcttcctgctgagcctggagaatgcctctaagaaggtgactaatgtaccatatctggcccctagtgtgggcagcaggcaagtagtcaggtgccttctcaagtggagaaagttgaacgctattttccagagacattggatgtgagggtgatctggctatgacatctgtcaccccagtgattgccactgttgattctgctgatctagctggctaggtggtgtccccttcttccctcaccactccatgtgcatccctcctgaagctgtgtgctcagttgaagaggaggaccatccccaatagaggaggaccagtcttcggctaagggtatacgagtagctgcgctcccctgctagaatctccaaacaagctctcaaggtccagagacaagatgtgaacttcatgtctcaattgatgatcacgtggttgtgtggtggtgcagattgtgtttttgatgtgcagcaggatttgggcagtacagaggatgatgtcagcatatcaccatcatcctcaggtggggcagatcattatgaagtccttgcctctggtttccctggagtctaggtgagaggtgcatgagatatcccttgggtacctccctcctcccctcaaggtgaatgtttcatcaacaaaatcaagctaatagaagtctcaggttgtcacttttggtgtcttgaataggatatttgtgtgagagcccctttgattaacccattgccagccccctcccaccctgacctctgaaccttcacaatatccatcccttaccctccccgctgaccaagtggctctggatcccagtcaggcgctaaaaatctgctatttgtgcttaggttagctttacccatagctgaatggctctgaggttcacggtggaagatctctaagggggacagttttgctgctcctgggatggaataggtatgatggtgatccatccacctgcaagttctggtttcccagtacgtatatgatttagaattagaagcacataatacatagccttgttactggcaccccttcccctaatcttgctttccctttgtattaggccattcttgcactgctataaagaaatacttgagactgggtaatttgtaagaaaagaggtttaattggctcacggttctgtaggctgtacaggaagcatagcagcatctctttctggggaggccccaggaagctttcaatcacggtggaaggtgaagggggagcagggatctcacatggcgggagcaggagtgagagagagtgatggtaaaggtgctacacctttttaaatgaccatatatcacaggaactcactcactatggtgagtacagtgctaaaggggatggtactagaccatttatgagaaatctgcccccacgatccaatcacctcccacaagaacccacctccaacattggggattacatttcaatataagatttgggcagggacacggattcaaactgtatcacccttcatatcatcctttataatactatgccaatctgatcatggccaggttcaacttcttttttaaaggcttcccagagactactgaatcttatgacccaaatctctttgcatggcagacaacttgctgaagaaagcctgtctggctgggttcagtggctcacacctgtaatcacagcactttgggaggcctattcagtttgcgcctaggagttcaagaccagccagggcaacaaagagagaccactgtttaaaaaaaaaaaaaattagccaggcattggggtacatgcctatagtcccagctactgaggaggctgaggtgaggggatcacttgagcccaggaggttgaggctgcagtgagctgagatcacatcactgtactccagccttagtgtcagagtgataccctgtcttggaaaaaaaaataaaaaagaaagaaagcctgtctgatttcacgaaaggtttttgcaggacacgcttttagtttccacaaaacagccaccctctacttccttactggcaaagctttcatgaatattatttatttgccatttcagtgctgctttctcagatataggcataccttggagatattgcgggcccagttccagttcatcacaataaagggaatatctcggtaaagtaagtcactaagtttttgttttcctagtgcacataaaagttatgcttacactatattatggtctattacgtgtgcaatagcattatgtcttaaagaagtacataccttaattttaaaatactttattgctaaaaaatgataatgattatctgagccttcggagagttataatccttttgtgggtggaaggtgtgttgctgtctgatcagagtgggggctgctgaagcttaagtggctatggcaatttcttaaattaagacaacaacgaagtttgccacatcgattcactcttccttttgtgagagatttctctgtagcatgtgatgctgtttgatacatgttacccacagtaaaacttcttttgaaattggagtcaattctctcagaccctgctgcttctttattaactaagtttatgtaatattctaagtcctttgttgtcatttcaacaatgttcatagcatcttcaacaggagtagattccgtctcaagaaaccactttctttgctcatccacaagaagcacttcctcatctattcaaattttatcatgagattgcagcaattcagtcacatcttcaggctccacttctagttctctggctttttctaccacatctgcagttaccgaagtcaggaacccctcaaaagtcattcatgaaggtttgcaccaaacttcttccaaacttttgtaaatgttgatattttgacctcctcccgtgaatcacaagtgttctttttttttctttctctctctctcttttttttttttttttttttttttttgagacagagtcttactcttgttgcccaggctggagtgcagtggtgcgatatcagctcactgcaacctctgcctcccagattcaagcaattctcctgcctcagcctcccaagtagctgggattacaggcctctgccaccaggcctagctaatttttgtatttttagtagaaatggggtttcaccatgttggccaggctggtttcaaactcctgacctcaggtgatccacctgcctcggcctcccaaagtgctaggattataggagtgtgtcaccatgcctggctaattttatatttttagtagagatggggtttcaccatgttggccaggctggtctggaactcctaacctcaggtgatccacccacatcggcctcccaaagtgctgggattacaggtgtgagctaccgtgctcagctcacaagtgttcttaatggcatctagaatgatgaatgctttccaaaagattttcaatgtattttgcccagatatgtcagaaaaatcactatccattgcagctataaccttacaaaatttattcttaaataataagacttgaaagttgaaatcactccttgatccataggctgcagaatggacactgtgttaccaagcatgaaaacaacatttatctccttgtatctctgcatcagagctcttgggtggccaactacattgtcaatgagcagtaatattttgaaagaaatcttttttttcctgagcagtaggtctctcaacagtgggcttaaaatattcaacaaaccatgctgtaaacagatatgctgtcatccaagctttgttgttccatttataaaacacaggcagagtagatttagcataattcttaagagccagagggttttcagagtggtaaatgaggattagcttcaacttaaagccatcagctatattagcctctaacaagagagtcagactgtcctttgaagctttgaagccaggcaggcattgacttttcctctgtagctatgaatgtcctagatggcctcttcttccaatataaagctattttatctacatggaaaatctgttgtttagtgtagtcaccttcaccaattatcttggctagatcttctggataacttgatgcagcttcttcatcatcacttgctgcttcacctcgcacttttatgttatggagctggccttctttggtttgggtggcaaggagagaaggttggggtttgtttttgacatacaaatcactttttaaaacttcaacaataacaaattaatactgtgtttgtgtgtgtatgtatgtgtgtgtgtatgtgtttaagagagatagaaaataaatgtttcttattgtttgaagctacttacttttggggcaatttattatgcagcaatagataacaaacacaatggattttcaccaaattttaaggtttgtttttttttaattaaaaaatgacttaaaatatatgctatgtggcatacagcgtatctaatttagtggttctgtggtatcacctcaaagaaattagcagttttacaccagagcaaattaaagtgatgtataatgtgaggcttggaaagatagtctatgccttttaagatattgtgaatatagaaaacaaacagaaattgcaagtaggaaccttatataggaagttataactgtgagcacttcaaattacaataactaatttgccatccggctgcttcttacatgggcaactccatagaaccattcttaaggctcattacaaacatacttatttatgtcagttggtaaccgggaacaacatagggttcagctagtctttgacacaaaaatatcattaatttgttgtgggaagtcagggaccctgaatggagggaccagctggagccaaggcagaagaacataaattgtgaagatttcatggacatttagcagttccccaaattaatacttttataatttcttacacctgtctttactgcaatctctgaacataaattgtgaagatttcatggatatttatcacttccctaatactcttataatttcttatgcctgtctttaatctcttaatcctattatcttcataaactgagaatgtacgtcacctcaggaccactattgtacaaattggttgtagaacatgtgtgtttgaacaatatgaaatctgattgtaaaacatgtgggtttgaacaatatgaaatcagtgcactctgaaaaagaacaaagtaacagcaattttcaggtaacaagaaaagataaccataaagtctgactgcttgcagggttgggcagaatagagccatatttttcttcttgcagaaagcctataaacagatgtgcgaggagaaatatcgctgaattcttttcccaggaaggaataaccctggggaaggaatgcattcctcgggggaggtctgtagatggctgctctgggagtgtctgtcttatgtggttgagataaggactgaaatatgccctggtctcctgcagtaccctcaggcttactaggattgggaaattccagcctggtaaattctagtcagaccggttctttggtctcgaaccctgtttcctgttaagatgtttatcaaaacaatacgtgcacagcgggacatagaccctcatcagtaattctaattttgccttcgctttgtgatctttattgcccttcgaagcatgtgatccttgtggcttactccctgttcgtacatcccctccccttttaaaatccctaataaaaacctgctggttttgcagctcggggttgtcatcacggtcctaccagtatgtgatgtcaccgctggaggcccagttgtaaaatttctctctttgtactgtttctctttatttctcagaccagccgacactaagggaaaatagaaaagaacctacattgaaatattgggggctggctccctctataatttgtcttcatacttcatggggttttatgaaggtcaaagtaaataatgtgaggttttggcaacacaaaagaactatacagatgtatcactgtgattatatatcaatcaagaaaggtcagccaggcgtggtggctcacgcctgtaatcacagcgctttgggaggctgaggcaggcagatcacgaggtcaggagatcgagaccatcctggctaacacgatgaaaccctgtctctactaaaaatacaaaaaattagctggatgtggtggcacgtgcctgtaatctcagctacttagcaggctgaggcaggagaattgcttgaacctgggaggcggaggttgcagtgagccgagatcatgccactgcactccagcctggcaacagagcgagactctgtcacaaaaaaaaaaaaaaaaaaaagtcaagttttgccatggttaaaaaaatctttacttttttttttgagacagagtctcactctgtctctcagactggagtgcagtggcatgatcttggctcactgcaacttctgcctcctgggttcaagcaactctcctgcctcagcctcctgagtagctgggatcacaggcacctgccaccacccccagctaatttttgtatttttagtagagatgggttttcactatattggccaggctagtcttgaacccctgacctcaagtgatctacctgcctcagacttccagagtactgggattacaggcttcagccaccatgcctggccaaaaatcttaagatgtttacaacatccaagatttatttttgctcatgctatatgtattcattgcaggttggctatggccctgtccatgtcatctcacaccaggacccagatggcagagctggagcagtgacaggtgtcatgagaggagaaagagtcatggagaaccacacactggcctttgaagctatttcctggaagtgatatatgttgcttctgctcacatttgattggccacagaaggtcacatagccaaacctgatgccaaggagtgaaataatgtaatcttcccatatttttgcattttctattgttctttctttcttcctgatgctccaagatttcttctttatcctctcctgtttgtctcaagagttccttttaggctaggtgtggtggcttacacctgcagtcccagcactttgggaggctgagacaggaagatcacctgaggccaggagtttgagagtagcctgggcagcatggtgagatcctgcttctacacgcacacatgcacacacacacacacatacagaaaagaaagaaagaaagagaaagaaagaaagaaagaaagaaagaaagaatttcttttagccattcttttagggtaggtctgctgatgacaaattcttttcattttccttctcctaagaatgtcttgatttccccttcattcatgaagggtatttttgatggctacaggatactgggctgacagttattttcctttggcacttgaaaaaaatgtcatttccttttggttttcatggtttctgaaaagcaatcttctgtcatttggattgtttttcctctacaaatactgtgtcatttctgattggtttcaagattttttagtttccagaagtttaattatgatgtgcctctgcatggatttctttgggtttattctgtttgggatttgcttagcatcttgaatctgttatgttttttccccctaaatttaggaaaatttttagccattattcctttcaattctttttcagctccatcctgtttctcctctccttctgggaccccaataacatgaatgctagatcttttgttacagtcacatagttatgttcattgtggtctgaggttacgttcatttttttcctatctattttctccctgttgttcagattggatgaattctgttgttctatcttcaagtttactgagtcttttctctgtcctctccattctgctgttgtgcccattcggtgaattttaaatttttattatggcatttttcagttctaaaatttccatttgattcttctttatatcttctatttcttttctgagacttctcccttttttatttgtttcaatcatatttacaatgacttgttgaaacattttttatgacggctgcttccttgtcagataattgcaacatctgtgttatcgtgatattgacatctgttgtcttttcttattctggttgagattttcctggttcttggtatggcaagtgattttcaattgcatcctggacatttggatattatgttatgagactctggatcctatttattaatttattttgagacaaggtatcactctgtcacccagtctggaggagtgtagtagtgcaatcttggctcactgaaatctctgcctcctagctcaggtgatccttccgcctcagccccccaagtggctgggactacaggcatgtgccaccacacctggttaatttttgtattttttgtagagacagggttttaccatgttgtccaggctgttctcaaactcttgagcccaagtgatccacccaacttggcctcctagagtgttgggactacaggtgtgagccattgcacccagcctctggatcctatttaaatcttctattttatcaagcctccttgataccacactaacagaagggtgtgtgtgtgtgtgtgtgtgtgtgtgtgtgtgtgtgtgttagggggtgttgtctggttcctgctgagtgagaggtgaaggcttaggttcctcacttggcttccattggtgggggtaggaaacctcagtcctgctgggtgcagatgagtttttgggctactctctaggcctctgctgatatcattctggctaggagcgggaggggtaccactagccatgtggttgccactgataacctgggggtaaggtggagggacagaggctttatcaccactggatgatggtacaagttccagctttcctcttggcttcctctactcagaaggagtgagaggaacacctcactaccactgagggtgaagaggaaatccaggaccccatgttacctccactgacactgtggggtatgcttttcaccgttagtgtgaataaatgtctgggcttttgagatatcttttcagatttttttctatgtctgacgacttatggctccaactggatcctccaactgctcctgtggccccacccagaagtgactcagcatgtatgaggaccatttcccacacccctatgattgcaaccaatcagcagcaagcacccattgcctagctactccccttcttcccccaaactatccttggaaaaccctagtctcagaattttttctaagaggctgatttgagcataataagactccagtcttctccttcgccagctctacatgtgaaaaactctttctctactgcaattcccctgcctttataaattggctctatctgggcagcaggcaagaagaacccattggacacttacagtcccaacagttttaagttccacttctcccaacagtaagtaatctgctcattaacacacgctttattggctcttctcccttccctgtctcactcttcccagcccttcactcagtgcccctcctaaataaactacttatatccaagtacttgtcccaggatgtgcttttggagaaacctaaaataaaacagtaatttttgtggctattcatacctattaatggacatttaactacttacctttccttttcttatttatttatttctgtatttatttactcatttttgagacacagtctcactctgtggtccagcctggagtacagtggtatggctcactgcaacctccatctctcaggctcaaatgatcctctcacctcagatgcctgagtagctgcgatcacagatgtgcaccactacacctggctaattttcgtatttttttgcagagacggggcttcaccatgttgctcaggctgttctcaaactcctggcctcaagtgatttgcctacctgggcctcccaaaatgctaggattgtcagaggcgtgtgaaccacagcaatcccatcttaaataagagctgggtaaaataaggctgaaacctactgggctgcattcccacatggttaaggtattctaagtcacaggatgagacagcaggccagcacaaaatataggtcataaagacattgctgataaagcagttttcaataaaggagccagccaaaacccaccaaaaccaaaatggcgatgagagtgacctctggtcatcctcactgctacactcccaccagcgccatgacagtttacaaatgccatggcaatgtcagcaagttaccctatatggtctaaaaaggggggctgggtgccctggctcacgtctgtaatcccagcactttgggaggccgaggtaggcaaatcacttgaggccaggagttcgagaccagcctggccaacatggtgaaaccttgtctctactaaaaaaaaatacaaaaattagccaggcctggtggtgcacgcctgtaattccagctactcagggggctgaggcagaagaatcacttgaacctgggaggtggaggtggcagtaagctgagatctcaccactgcactccagcctgggcagcaagagtgaaactccatctcaaaaataaataaataaataaaataaaaaataaaaaggggaggcatgaataatccagcccttgtttagcatatcatcaagaaataaccacaaaaacgggcaaccagccgccctcagggctgctccatggagcagccgttcttgtaatcctttactttcttaataaacttgcttttactttgcactgaggactcacccagaattctttcttgtgcgaaatccaacaaccctctcttggggtctggattgagacccctttcctgtaacaggattacagccgtgcgccacctcacctggccttttttttttttttttgagatggagtcttgctctgtcgcccaggctggagtgcagtggtgcggtcttggctcactgcaagctccgcctccccggttcacgccatcctgccgcttcagcctcctgagtagctgggactacaggggcccgccaccacgcccggctcgtttttttgtatttttagtagagacgaggtttcaccgtgttagccaggatggtctcgatctcctgacctcgtgatccgcccacctcgccctcccagagtgctgggattacaggtgtgagccagggcgcctggcctcacctggccaattcttgattctatcctgtaaactgtccttggagttttccccaggtgactgccctctgacttcttcactttgtgaatcagtccttcacatcttcctctcttagtagcccagaaaccccaggttctaacttccttgtgacacaggagttaagaagaaattacttaggtagacagtgaggttaccgaagttcttggtaaggtttctcttttaatggaaagcaggcccaaatcatttttccttctaacaaagagcagcctgtaaaatcgggctgcagacatagatgacggcagttgtgccaatcatgttcaaaatggcggccccatcatcccttctctgtcagccacaggtgcagtaaggagccgacaaaatggcaccctccgagagagttcatttgcataataagcttagggtggggcggccagccttcccagctatgtaaacaaacacctgatcaaaccaatctgtgagtcctaagtaaatcagacgccgcctcctcaagctggactataaattcggctcatctgcctccagctgccccttttctctcggaagtcccctctctcactagagagagagctgttttcctttctctttcttttgcctattaaaccttccctcttaaactcctcgcgactcctcgcgtgtgtccgtgtcctacattttcctggcatgggatggcaaaccccgggtatttaccccagacaactggctgcttcacttgcactggatcttgagggtcggggagatttttgacctttaacagggactccatcattgcaagttttccttggagactcttgatggcccaggtttagtttatacctactgtgagagcaagaacttgagtaatgtatggatggacctttttggaaggaaaacaattttcatggacttaaattatttttataatttaaatgtgtggaaacacaactaactatgaattccttatgcttcagtagttaagcagttataaaaccaaagcaaagtagccataggtacaaacaaaagtataaagacaagtttaacattaatgtaataaatagtgtttttctgaaatgaagttgctgctggcaacagaccatgtactgcctgatgaaggttcttccgcacttggcacaatattccactgtgtgcctggcgatgactcaattcttccccttctcatgtctgttcaaattactaagaaatctttgttagaacttgtctcctggccttcacttggtacaaatgcgaccaagacaattaaagctataaataggtaaatgcaaatgcaggtactcacaagcagggccaggatcagttacaaatgacccaaaacatgcttataacacttttcaaatgctactaaggaaagttagacatggaacttaatagttttcacaggtattcacgagtcctcaggagtccagagacctcagtttgagaacactatcctagcactgaccttgacttccagggtgaccttgaggtaagcatttaccatttttggatctctgtacattttttgtacacaagaataatttgggccaccagtgttcttgggagataaaagaagttagaggagttaatgacaatgttccaagatgttcaaggactagagagaaaggataagaatgtattatagacctctagagttggaaaaagaatggtggctgagatcctccagcctagctttggctctgtaatcaaaaagactcagatttgggccaagcattgtggcacacgcctgtaatctcattacactgggaggctgtggcagaaggatcgcttgaggccaggagtttgagactagcctacgtaacatggtgagaccctatctctaccaatctctacatacaaacaaaaaatggctgggcgtggtggctcatgcctgtaatcccagcactttgggaggcggaggcgggcggatcacgaggtcaggagttcaagatcagcctggccaacatggtgaaatcctgtctctactaaaaatacaaaaattagctgggtgtggtggcgggcacgtataatcccagctactctcaaggctgaggcaggagaatcgtttgaacccgggaggcagaggttgcagtgagccgagagcgtgccattgcactccagcctaggcaacagggcgagactctgtctcaaaaaaataaaaataaaaaataacaggacatgatggtgcctgagccccagctatttgggaggctgaggtgggaggatggcttgagaggttgcattgagttataattgtacccctgcactccagcctgggtgacagagagcttgtctctataaaacaaataaacaaacaactgagatctgaattccagatctgccatttactgtgtgtgtatgggggatggggatggagagcaacttttctaactctcagtttctaccctaagtgggcatgtttcaaaatgccacatcacagaactgctgtgtgggccaaatgagatggctctggaaagcgctgagagcagagcctggctcacagcaaggctcagggatcctaagacgctgctgagaattccacaggctttttagcaaaggacaatagaaaagagaaagtgaagattctaacattctgcctataaatgacaacatctcctatatgtgcaaattaggtcattgtaccctaaatagccccgcagctgccctgggcttccagtcagcctttctgacctctctcttgggtctgctgctttggggtgcttcctgccattccctgcccaagcctgaatctctttcctggccgctttcactttccttccattttccagtaattggagttggtcacctgtgcagcaagcgcccccaagtggccttcctgttcactgtccggaccataaggcctaaagaatactccgataagtttatcaaggccgggcttccgcagaggcaggactcaccaggcttagcggtcggtccagggtcggtccagtctggaggcccagggagccattctacatccccctttccattttggaagactgagatggaggaatccaggggaagttctgggtaggaagcagccacttgccattaagtggcaattaaattgctattgcaatttaaggtaaatcgcagcccctctgggcctagttttcttttttctcactctttttttggcgatagagtcttgctccgtcacccaggctggagtgtagtggtgtgatcatagttactgttacctcgaactctggggctcaagccatcctcctgcctcagcttttgggtagctgggattacaaggttttctttttatgagagccctgccccactcatgtcagagggccctgaggaggcaaacacaggatggttgaaaatgctagtaaaacacctaggatgtgcactgctgtcctggctggaggcttagggggagcaccatgggacgtacacaggataaagtgggattaactcctccctcccctcagccattactctgaactctgcatcccacatgctgctgccaaaaaccacttttaaaagaacacaaatctaaacatgtcatttcccagctcaaaaccccaaggttctttctcctcaccttcagaataagccaaactactcaatgataggttccaaatctgcctttctggtttcactcatgggatggacccttcttccaggtgaggctgcatttggacatagccatattcacgcctccctgccttggctcctccgcttctctggccaggaatggccttgcctcatctctgcaaatcttagcatgacttaaggcccagttcaagctccagctcctccctgaggtcttcctgagtcttgtctcctgtcccactcaggaggacctggcctcctccttccctgggttcccatgaccctttccagctctgcctgtagcacggtgttctgtcttctgtgactacatatatacgcctaacactctctagattgtaaaggcctggaaggtggggagtgggttccattactgaatgcatctttcatagctctcgctgtcagagccctgccctatgcaaactcttttatttttatttatttatttatttatttatttattttgagagggactttcactcttgtatcccaggctggagtgcaatggcgcattctcagctcactgcaacctccacctctcgggttcaagcgattctcctgcctcagcctcccaagtagctgggattacaggtaaccgccaccatgcctggctgatttttttgcatttttagtagagacagggtttcaccacgttggtcgggctggtctcgaactcctgacttcaggtgatctgcctgactcgggcctcccaaagtgctgggatgataggcatgagccactgcacctggtgccctatgcaaactcttattttattattattattttttgagacagagtctccctctgtcacccaggctggagtgcagtggtgtgatcttggctcactgcaacctccacctctcaggtgcaaacaattctcctgcttcagcctcccaagtagctggggttacagacgcgcaccaccacacccagctaatttttttctatttttagtagagatggggtttcaccatgttggctaggctgatctcaaactcctgacctcaggtgatccacccacctcggcctctcaaagcaaactcttaataacaactgttgtggaatgacttgggaggtggcactcagagatcccaagtgacacatgagaagtccacagagagagatcatgtttagtggagtttggatggttgcttttatcagtgggcctgtaccttacagatgctatctcattatcttctaaacagactctgggccagtgaccattatctccctcttactgatgtagactcagccaagagaagccagatgttgagtcggaaccttaactctccctctcagacgcagagccctgctttctcccctcccatttgatactctgcttcctcttgcatgctgtgagaggcggcctcattactcctcttccctcctccagtccctccaagcctaattcatcacctttggctttgggatcatagtttccaaaccaaggattgtctgaacattgtctgacaatgccctttttttttttttttaggcagggtcttgctctgttgcccaggctggagtgcagtggtgcaatcatggcacactgcagccttgacctcccgggctcaggtgatcctcccacccagcctcctggtgcgcatcaccacatccagctaattttggtattttttgtagagatggggttgtgccatgttgcccaagctggtctcgaacttctgggctcaagcgatcagccctccttggcctcccaaagtgctgggattataggcatgagccaccgcaactggcaccattgccattggtatttaagaggtgatggtttaggctttgaaattggggttgtttgtgaaaactgagagcaccttttgttttcagatatttcctatggccattggtgtaattggagggaagctctcgccatatataatatttttgagacagccaactaagaaactgggattctggttctctccagggtgcaaaatcctgggagaaggaagtgaattctcaggggcccagaaggagtctctaaaggacctctgccagtcaattctaatctctcttctcccctgcaaatcagcccctgcttctgcctctttctccgcctctcctagattctccccctctggagggcctgagctcccggccaccacccccaatgccgctttctgtttcctctgcctcccttcatctccttttgtctggggtttctttgtctggggtctccctttggttctgtttcacagttctcagcctcccctccctttctccacagccaggctgctcagtccctctctgcgggggcctagaggctcggtgaggggagcgggacttggttgccatggtcacattgaagccagccgcagctggcccgggcagctgctcctcctgggcccggggccccggacgctcggacaaagccaggcagcgttggcagccccagacccgaccccaaaggcctgagactggggtgactgggacctaagagaatcctgagctggaggtgagaggggggaagccagagatgaactgggagggcaggagtgggcactggagctgggccctccccttgtgggcagggaccaggcggtccccggctggaggctggaggtgtgttgggaggaggggagcggcccagagcctggcagggaggaggggaaagagagggaatagagttgggtgccatggtgtggtgaatgggctgagggactagggtgtccccaaagggggaccgttgtccagaaacaggttagattctctctttggtcctcatgtccccatctgtcccgcaggtgcctcttcctttctcagccttttatacttctcatctccccgtgtcccttagcttcacactctgcgccccagtctccctcctctttccctccactctctgtttcactccagccccttcttcccttgtccttgcttcttgtccccttgatctgtctgcccagctctcaagcctcctcagttccctgccttcctctcttaggagtttgtttccaacactgtttccttcccgagtccacttcagttccttcatccagttcagcccttttcttcccaaacttcagtctcctcctctgagcccctggggcttcccaccttttgctgtgtgtgccctgtcttcatcctccttttcctctctcagacctgtctccttggccttgacctcagtccatctccgtctctctgggaattctctcaccattgtccccatctgaccatcagcctcctctccctcttctggtcccttgcccttttcttccccaaccacagctgagctgtttcatctctctcccagagctacgtcatctcaatctcctccttcgctccctggcctcagtttccagtttattcagtggcatcaggtctgactcacacccaaagccttgtacactccttcaccctgccccccacccgtcgcttcttactctccccagctgctgacccagcctgctcctccagaggcagctgcagctcccggaaggggactgcagctagtgtatgtgtgggggcccatctggtccgtcctctcgctcgctggtcgtgctgggcttccctcctgtggccaggtggtctgcaggcctgaagctgccttctcccctctcctacgtgcctctcctcacattttttcagctgtttcccatcctctccttcctgggcagcaggctgccactggcttgaaggggagggaagcccaggatgggaggggatggtagagggtcatttgggggttctcagggacacagggggcctctggggttcggagtgatgcaggagatgtggaatgggctctggggaccacggatgggtaatcaggccctcttggtctttggtgctgctctctgggccccaggatggctgggatttccctctcaggcccctgggaatctcggctccgagtcccgcattccagctggctccagctccctttccgttgtcacttgactccactgggccccagccttgcatccctcccactcctccagcctagagctggggcgaggtgggcatcaccactaggaatttctcctgaggcagtgagaagaggggacaaaggtttcaggactctctagctccttctgctctccccagtggacccctctgtctggcactgccatgccacttagctggggtcagcgtgggcctggggtgtggaatgtcccaccagggtatgacgggctgtagcttgcctggcaggcctgttggggctttcccagagcacagctcctggaaggaggggctgtgggctgccaggtgaggtgacttgggaagccttggccccacccccaggctggccccacccccagtccagcgtctcctgggcctagattccccagctgctgttctctggaggggtaggtgttctgggggaatgaatccctgggggcttggtgggacaggaaggcgggaagaagctgctcttcgagtgaccctggggctgtctgttagcaggtccctcagccgttggaacgtccttgggcttctgaactagtgcccatgtgtgcctcggcctttcccaagggccagcttcttcctggtagtgcttttgtgtacttgtctggttgggacttcgtgtttctttcttgggattgttgtctgggactgcaagcagggtatgtttttatctactgtgaggttcctggggcggagatgtgcagtggagcgagaacttcctgtgaccgtgacattgtctaggtggtgagcaggtgtgggggtgtggagagaggtgaggggctgaggtagtgctgagtggggaaaaagcacctcccaccacaagctgttctgtcccgctccatcctctgcccagtagctctctcagttgctttgcctactcagtctcactgtttcatcttccctgggtctcttggtccccttccttttgactgtgtgtgattttcagtgtgcctccatccttctcctgctcctcttcttcctcctcccgaccactcaactttgtcctggcctcatttttggcctcttctggccagtgatcagaccctctggcccactacggccagagctggctgggcctgagggaggcttgccctgaggactcctgagtccccctcccactccactccgttgggagcccaggggaatcagggcctgggcgtctggacccccgggtcccttagaacgcccttcagagagaggaactgagaggagaaggagaagagagtgggcccgccttcagggtctggggccttccaggttgggtcgtaggggcgggagcgcacaggctgcgagagaggagcaaaggttggtggagggagaagagcagtctggggcctggctggacaggtgagccctgagacctgagctctgctcccttctctgggctaactcccgcagctgggctgggccgagcctgtgggaacctgcttcttcctctgtgccctggggctgctcccctttgcctctcccaccaggaaccgatcccagaagtaggaggggcgtcttcccctcgtgggccctgagcgggactgcagccagccccctggggcgccagctttggaggttctcgtttggggaagcgggggtgggctgcgagtgggtggagggggctgggcgcggagccggccggaggcagcggcgcgggcggctgggcggcctgggagcgcccaggcgggcttggcgggcgggttacctgggggaggccgggccgggcgctagcgcgcggggtgggcgtggcgggcgcggggcctggagctcggcgccgggcgtgggagccactgggactactgggtccgggagggggaagggagggctgcgagcccgaacgcgcggcgagaaggccgaggggagggaggggagcgaggagcgggaggaggaagggagggagccgaggcgagggggaggcggcgcctgggcccgagccgccccagccctggctcctctccccggaacaggcccccgacagctgctctcgggagccgcctcccgacacccgagccccgccggcgcctcccgctcccggctcccggctcctggctccctccgcctcccccgcccctcgccccgccgccgaagaggccccgctcccgggtcggacgcctgggtctgccgggaagagcgatgagaggtagggagagcggcggcggaacccgcgggcggaggcctggggctcttggggtgggggcgcgcggcggcgcctgcagggcgaggggcgggggaggcaggacgtcccgagccatgcttggtcgtccagctcttctaagcctccctgcccgcctccccgatgctctggcataccgtctgaaaaccgggggcggggactgggtggaggtgaagcccgtgacctcccagaaagagttttgagcctccagccttgaggcaagtcccctctcactcagtgcggaggaactgagccccgggaggaggtgctcctgtgcagccccactgagtcagctcatctatcgcctgccctccacctggccagtccctgcgggcatctaactgctaagcctccgctcagccaacacccagttggtcagtctggtcacagtccagcaaaaagagggactgccactctaacccaccagtgacaccactcttcccggctggatggtcaattagctctggcatgagagaatgtcactgccggtgagcgccagcttcagggtcccacccccccatgcctggctcttggctgaacatttcttcccagcgcttccagcagccagaggcaggcgcccaagctcgctggctgttgctgagggcctgtaggtgtgtccaggactgagtggtgtggtggagacaggtgaaaggggagtgagtggaaaggcagggaaaggctgttgtccttattgccactcttcccacccagcgcccacctgttccctgccccctcgacgtccctctggcttggtcacccatgtgtgttagaggctgggccccagttctctggggatcctgtgcccaagggcccgggtgtgtgtgtctcatgctgtcttttggtcacaggagcatgtggtgtctgtcatttcatgttcacaggtgtctgaaggtggctattcactgagcgatggggttggacttgaaggaatgccaaggtgtggacgggttgatgtatgcatgagcttctgtgtttgctctgtctcagaaactctgtgagggttgtcagggacactgagaggtgggtgtgtgcatgccacatttagcctcgctgtttacagccagttcagtaagtttgtgtgtttcaccgtgtgtgtgtgtacagagctgtgtgggtgttgtctgagtgggacttgggggttgggagaggagcgtgaagggcttgaggcagggtggcctggcccctggtttgtctttggttgtaatggagtggaagggggtgggattggggaaggtcttctgggcttgtcctctcttgccctctgggtctctgactgtggactgaagacccagtggagagagatgaggtgactgggggtgttggagaacagacagcccagacgtctctgtgcttctccgtgttcctctgcttggctctgtgccccgtgtttctgagcctgctctatttacctcttgcattgtggctctcgctctgtctccgcctgcctcgtatcctctgcctgcctttgtatctctgccccgggctcctctcggctctgtgtggctctgatgactcatctgggataggcatgaaggttacttaggggaacaagagccccgctgttcccgagagaggtggggttggagagcggcacccaggaattccaagccagtctcctgggactctggcagcctgctccccggcgctggaccctaagggaccaggcgtgatgccttctggttctagcctctgagtgccccccacaactcagtcgtccccctcagctgctgcttcagagctctggggtctcagctgcctcttacattcctgccctagtgcattgtgggagcagctggaggaggacaaagggatgggggagtatcccccactcctcctacctcctggggtgacctgccttccttgtctttagacccgccctcgtctccaaggcaactcagcctttcctcagtccctcagaggcagccaccttctggaagtgggaactggggggactggatgtctgggtctcaggaaggcagagcagggataactgggcccaagatgccctgaacctgataagaggtggcagtcgagtccctcaggactccagggcctggagacttcagtacagggctctgagaccagtacaggttaggatagcttttcctgcagcaggggaggggagagtagttacttgggtttgtaaggagatgccatttagaatagttttatgtggggtaagcttcctgggcctgaggaacagagtagggattttcaaactttaatgggcacaggtcacctgggaattgtgttaaaaggcagattttgattgagcaggtcaagggtgagcctgagattctgatttcttccatgcttccaggtattgctgatggtccagggaccaccctgggcctagagggctataggggacagtaagactagaaggtgctggggtcccctctgcccttctcttagaattctggactcctatgtgggagggcagcagggtgagctggtccaggcttatctgatgtttaattctatcatatcctcaacaaggaattgcccaacctttcctgggacatatttattttttaaaagtcaaaatgattttcatattcttttacatatcttatgattttacataaatgcatttatgttacaagatttagaaaaatagtacaatcaacctgtctttttaaatttgcttttcttttgccccgttcatgttaactcttgttatattgtattctattgttatattctattatatattctctccttctagacgtacacacaggtatatatacaaacatgggtgcttgtttattctattttcaaaaggtgggatattttttatacttctgttgcttgcttttcatattcaacagatatacatggaaatcacacaaagttaggaatatattgcctctttgttacttttcatagctgcatagtagtcaataaaccttattttttttaattccagcctgtcccctgtgggcattcacatatcttacagatttatgtcttacaaaaggtaccataataaacatctttgaaatcttcttttttatttttatttttcactttttttaaagagatggggtctcactatgttcaccaggctggtctctaactcctggcctcaagtgatcctcccatctcggcctcccaaagtgctggggttacaggcatgagccaccagacccagacctgcacatatgttcttacttcctggtgcttctctctcgagggaatgctgggtcgaagaggatgtgcatttttaattataatagacattgctagattgctttccaaatagaagataacactcatttctgccattgagcatggtgcctcccttttcatcactttctaccacttttatatgttacagccttaaaaaaatatcttgtcagtctgcttggtatttccctgaggctggtgaatttgaccattaaaaaaaatgtttgttggcaatttggctttgcttttctgtgaaatgactattcacattctttggctgtttctttattgggttacttatatattttttcttgtcagttcctaaggggccttagtttattgtagttattaaaccttttcctgttgtatgtgttataaacattttttgcacacttgttgtttgttctaagccgttgtttatggggatattttgcccattcctgattggagaaatggggctttaggaagttatttaactgatctctgccctagtttcttcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctggtgaggagactgaatcatgggtccctgagggccagggcttgggaggtagagagttgggggccttgacctgttacatgcctgctttttactcagccaagtgccgctatgccctgggcatgcaggaccggaccatcccagacagtgacatctctgcttccagctcctggtcagattccactgccgcccgccacagcaggtacttggcacacctggcacacttgtagctgccccgagaggagctcctgggacctctacttcccctccaacccctctgcccatgccagtgaaacccctgcaggctgagggggcaaatgaagtggggtttaaatactggagatggaggcagacctggggccagatgttctctgtgcccctcttcaccctcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgagactggcaggggcagcacccagaggaggttggctctcctcacttccagctgtactttaaacaccacctatacgctgacgactctccagtttatatcatctccagactaagcctctcagctgagctccaaacaatattgtaaacctggccaccttttggatttctccacttagatgtctttttttttttttctaatagatggggtcttgctgtgttgcccaggctggtcttgaactcctgggctcagtgatcctcccaccttagcctcccaaagtgctgggattacaagcactgtagccagccacctagatgtctaataggcatctcaaacgtacgtttaacttcccaagctgaatttgattcccattcccagcctaaacctgctcctcccctggcattctccagctcaggaagtggtatcaccattgcctggttgcctaggctataagttaagatgatatccttgattcctttttttctctcacctccttccaaagcatcagcagccccgtctgttctacctccatagtgttcctgagtccagtcactcctcaccactccacctctactgccctaggccacctgcccgccatctccagcttagatgagtgcagtagatgccaaacgcgtctccctgcttctgcccttttctgcctggagtcaaatctccacctgggggggcggcatccagtggaccttagagcatgtaaatcagatacgtcacacctagctgacacccccatgctggctttccactctgccagaacaaaagctgagtccctagctggtgcaggatgctcagcctgacctggctcctgcctgcatcacttgtttcttggcgcctccttggccacgctgcctttcttcttgttgctggaacaagccagggctcgttcccacagcttctggacattttctctgtgcctgcaaagctcctcccctaaataaccacaggctctccctcactccattcagttctctgccaggtgtcacctccttagagagccttttctggccacccacctcactgctctgtccatacttcctgcctcttgttcttcgcagctgttttccctgctgggatctcagtcctacaagggtggggagtgacgttcaccactgagaacgcgcctggcacagagcgggcactcagccaacttctgctgaatgaacagagggaatgggctgaaatgaaggggaagctgaggcaggggtgcagggctgtgaggattggggagaatctgggcacaatgggatgataggcttggagacaaatggatggagccaggcaaggagaagagggcagctgagcctgaagtctgaggatggaacatcagagctgcgacagagccagaggtctcagctgcagatcttcatttcacccatgcctggctgcgccccacagtgctgtgtgctcggtgccacccctcatgggtctctaagtggccactgtgggctgggccagggagcagctggtgggtgggaagtaagatctgacctggactccatcccacccaccccctgtttcctggcccacaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggaggggtgagtggctcagcttcctgggaatctgtttcctgagcaggggactggagggtggggagtgtggagaatgggcatccaggatcccttctcctgctgggaagctgtcactctgaggagggggctagccagcattgtctcctccatgccaatgagccagtggagagatacaagaagggacctgaaacctgcccaggcctgatgcagggatgggggatggagccttagtgcctctgacccccatcctctcaccctgccccagatggactcctgtcttacaccgcccctgtggggcagacaatgtatttatctgaggccgtgtacctcaacgactccacctatgacggacataccgtgggcgggtaagaaaggcccctgcaggatatggagtttggggtgggagggaggactgtgtgtgtgtgtgtgtgtgtgtgtgtgtgagagtgtgtgtgtgtaggggggctggtaagtagggtggggagtgagatggaagagctgagaagagggatgggttaggtggggcctcaaagggtagcactagggtgaccactagcccgtatgacactgtatgaaaaaggcacccctttgctaacacacattgttggaaattgctgcaataaatatacacatcatagattgaaatggtgccccttagaggtggtgcctttgtgctggatgtgacctgcaaggtacctgtagtgctggggtggggtggagagaggagaagggccagctgcatgagtgtgaggtgggatgggaatgggactagtggatgggagccaggctggccatgccactgtgccggagggtggcggagcagaatgcctggatgtcaagaccctcttcccttccaacctcctcttccttggtcccctcttctccagactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtgagtgagtccggctctcgaggagggctctgaagccatgcagggtgccgttggggtgcccccaccactcctagccttgaccctgtgccctcttcccttccccccaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctggtaagccctggagtagcccagtctccagtccctgaaattgacaactgatttcattcctaaccctgcagtgtccctaaaatactcattccttgcattatatctacccatcacccaccgaaacttctcaattaggggtgccccaaataacttgagcccctttctgcctcttgttctctgcgtatccatctttcctttgtaagccccttgcccgtgactattattgagccagtatgacagtactggttgttaaaatattgaaatacttctgtattagttgagaaatagcctcttctctaagcctccagatacctgtcctccacctccccacaatccagcaactatagggttaacacccaccacagctgggtgttccaggaccctgctcccccagcccccactggtcagtggttgcctattgagaatcacccatgcttctgctcctttgcacaacagtccactgcctctgcctcccttgggtctcctcctcatttacctccctcctttctttttgttccttctccccagatgtggtgaacaattcctctccggcactgggaggcaccttcccgccagccccctggtggccgcctggcccacctcccaccaacttcagcagcttgggtgagcaatcttgggtgggcgtgtggaccctctgcacccttctccctgggcctccccctcggctagggtgggaccctcctgtggtgctgaccctgctgcctccaccagagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcaaggtgggcacagccgtggcatgtggagtggcggggggaggccaggccccagcacgagccagcgtccagtgggacctgcagggcacagcccactagcatcccaagaggagggcttagtaaagagaccacttacaccatgtcaaagagggtatggggctcacagggagggctgctccccagctctgggtctgctcagcggagaggagcaaataccacgacccagaggagagagcctgtggagagggcaccttgacaggggcagtagactttggtcctgggatgcagctggcccgtatctacccctcagggagggcctgggagaatagatgccctgacctcactttctgccccaaactcctgctgggctcctctctggctaacccaaaccaggcctgttggtgcagtgtacactggtcagccttggggcagaagcagggtagagacaggcagagagtggggttggaggggcaaagggaagacgtctggcacaccccaagccacgtcttccggctggagtccagtggcagtaatgtacattaaggttgatgactggacacggtggctcatgcctgtaatcctagcactttgggaggccgaggcgggaggatcacctgaggtcaagagttcgagaccagcctgaccaacatggtgaaatcccatctctactaagaatacaaaattagccaggcatggtggctgatgcctgtaatcccagctactcaggaggctgaggcatgaatctcttgaacctgggaggcgaaggttgcagtgagctgagatcatgccatttcacttcagcctgggcgacaagagcaaaattccatctcaaaaaaacaaacaaacaaaaaaaaaacggttgatagttatggactgggcagatgagggttagaatctcattgtgggacagggaagttacctccatgctcttgagcttcactttctctgcctgtaagatggtgctgatagtatccacagctgtagggctcttgtgagggctgagggagggaacgcagggatggacacagcagagggccaggccgtgtgtgctgagcaacacgggtgatgcctcccatccctatgacaaggctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctggtaagacctgccttgttccagtcgcacctctgtcctctctgctgttttcttattgtatccctttcccattctctttttttcctgtcttccccagtttccacttgttttcttctttctgtgcccctggttactgtctatatcactctttgtccctaccatgtagtctctctcaagagttccccatgtattacccatagtcccccgtggtgctatcttgtctgtgtcccacagacatctctctatctttgttgtaccctctcattgtgtctccctggcccctttgctttgtattagactcaccatgtttgttccttcatctatcctccatcacccatccttccatccatagtcatacatccttgcatccatccatcaatcttccatcatctgtctttctatctatattcataaatctattcatccatccatccacccacccatatccatcatccatctatccatctatattcacacatccatctttccatctgttatccatccatccaacaaaacatctgtttaccatccatccatctattcatacgtcccatctgtccatgcattcattatccagccagccgtccgtcactctgcagatccttgttttatcctgtctgtctcttaatgcaatcatcccatcagccctggtcttgccctattcaaggtctccctgtctgtctagccttgagtctcatcccttccccgtgtttcccctcctccttctcccgacagcgttgctgctctccaatccagcctaccgcctccttctggccacttacgcccgtccccctcgaggcccgggcccccccacacccgcctgggccaaacccaccaacacccagggtaagcccctctgcccctgggctccgccaggctccccatacctctactggggcagggaaaagccctcacaccttgcacttcctcctctccccactgtggcctattctgctctcctgagctcccaaggaggaagctcttgtgcccttagctcatctctgctgctgcttgctcttttttaaggtcccccccttgagctgaggagtagaaagcttactggtccccagctcttctccctcctcctcttccacgccatctcttcagctctccagagctagacaggaggttgctgtggtggccccagactatagtaactcctcctttattctccactctctctagagctgcgaggaggagggctctcaccccgggcgcttgccctttccctcacatgtgtcctctctctgcagtcccagaggtgaaggctcatgccccaaccctttccatctgcccctcttctcctcagtgttgccttctcattgtggccccttccccagggctaagaggggacagctctgcttcctctcctgtctgtagacaacttgtgttggggctgtgagcagctgttaccctccctcctctctgtgtgcctctgtctctgcttgttgttgagcttggtgtgttgggttgaaagggttgggagggcttggccccagggggagccaggctgaaagccacgggagagcagctaagtgaaggggagggagctgtggtgaacgggacaagggtttggaaggtggagggtgcctggatgctgggaccatcctgaggcgggagaattcctggggaggaattcttcttccagccaagatttatctcacagtctcttgagagaccctagggaggccctaaaagagtaagactttatgacagttttgctcaaccatattcattgccttgaaaagctctggaatagctaactctcgtcccatgccagtgtcttcctggtttgaggttggcgcatggaatactgggaagatacagcatagacccagtctctcactcaaccgggagacacagggccctccgggaggctgaggtgtggggaactatagctcttgggctgttcctgatgcctcgtcctgtcttctttcccctcacccctgcagcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtaaggagggtgcctacccagtgtctggccctattgtgtgctctgatgccatgcctgcgcatccccctagccaggaaccttagtcatttgtaaccgtgttaatccgtttgaccctgtgaccgcctagcaaacgaacttctttctccaggtgcacctgtgtgaggtcgacagccctcaagatctggttagtcttgatttcccccttaatgtgcgtaagggacaccctttgctggtagctgtcaagatcttacggccagatgccaccaagaatgccaggtgaggaccagggatggcatctggaagaagggaggggaggccgtgaagagtggggagccatctagagagaacaatggcagagcccaacagaggggtggcatctctgggaggggatttacatgtacgctgggggtggggacgcctggtctgcctgaggtggggcaggggggtgggggcgcgggggaaggtgcaggccgcccactcggcattcctcttcagcttctccttgttctccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcaggtacctgcttacccaggctgggccttgctcagaattcccccaggggatctcctcctctcccctcgcttcagcctggaggaaaagaggggagcgtgggggtgggaagggagagaggttccaggagggcctgggataaggaatgtgtgacaagttaacccaggaacatggacagaaaggctggaggtgactatgcaagagtggtgaagggacttgggccctgccatgacgtcccttctgctttctctcaccctcactcccctctgagtccagattggggagcacaataaaagaagagccccctagtgttggccaggcctgggagattgagagggaagtgacccttggcctcacgtgggcattccacctccacatggggagccagagtgaccgggcccggggagtgggctctctctcctctcctggatgggaatctgcgaagctgcccccagtgaccttctgtcggttcccttctcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggtgagcagcccgaggacagccaggttggagcagggcaggtgggagaacactggccgccactcacagccctggtctccatcagtcacacactttctctgggttgcattttacagaatctcatctataatatgaggttctcctagcccaagggactggggaaagcaggagctgcagtgtgatgggcaagaatccaggagccaagagtgggtactggggatggagacagggtggcagagagctcaagagatgaggttgggcgaggaagctggagatagaaggggttgggtagggagaccgaaggtcaggaccagaaagtgggggtggatggagaggaaggaggagcagaaggaagaggtgggccagggccctggagagaggaccagagcatggagaggaaaggcagagcccaagggagaggagttggaaaaggtggccagcggaggagagtggagagcctggcgtcaggagggatcaggcctgagtggagcccagagtggatctggggcttccaataggaagggaggagggtctacgttgcctgatgtccctgtctgtttttgctgccttctctgcatcccaggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtcagagtggaggagagggaagatgggtccgaggcgggggacagaaggggcagagttgtcatcttggagactaaagaatatttgttccctgactctcatccacactgccacaatgcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttcc
